United States Patent 7,833,706 (GENETIC POLYMORPHISMS ASSOCIATED WITH RHEUMATOID ARTHRITIS, METHODS OF DETECTION AND USES THEREOF) - sequence listing, part 2

SEQ ID NO: 2109 - DNA, 201 bp, Homo sapiens
atttaagtatcaagcactttgttatgctgtacaatgaatggattgttcttgtttctcagatgggtagagtaaaagtgtctgtactttacaattcaactacwtgttctacccagcatttaacggcaagaactttatatttattctcaagcagggcatgtttccctttgttcacattctctgagaaattgaaactctggtttc

SEQ ID NO: 2110 - DNA, 201 bp, Homo sapiens; identical to SEQ ID NO: 2093

SEQ ID NO: 2111 - DNA, 201 bp, Homo sapiens
agaagccctatgagtgtgaggagtgtggtatgagcttcagtcagcgctcaaacctgcacatccaccagcgagatcacacaggagagaggccctacaagtgwggtgagtgtgggaagggcttcagtcagagctcgaaccttcacattcaccggtgcatccacacaggagagaagccttaccaatgctatgagtgtgggaagg

SEQ ID NO: 2112 - DNA, 201 bp, Homo sapiens; identical to SEQ ID NO: 2097
  misc_feature (1)...(201): n = A,T,C or G, or insertion/deletion polymorphism (see Tables 1-2)

SEQ ID NO: 2113 - DNA, 201 bp, Homo sapiens
atacaggcgaaaaaccttataaatgtgacaagtgtgggaagggctttagtcagagctccaaactgcacatccaccagcgagtccacactggagagaagccytatgagtgtgaggagtgtggtatgagcttcagtcagcgctcaaacctgcacatccaccagcgagatcacacaggagagaggccctacaagtgtggtgagt

SEQ ID NO: 2114 - DNA, 201 bp, Homo sapiens
ctagtcccgattatggttattacagtttgatgaaatgtggctgagatcattggcactgtggagattaagaaatgtgaggtcagagtgttgggtaaattgtrcctgcgagtgttaaggttgtcaggataatggtgggaatggggtgaagatgacaactcagcaatgacacaagaagagagtgacacagaaagattcagtagc

SEQ ID NO: 2115 - DNA, 201 bp, Homo sapiens
aaccctacaaatgtgagcaatgtgggaagggcttcacaaggagctcgagtctgcttatccatcaggcagtccacacagatgagaagccttataagtgtgasaagtgtgggaagggcttcaccaggagctcaagtctgctcatccatcatgccgtccatacaggcgaaaaaccttataaatgtgacaagtgtgggaagggct

SEQ ID NO: 2116 - DNA, 201 bp, Homo sapiens
agttccaaactcctcatccaccagagagtacatactggagagaagccctatgagtgcagcaagtgtgggaagggcttcagccagagctccaaccttcacakccaccagcgggttcacaagaaagatcctcgctaactgacattagcccattcaggtcttcacagcgctcatactgtaaaaactgttaaatatttagtatca

SEQ ID NO: 2117 - DNA, 201 bp, Homo sapiens; identical to SEQ ID NO: 2098

SEQ ID NO: 2118 - DNA, 201 bp, Homo sapiens; identical to SEQ ID NO: 2099

SEQ ID NO: 2119 - DNA, 201 bp, Homo sapiens
gaggaagagcttccgccttccccagcagagcctgttgagagagagtcgtccacagacatctgtgccttctgccacaaaaccgtgtcccccgcaagagctgyctgtggaggccataaagaggcagtaccatgcccagtgcttcacgtggcacacctgccaccgccagctagctgggcagagcttctaccaggatgggcgacc

SEQ ID NO: 2120 - DNA, 201 bp, Homo sapiens
ccgccttccccagcagagcctgttgagagagagtcgtccacagacatctgtgccttctgccacaaaaccgtgtcccccgcaagagctggctgtggaggccytaaagaggcagtaccatgcccagtgcttcacgtggcacacctgccaccgccagctagctgggcagagcttctaccaggatgggcgacccctctgcaaacc

SEQ ID NO: 2121 - DNA, 201 bp, Homo sapiens
aagaggcagtaccatgcccagtgcttcacgtggcacacctgccaccgccagctagctgggcagagcttctaccaggatgggcgacccctctgcaaaccctyctaccaggacacactggagaagtgcggcaagtgtggccaggtggtccgggagcacatcatcagggccctgggccaggccttccacccctcctgcttcatg

SEQ ID NO: 2122 - DNA, 201 bp, Homo sapiens
cccgaccacaggccccagtggagggaccttcagtccagcctgggcccagtcccctcgggcctggggaggaagagcttccgccttccccagcagagcctgtrgagagagagtcgtccacagacatctgtgccttctgccacaaaaccgtgtcccccgcaagagctggctgtggaggccataaagaggcagtaccatgcccag

SEQ ID NO: 2123 - DNA, 201 bp, Homo sapiens
gcaccccctggcagggctgcagccacagtgccagctgcacctctgcagctctccaatggaggatgctcaccccctcctcctgtcctggatggtgaggacgracttcctgacctggacctcgtcccaccccctccactgccccctccggtgctcctgtcttctgaagaagaggctcctgctccaatgggggcctcactcatt

SEQ ID NO: 2124 - DNA, 201 bp, Homo sapiens
catgtgtgtgacctgtgcccggtgcatccaggatgagagctctgccctgggcagccaaaacgagatgtactgcctagacgaattctacaagaaatttgctyccgtatgcagcatctgtgagaatcccattattcctcgggatgggaaagatgccttcaaaatcaagtgcatgggaagaaacttccatgtaaattgctacag

SEQ ID NO: 2125 - DNA, 133 bp, Homo sapiens
agctgaagccatggcctcaaagcctgagaagartgtggcatcgtctgtctttatcacccttgcacccctgtgccacgatttagctgtggttgaggaagggggcaggcggtttgtgaggcctgatgtggcctcc

SEQ ID NO: 2126 - DNA, 201 bp, Homo sapiens
atgtgtgtgacctgtgcccggtgcatccaggatgagagctctgccctgggcagccaaaacgagatgtactgcctagacgaattctacaagaaatttgctcscgtatgcagcatctgtgagaatcccattattcctcgggatgggaaagatgccttcaaaatcaagtgcatgggaagaaacttccatgtaaattgctacagg

SEQ ID NO: 2127 - DNA, 201 bp, Homo sapiens
atttagctgtggttgaggaagggggcaggcggtttgtgaggcctgatgtggcctcccctgggaggctcctgcccccatgaaggcacccggagctggcttarcgggaaagcccagcccctgggcaccccctggcagggctgcagccacagtgccagctgcacctctgcagctctccaatggaggatgctcaccccctcctcc

SEQ ID NO: 2128 - DNA, 201 bp, Homo sapiens
gtaccatgcccagtgcttcacgtggcacacctgccaccgccagctagctgggcagagcttctaccaggatgggcgacccctctgcaaaccctgctaccagyacacactggagaagtgcggcaagtgtggccaggtggtccgggagcacatcatcagggccctgggccaggccttccacccctcctgcttcatgtgtgtgac

SEQ ID NO: 2129 - DNA, 201 bp, Homo sapiens
  misc_feature (1)...(201): n = A,T,C or G, or insertion/deletion polymorphism (see Tables 1-2)
atcatcagggccctgggccaggccttccacccctcctgcttcatgtgtgtgacctgtgcccggtgcatccaggatgagagctctgccctgggcagccaaancgagatgtactgcctagacgaattctacaagaaatttgctcccgtatgcagcatctgtgagaatcccattattcctcgggatgggaaagatgccttcaaa

SEQ ID NO: 2130 - DNA, 201 bp, Homo sapiens
ttccacccctcctgcttcatgtgtgtgacctgtgcccggtgcatccaggatgagagctctgccctgggcagccaaaacgagatgtactgcctagacgaatyctacaagaaatttgctcccgtatgcagcatctgtgagaatcccattattcctcgggatgggaaagatgccttcaaaatcaagtgcatgggaagaaacttc

SEQ ID NO: 2131 - DNA, 201 bp, Homo sapiens
cccaccccgaccacaggccccagtggagggaccttcagtccagcctgggcccagtcccctcgggcctggggaggaagagcttccgccttccccagcagagwctgttgagagagagtcgtccacagacatctgtgccttctgccacaaaaccgtgtcccccgcaagagctggctgtggaggccataaagaggcagtaccatg

SEQ ID NO: 2132 - DNA, 201 bp, Homo sapiens
gactggccagctctgtggcatcttggtgtctctttgttggctcattggtttccttggacattcaatttccattttcttcatttttcaactacctttctgtkgtcccaacatcattgatcattttctgtgtgatgtagacccactgatggcattgtcctctgcccctactcacatcatagggcatgtgttccattctgtgag

SEQ ID NO: 2133 - DNA, 201 bp, Homo sapiens
catcatagggcatgtgttccattctgtgagctctcttttcatcaacctcaccatggtgtacatccttgggtcctataccttggtgctcagaactgtgcttyaggttccttcttcagctggatggcaaaaggccatctctacctgtgggtcacacttggttgttgtgtctctgttctatggagccataatgctgatgtatgt

SEQ ID NO: 2134 - DNA, 201 bp, Homo sapiens
acatccttgggtcctataccttggtgctcagaactgtgctttaggttccttcttcagctggatggcaaaaggccatctctacctgtgggtcacacttggtkgttgtgtctctgttctatggagccataatgctgatgtatgtgagtcccacacctggcaactcagttgctatgcataagctcatcacactgatatattctg

SEQ ID NO: 2135 - DNA, 148 bp, Homo sapiens
acctggcaactcagttgctatgcataagctcatcacactgatatattctgtggtaacacctgtcttaaaccccctcatctacagcctacgcaacaaggacrtgaaatatgccctccatcatgtcttctgtggaatgagaattatccag

SEQ ID NO: 2136 - DNA, 140 bp, Homo sapiens
atgaataactcacagatatctactgtgacgcagtttgtgktgttggggtttcctggtccctggaaaattcagatcatctttttctcaatgattttgttggtctacatcttcactctgactgggaatatggccatcatctg

SEQ ID NO: 2137 - DNA, 201 bp, Homo sapiens
  misc_feature (1)...(201): n = A,T,C or G, or insertion/deletion polymorphism (see Tables 1-2)
gatgctgtgtgtgccctggtggtggtcttaaggacctaccacatcaacatctggacaaccctcactgattacctgcccttggttgcactcatcaggctaantgatcccatatttaacctcaaggagaaatatcaaccagacactgcatggcaacctccttggggccagccttcaaggcttcatggccatatcatgaaccca

SEQ ID NO: 2138 - DNA, 201 bp, Homo sapiens
cacctgtgtacaatgcaggaagattgcgagaaaggatttcagtgctgttcctccttctgtgggatagtctgttcatcagaaacatttcaaaagcgcaacasaatcaaacacaagggctcagaagtcatcatgcctgccaactgaggcatatttcctagatcattttgcctctacgatgttttttcttggtccacctttagg

SEQ ID NO: 2139 - DNA, 201 bp, Homo sapiens; identical to SEQ ID NO: 2137
  misc_feature (1)...(201): n = A,T,C or G, or insertion/deletion polymorphism (see Tables 1-2)

SEQ ID NO: 2140 - DNA, 201 bp, Homo sapiens
cacctgtgtacaatgcaggaagattgcgagaaaggatttcagtgctgttcctccttctgtgggatagtctgttcatcagaaacatttcaaaagcgcaacasgcctctacgatgttttttcttggtccacctttaggaaggtattgagaagcaagaaactggaggcccaatatctaacctgcaaatcgtttttgagtttggc

SEQ ID NO: 2141 - DNA, 201 bp, Homo sapiens
tcaacagaaaatattatgtgagctttctgggcatattgatctttttgtagatgtgaataagcatctctttgatggagaagtgtgtgccatcaatcactttrtcaagttgctaaaggatataataatctgtttcttaaatatcagagctaaaaatgttgcacagaatcctttaaaacatcattcagagagaactgatatgaa

SEQ ID NO: 2142 - DNA, 201 bp, Homo sapiens
gcttaaaatggctctaccaaaattatgttttcccaaaggtcatgccttttccttatcttctgacttacaaattcagtcatgatcatctggaattatttctraagatgcttaggcaggtattagtaacaagttctagccctacctgcatggcattccagaaagcttactataatttggagaccagatacaaatttcaagatg

SEQ ID NO: 2143 - DNA, 201 bp, Homo sapiens
gagtagagaatggagatcagctctatcaatactgttcattgttaataaaaagtatacctctcaagcaacagcttcagtgggatcctagcagtcacagtttkcaggggtttatggactttggtcttggaaaacttgatgctgatgaaacgccacttgcttcagaaactgttttgttaatggcagtgggtatttttggccatt

SEQ ID NO: 2144 - DNA, 201 bp, Homo sapiens
aagagctcaatgctcatcggaaaacagggagaaacctaatctgaagatggaagcatactaaggacaattttctccactcacatccacatttgaaaagaggyacagaaaaacataggtaactctactttcacaaatgaggatagtttaacggatagaagaaacaagcacattattcacctgtgttgtaaaacatctactctt

SEQ ID NO: 2145 - DNA, 201 bp, Homo sapiens
ttcaattgctcgaaggaaagacttggcgctttggacagttcaacgtcagtatggtgtcagcgttacaaagactgtctttcacgaagagggtatttgtcaaractggtctcattgttcactaagtgaggcattactagacctgtcagatcataggcgaaatctcatctgttatgctggttatgttgcaaacaagttatcagc

SEQ ID NO: 2146 - DNA, 201 bp, Homo sapiens
  misc_feature (1)...(201): n = A,T,C or G, or insertion/deletion polymorphism (see Tables 1-2)
tgtaagaacccattcaagaatggcaatttttgaactagtttctaaacaaagggaattgtatcttcaacagaaaatattatgtgagctttctgggcatattnatctttttgtagatgtgaataagcatctctttgatggagaagtgtgtgccatcaatcactttgtcaagttgctaaaggatataataatctgtttcttaaa

SEQ ID NO: 2147 - DNA, 201 bp, Homo sapiens
agtgtctgctacgagctcaattttcagattttaagtgggagttatataattggagagaaacagatgagtactccgcagaaatgaaacaatttgcatgtacrctctacttgtgcagtagcaaagtctatgattatgtaagaaagattcttaagctgcctcattcttccatcctcagaacgagcggccagtgaggcaggagga

SEQ ID NO: 2148 - DNA, 201 bp, Homo sapiens
  misc_feature (1)...(201): n = A,T,C or G, or insertion/deletion polymorphism (see Tables 1-2)
ccagtccaggtttcaacagcaacattttttcttttcttcaacgaagagtagagaatggagatcagctctatcaatactgttcattgttaataaaaagtatncctctcaagcaacagcttcagtgggatcctagcagtcacagtttgcaggggtttatggactttggtcttggaaaacttgatgctgatgaaacgccacttg

SEQ ID NO: 2149 - DNA, 201 bp, Homo sapiens
atatgaaaactttatcaaggaaacactggtcatctgtacaggattataaatgttcaagttttgctaataccagtagtaaattcaggcatttgctaagtaaygatggatatccattcaaatgagagacctaaaatatattaacattttaattaagaatacttgatcaacattttttgaagttcaatttaccatattttataa

SEQ ID NO: 2150 - DNA, 201 bp, Homo sapiens; identical to SEQ ID NO: 2141

SEQ ID NO: 2151 - DNA, 201 bp, Homo sapiens; identical to SEQ ID NO: 2142

SEQ ID NO: 2152 - DNA, 201 bp, Homo sapiens; identical to SEQ ID NO: 2143

SEQ ID NO: 2153 - DNA, 201 bp, Homo sapiens; identical to SEQ ID NO: 2144

SEQ ID NO: 2154 - DNA, 201 bp, Homo sapiens; identical to SEQ ID NO: 2145

SEQ ID NO: 2155 - DNA, 201 bp, Homo sapiens
agtgtctgctacgagctcaattttcagattttaagtgggagttatataattggagagaaacagatgagtactccgcagaaatgaaacaatttgcatgtacrctctacttgtgcagtagcaaagtctatgattatgtaagaaagattcttaagctgcctcattcttccatcctcagaacgtggttatccaaatgccaaccca

SEQ ID NO: 2156 - DNA, 201 bp, Homo sapiens; identical to SEQ ID NO: 2148
  misc_feature (1)...(201): n = A,T,C or G, or insertion/deletion polymorphism (see Tables 1-2)

SEQ ID NO: 2157 - DNA, 201 bp, Homo sapiens; identical to SEQ ID NO: 2146
  misc_feature (1)...(201): n = A,T,C or G, or insertion/deletion polymorphism (see Tables 1-2)

SEQ ID NO: 2158 - DNA, 201 bp, Homo sapiens; identical to SEQ ID NO: 2149

SEQ ID NO: 2159 - DNA, 201 bp, Homo sapiens
ctgtgacaggaggacacactcagatacaggcagggtcacacaccgagactgtggagcaggacagaagccaaactgtaagccacggaggggctagagaacasggacagacccagacgcagccaggcagtggtcaaagatggatgcaagtgagcaaccctgaggcaggagagacagtaccgggaggacaggcccagactgggg

SEQ ID NO: 2160 - DNA, 201 bp, Homo sapiens
tggttggtgaggaatgggttgatgaccactcaagggagacagtgatcctcaggctggaccagggcaacttgcataccagtgtttcctcagcacagggccargatgcagcccagtcagaagagaagcgaggcatcacagctagagagctgtattcctacttgagaagcaccaagccatgacttccccgactccaatgtccag

SEQ ID NO: 2161 - DNA, 201 bp, Homo sapiens
ggcattaggttgacttcaaagatgcctcagttactgcaaaacattaatgggatcatcgaggccttcaggcgctatgcaaggacggagggcaactgcacagygctcacccgaggggagctgaaaagactcttggagcaagagtttgccgatgtgattgtgaaaccccacgatccagcaactgtggatgaggtcctgcgtctg

SEQ ID NO: 2162 - DNA, 201 bp, Homo sapiens
acagtggttggtgaggaatgggttgatgaccactcaagggagacagtgatcctcaggctggaccagggcaacttgcataccagtgtttcctcagcacaggrccaggatgcagcccagtcagaagagaagcgaggcatcacagctagagagctgtattcctacttgagaagcaccaagccatgacttccccgactccaatgt

SEQ ID NO: 2163 - DNA, 201 bp, Homo sapiens
ctcaagggagacagtgatcctcaggctggaccagggcaacttgcataccagtgtttcctcagcacagggccaggatgcagcccagtcagaagagaagcgargcatcacagctagagagctgtattcctacttgagaagcaccaagccatgacttccccgactccaatgtccagtactggaagaagacagctggagagagtt

SEQ ID NO: 2164 - DNA, 201 bp, Homo sapiens
tcagcacagggccaggatgcagcccagtcagaagagaagcgaggcatcacagctagagagctgtattcctacttgagaagcaccaagccatgacttccccractccaatgtccagtactggaagaagacagctggagagagtttggcttgtcctgcatggccaatccagtgggtgcatccctggacatcagctcttcatta

SEQ ID NO: 2165 - DNA, 201 bp, Homo sapiens
gacccagaaagctggagaaggcaagaggaatcagacaacagagatgaggccagagagacagccacagaccagggaacaggacagagcccaccagacaggtsagactgtgactggatctggaactcagacccaggcaggtgccacccagactgtggagcaggacagcagccaccagacaggaagaaccagcaagcagacaca

SEQ ID NO: 2166 - DNA, 162 bp, Homo sapiens
gtactcctcacaccacttaacagccacttgtttcatcccacctgggcattaggttgacttcraagatgcctcagttactgcaaaacattaatgggatcatcgaggccttcaggcgctatgcaaggacggagggcaactgcacagcgctcacccgaggggagc

SEQ ID NO: 2167 - DNA, 201 bp, Homo sapiens
caaacaacaaatagctgaggatccagaactaacgcattcaagtagtaacaagattggtgtctttaatacatctggtggaagtcactccggtcagaattcargtaccctcaatggtggagatgtcatcaatcttagacccaacaaacaaaggaccaagaaaaacagaaatccttttagcagctgtagcataccctaagatgt

SEQ ID NO: 2168 - DNA, 201 bp, Homo sapiens
cttgttaagtgatcaaaagtaaatgttctctttgccattttagatggaaaaataaaaaaaattaaaaagtaaatttttgcttttcattatattgaaatgayctggcattatctatttcacagtaatgtaaaatgcttatttttatgtcaccagttgtcaccactcccattgctgatagtgacataggttttgggggcaaaa

SEQ ID NO: 2169 - DNA, 201 bp, Homo sapiens
tgtatagcactttctcaagagctgtcagtcccacatacagaatcatttcttttacaaaatgatttaatatgtaatcatgtgtcaggacataaattttgtcrcttgggacagtagctttccagctaagataattgcgtgaactctgttaaaactgattatcactcatcaatggctttatttttaacctataaataacccctt

SEQ ID NO: 2170 - DNA, 201 bp, Homo sapiens
accacccccggcggagctgctgctgagccactcaatctgagccctggctactaataaaatttgagagggaagatctgatctcctagaattagagttggtayagaaaccatttcagctccaaaaatgttggaggaagatatggaagtcgccataaagatggtggttgtagggaatggagcagttggaaaatcaagtatgatt

SEQ ID NO: 2171 - DNA, 201 bp, Homo sapiens
ctaaatatattgttacagattttaatactgtggatcaaggaaagatagcaagcattcttttcctgaaattggtcatgtagcttttctgcgaaatagtattsaatctgaatactttcacaaaataatactgaaaggtaaaccctaaatcttgccagactgcattagtattttggcattgaaacttgtgcaatatctgtgtaa

SEQ ID NO: 2172 - DNA, 201 bp, Homo sapiens
ttaagaaacccatccagctgtcatggtatgttacaaggttttcagcagactttgctcctaatggctctctgaaagtgacagacttaaatattgctctgcamtgcttttcagaatgtagagtgagacctctggtggaaaaattattgccctgtggactcctttaattttttttacattagacgaagcttctcctgtttgtaa

SEQ ID NO: 2173 - DNA, 201 bp, Homo sapiens; identical to SEQ ID NO: 2167

SEQ ID NO: 2174 - DNA, 201 bp, Homo sapiens; identical to SEQ ID NO: 2168

SEQ ID NO: 2175 - DNA, 201 bp, Homo sapiens; identical to SEQ ID NO: 2169

SEQ ID NO: 2176 - DNA, 201 bp, Homo sapiens; identical to SEQ ID NO: 2171

SEQ ID NO: 2177 - DNA, 201 bp, Homo sapiens; identical to SEQ ID NO: 2172

SEQ ID NO: 2178 - DNA, 201 bp, Homo sapiens; identical to SEQ ID NO: 2167

SEQ ID NO: 2179 - DNA, 201 bp, Homo sapiens; identical to SEQ ID NO: 2168

SEQ ID NO: 2180 - DNA, 201 bp, Homo sapiens; identical to SEQ ID NO: 2169

SEQ ID NO: 2181 - DNA, 201 bp, Homo sapiens
cggagatccgaggagccatcggcagttcccaggagtaagaacctgagagcgtgtgagaatttgagagggaagatctgatctcctagaattagagttggtayagaaaccatttcagctccaaaaatgttggaggaagatatggaagtcgccataaagatggtggttgtagggaatggagcagttggaaaatcaagtatgatt

SEQ ID NO: 2182 - DNA, 201 bp, Homo sapiens; identical to SEQ ID NO: 2171

SEQ ID NO: 2183 - DNA, 201 bp, Homo sapiens; identical to SEQ ID NO: 2172

SEQ ID NO: 2184 - DNA, 201 bp, Homo sapiens; identical to SEQ ID NO: 2167

SEQ ID NO: 2185 - DNA, 201 bp, Homo sapiens; identical to SEQ ID NO: 2168

SEQ ID NO: 2186 - DNA, 201 bp, Homo sapiens; identical to SEQ ID NO: 2169

SEQ ID NO: 2187 - DNA, 201 bp, Homo sapiens
tccagctagagaaggtgggcggcagcgccagcccggcgccccctcccagctcccagcgatttgagagggaagatctgatctcctagaattagagttggtayagaaaccatttcagctccaaaaatgttggaggaagatatggaagtcgccataaagatggtggttgtagggaatggagcagttggaaaatcaagtatgatt

SEQ ID NO: 2188 - DNA, 201 bp, Homo sapiens; identical to SEQ ID NO: 2171

SEQ ID NO: 2189 - DNA, 201 bp, Homo sapiens; identical to SEQ ID NO: 2172

SEQ ID NO: 2190 - DNA, 201 bp, Homo sapiens
ctcaattagcccctgtagataagacatgcttcccagagtgagatttttgaaatccccttttcatccagaactatatttacccacctattgtaactattcaratagagcaaaattaggaggcttgataaatactaagaatttagtaccacagaaattatttattattttccctgtagtccacaattagtgataacgaatcct

SEQ ID NO: 2191 - DNA, 201 bp, Homo sapiens
gcccaaaaaagcagcaaaaaattgaaggaagcaaagctccatcaaatgctgaggccaaattattagagggtaagagtcgaagaatagcaggctatacgggyagtaatgctgagcagatcccagatgggaaggaaaaatcagacgtcatcaggaaagatgcaaagcagaatcagttggaaaaaagcagaacaaggtctccag

SEQ ID NO: 2192 - DNA, 201 bp, Homo sapiens
acattttgcttccatatttgaagagtctcacgtgccagtaattgaagaatctttgagagttcagatatgtgaaaaggcagaagaattaaaggacattgtgyctgaaaagaaaagcactttaaatgaaaatcagcctgagataaagcatcagtctcttctccagaaaaatgtgagtaagagggatccacccagcagtcatgg

SEQ ID NO: 2193 - DNA, 201 bp, Homo sapiens
cggtcggccagcccaaaaaagcagcaaaaaattgaaggaagcaaagctccatcaaatgctgaggccaaattattagagggtaagagtcgaagaatagcagrctatacgggcagtaatgctgagcagatcccagatgggaaggaaaaatcagacgtcatcaggaaagatgcaaagcagaatcagttggaaaaaagcagaaca

SEQ ID NO: 2194 - DNA, 201 bp, Homo sapiens
ctgctgctcgaaatggccatgtgttactaactgtcagacggaagatcttctatggagaaaaacaacccgaggacgacagctctcaggccttcatttcaacrcagaatggatctccccgcctgaaccgggcagaggtcccagccaggcctgcaccccaggagccctatgatgttgtcttgcaacgaaaagaaaatgaaggat

SEQ ID NO: 2195 - DNA, 201 bp, Homo sapiens
gtgatggtctcaatggaccatcagatgcaagtgagcagagagtatccatggcatcgtcaggcagctcccagcctgaactagtgactatccctttgattaarggccctaaagggtttgggtttgcaattgctgacagccctactggacagaaggtgaaaatgatactggatagtcagtggtgtcaaggccttcagaaaggag

SEQ ID NO: 2196 - DNA, 201 bp, Homo sapiens
ctcccaagcctccagcagaacccagcccttttcagccagatccagttgatcaagtcctctttgataatgagtttgatgcagaatctcaaagaaaacgaacracatctgtcagcaagatggaaagaatggatagctctcttcctgaagaggaagaagatgaggacaaggaagctattaatggcagtggaaacgcagaaaaca

SEQ ID NO: 2197 - DNA, 201 bp, Homo sapiens; identical to SEQ ID NO: 2190

SEQ ID NO: 2198 - DNA, 201 bp, Homo sapiens; identical to SEQ ID NO: 2191

SEQ ID NO: 2199 - DNA, 201 bp, Homo sapiens; identical to SEQ ID NO: 2192

SEQ ID NO: 2200 - DNA, 201 bp, Homo sapiens; identical to SEQ ID NO: 2193

SEQ ID NO: 2201 - DNA, 201 bp, Homo sapiens; identical to SEQ ID NO: 2194

SEQ ID NO: 2202 - DNA, 201 bp, Homo sapiens; identical to SEQ ID NO: 2195

SEQ ID NO: 2203 - DNA, 201 bp, Homo sapiens; identical to SEQ ID NO: 2196

SEQ ID NO: 2204 - DNA, 201 bp, Homo sapiens; identical to SEQ ID NO: 2191

SEQ ID NO: 2205 - DNA, 201 bp, Homo sapiens; identical to SEQ ID NO: 2190

SEQ ID NO: 2206 - DNA, 201 bp, Homo sapiens; identical to SEQ ID NO: 2192

SEQ ID NO: 2207 - DNA, 201 bp, Homo sapiens; identical to SEQ ID NO: 2193

SEQ ID NO: 2208 - DNA, 201 bp, Homo sapiens; identical to SEQ ID NO: 2194

SEQ ID NO: 2209 - DNA, 201 bp, Homo sapiens; identical to SEQ ID NO: 2195

SEQ ID NO: 2210 - DNA, 201 bp, Homo sapiens; identical to SEQ ID NO: 2196

SEQ ID NO: 2211 - DNA, 201 bp, Homo sapiens
ctgctgctccaaatggccatgtgttactaactgtcagacggaagatcttctatggagaaaaacaacccgaggacgacagctctcaggccttcatttcaacrcagaatggatctccccgcctgaaccgggcagaggtcccagccaggcctgcaccccaggagccctatgatgttgtcttgcaacgaaaagaaaatgaaggat

SEQ ID NO: 2212 - DNA, 201 bp, Homo sapiens
ctcccaagcctccagcagaacccagcccttttcagccagatccagttgatcaagtcctctttgataatgagtttgatgcagaatctcaaagaaaacgaacracatctgtcagcaagatggaaagaatggatagctctcttcctgaagaggaagaagatgaggacaaggaagctattaatggcagtggaaacgcagaaaacg

SEQ ID NO: 2213 - DNA, 201 bp, Homo sapiens; identical to SEQ ID NO: 2195

SEQ ID NO: 2214 - DNA, 201 bp, Homo sapiens
ctgcttggcattacctggtcagctggtatggtctagagcatggccagccacccattgaacgcaaggtcatagagctgcccaacatccagaaggtcgaagtrtacccagtagaactgctgcttgtccggcacaatgatttgggcaaatctcacactgttcagttcagccataccgattctattggcctagtattgcgcacag

SEQ ID NO: 2215 - DNA, 201 bp, Homo sapiens
gaaagaagatgacgaggaggataaagatgacgtccctgggccctcaactgggggcagcctccgagaccctgagccagagcaggctgggcccagctctggartcacgaacaggtgcccgttcctcctggacaattgccttggcacatctcagtggcccccaaggcgacgacgcaagcagctgttcaccctgcagacggtgaa

SEQ ID NO: 2216 - DNA, 201 bp, Homo sapiens
ttgtggagaagcactggtataagcagtgggaggcatacgtgcagggaggggaccaggactccagcaccttccctggctgcatcaacaatgccacactcttycaagatgagataaactggcgcctcaaggagggactggtggaaggcgaggattatgtgctgctcccagcagctgcttggcattacctggtcagctggtatg

SEQ ID NO: 2217 - DNA, 201 bp, Homo sapiens
cactttccacggcctcttcaagtccacgctggtgtgccccgattgtggcaatgtatctgtgaccttcgaccccttctgctacctcagtgttccactgcctrtcagccacaagagggtcttggaggtcttctttatccccatggatccgcgccgcaagccagagcagcaccggctcgtggtccccaagaaaggcaagatctc

SEQ ID NO: 2218 - DNA, 201 bp, Homo sapiens
cggagattctcatcatccacctgaaacgcttttcctacaccaagttctcccgagagaagctggacaccctcgtggagtttcctatccgggacctggacttytctgagtttgtcatccagccacagaatgagtcgaatccggagctgtacaaatatgacctcatcgcggtttccaaccattatgggggcatgcgtgatggac

SEQ ID NO: 2219 - DNA, 201 bp, Homo sapiens
agtggcactactttgatgacaacagcgtctcccctgtcaatgagaatcagatcgagtccaaggcagcctatgtcctcttctaccaacgccaggacgtggcrcgacgcctgctgtccccggccggctcatctggcgccccagcctcccctgcctgcagctccccacccagctctgagttcatggatgttaattgagagccct

SEQ ID NO: 2220 - DNA, 201 bp, Homo sapiens
tttgagaggtcacagcgctgtgtctgtgtgagtacacctgtgtctgcacccctctactcttacaggtcatagagctgcccaacatccagaaggtcgaagtrtacccagtagaactgctgcttgtccggcacaatgatttgggcaaatctcacactgttcagttcagccataccgattctattggcctagtattgcgcacag

SEQ ID NO: 2221 - DNA, 201 bp, Homo sapiens; identical to SEQ ID NO: 2215

SEQ ID NO: 2222 - DNA, 201 bp, Homo sapiens; identical to SEQ ID NO: 2216

SEQ ID NO: 2223 - DNA, 201 bp, Homo sapiens; identical to SEQ ID NO: 2217

SEQ ID NO: 2224 - DNA, 201 bp, Homo sapiens; identical to SEQ ID NO: 2218

SEQ ID NO: 2225 - DNA, 201 bp, Homo sapiens; identical to SEQ ID NO: 2219

SEQ ID NO: 2226 - DNA, 201 bp, Homo sapiens; identical to SEQ ID NO: 2214

SEQ ID NO: 2227 - DNA, 201 bp, Homo sapiens; identical to SEQ ID NO: 2215

SEQ ID NO: 2228 - DNA, 201 bp, Homo sapiens; identical to SEQ ID NO: 2216

SEQ ID NO: 2229 - DNA, 201 bp, Homo sapiens; identical to SEQ ID NO: 2217

SEQ ID NO: 2230 - DNA, 201 bp, Homo sapiens; identical to SEQ ID NO: 2218

SEQ ID NO: 2231 - DNA, 201 bp, Homo sapiens; identical to SEQ ID NO: 2219

SEQ ID NO: 2232 - DNA, 201 bp, Homo sapiens; identical to SEQ ID NO: 2216

SEQ ID NO: 2233 - DNA, 201 bp, Homo sapiens; identical to SEQ ID NO: 2219

SEQ ID NO: 2234 - DNA, 201 bp, Homo sapiens; identical to SEQ ID NO: 2217

SEQ ID NO: 2235 - DNA, 201 bp, Homo sapiens; identical to SEQ ID NO: 2218

SEQ ID NO: 2236 - DNA, 201 bp, Homo sapiens; identical to SEQ ID NO: 2215

SEQ ID NO: 2237 - DNA, 201 bp, Homo sapiens; identical to SEQ ID NO: 2214

SEQ ID NO: 2238 - DNA, 201 bp, Homo sapiens
ggcgggtatggtggtggtggaccaggatatggaaaccaaggtggtggatatggtggcggtgttggaggatatgatggttacaatgaaggaggaaattttgrcggtagtaactatggtggtggtgggaactataatgattttggaaattacagtggacaacagcaatcaaattatggacacatgaaagggggcagttttggt

SEQ ID NO: 2239 - DNA, 201 bp, Homo sapiens
gggcataactgtgaagtgaaaaaggcccttgctaaacaagtgatgcagccggctggatcacagaggggtcgtggaggtggatctggcaattgtatgggtcrcagaggaaactttggaggtggtggaggtaattttggccgtgatggaaactttggtggaagaggaggctatggtggtggaggtggtggcagcagaggtagt

SEQ ID NO: 2240 - DNA, 201 bp, Homo sapiens
aattgttgttcagaaataccacactattaatgggcataactgtgaagtgaaaaaggcccttgctaaacaagtgatgcagccggctggatcacagaggggtsgtggaggtggatctggcaattgtatgggtcacagaggaaactttggaggtggtggaggtaattttggccgtgatggaaactttggtggaagaggaggcta

SEQ ID NO: 2241 - DNA, 201 bp, Homo sapiens
ttcttagcaggagagagagtgaggagttgtcaggaaagctacaggttactttgagacagtcgtcccaagtgcattagaggaactgtaaaaatctgtcacakaaggaacgatgatccataatcagaaaagttactgcagcttaaacaggaaacccttcttgttcaggactgtcatagccacagtttgcaggaagtgcagcta

SEQ ID NO: 2242 - DNA, 201 bp, Homo sapiens
gatggttacaatgaaggaggaaattttgacggtagtaactatggtggtggtgggaactataatgattttggaaattacagtggacaacagcaatcaaattmtggacacatgaaagggggcagttttggtggaagaagctcgggcagtccctatggtggtggttatggatctggtggtggaagtggtggatatggtagcaga

SEQ ID NO: 2243 - DNA, 201 bp, Homo sapiens
gtatggtggtggtggaccaggatatggaaaccaaggtggtggatatggtggcggtgttggaggatatgatggttacaatgaaggaggaaattttgacggtrgtaactatggtggtggtgggaactataatgattttggaaattacagtggacaacagcaatcaaattatggacacatgaaagggggcagttttggtggaag

SEQ ID NO: 2244 - DNA, 201 bp, Homo sapiens
ttcttagcaggagagagagtgaggagttgtcaggaaagctgcaggttactttgagacagtcgtcccaagtgcattagaggaactgtaaaaatctgtcacakaaggaacgatgatccataatcagaaaagttactgcagcttaaacaggaaacccttcttgttcaggactgtcatagccacagtttgcaaaaagtgcagcta

SEQ ID NO: 2245 - DNA, 201 bp, Homo sapiens; identical to SEQ ID NO: 2242

SEQ ID NO: 2246 - DNA, 201 bp, Homo sapiens; identical to SEQ ID NO: 2243

SEQ ID NO: 2247 - DNA, 201 bp, Homo sapiens; identical to SEQ ID NO: 2238

SEQ ID NO: 2248 - DNA, 201 bp, Homo sapiens; identical to SEQ ID NO: 2239

SEQ ID NO: 2249 - DNA, 201 bp, Homo sapiens; identical to SEQ ID NO: 2240

SEQ ID NO: 2250 - DNA, 201 bp, Homo sapiens
cgagttggaagaggtgagtcctgtctcaaaatggaggtaaaaccgccgcctggttgcccccagcccgactccggcagtcgccgtcgccgctggggggaggrgggccatgatccaaaggaaccagagcagctgagaaaactgtttattggtggtctgagctttgaaactacagatgatagtttaagagaacattttgagaaa

SEQ ID NO: 2251 - DNA, 201 bp, Homo sapiens
attccagcacctatgtcagagctcacagagactgtggtctgtgccctggggttgtctgtgggcctcgtgggcattgtggtggggaccgtcttgatcatccraggcctgcgttcagttggtgcttccagacaccaagggcccttgtgaatcccatcctgaaaaagaaggtgttacctactaagagatgcctggggtaagccg

SEQ ID NO: 2252 - DNA, 201 bp, Homo sapiens
agcctgagattccagcacctatgtcagagctcacagagactgtggtctgtgccctggggttgtctgtgggcctcgtgggcattgtggtggggaccgtcttsatcatccgaggcctgcgttcagttggtgcttccagacaccaagggcccttgtgaatcccatcctgaaaaagaaggtgttacctactaagagatgcctggg

SEQ ID NO: 2253 - DNA, 201 bp, Homo sapiens
actgggagcctgagattccagcacctatgtcagagctcacagagactgtggtctgtgccctggggttgtctgtgggcctcgtgggcattgtggtggggacygtcttgatcatccgaggcctgcgttcagttggtgcttccagacaccaagggcccttgtgaatcccatcctgaaaaagaaggtgttacctactaagagatg

SEQ ID NO: 2254 - DNA, 201 bp, Homo sapiens
aacactgggagcctgagattccagcacctatgtcagagctcacagagactgtggtctgtgccctggggttgtctgtgggcctcgtgggcattgtggtgggsaccgtcttgatcatccgaggcctgcgttcagttggtgcttccagacaccaagggcccttgtgaatcccatcctgaaaaagaaggtgttacctactaagag

SEQ ID NO: 2255 - DNA, 201 bp, Homo sapiens
ggatgagcctcttctgaaacactgggagcctgagattccagcacctatgtcagagctcacagagactgtggtctgtgccctggggttgtctgtgggcctcrtgggcattgtggtggggaccgtcttgatcatccgaggcctgcgttcagttggtgcttccagacaccaagggcccttgtgaatcccatcctgaaaaagaag

SEQ ID NO: 2256 - DNA, 201 bp, Homo sapiens
tggagcactggggcctggatgagcctcttctgaaacactgggagcctgagattccagcacctatgtcagagctcacagagactgtggtctgtgccctgggrttgtctgtgggcctcgtgggcattgtggtggggaccgtcttgatcatccgaggcctgcgttcagttggtgcttccagacaccaagggcccttgtgaatcc

SEQ ID NO: 2257 - DNA, 174 bp, Homo sapiens
tcaccatagaggttcctgaggtcacagtgttttccaagtctcccgtgacactgggtcagcccaacaccctcatytgtcttgtggacaacatctttcctcctgtggtcaacatcacctggctgagcaatgggcactcagtcacagaaggtgtttctgagaccagcttcctctcca

SEQ ID NO: 2258 - DNA, 201 bp, Homo sapiens
aatgggcactcagtcacagaaggtgtttctgagaccagcttcctctccaagagtgatcattccttcttcaagatcagttacctcaccttcctcccttctgmtgatgagatttatgactgcaaggtggagcactggggcctggatgagcctcttctgaaacactgggagcctgagattccagcacctatgtcagagctcaca

SEQ ID NO: 2259 - DNA, 167 bp, Homo sapiens
tcaccatagaggttcctgaggtcacagtgttttccaagtctcccgtgacactgggtcagcccaacaycctcatctgtcttgtggacaacatctttcctcctgtggtcaacatcacctggctgagcaatgggcactcagtcacagaaggtgtttctgagaccagcttc

SEQ ID NO: 2260 - DNA, 201 bp, Homo sapiens
actgcaaggtggagcactggggcctggatgagcctcttctgaaacactgggagcctgagattccagcacctatgtcagagctcacagagactgtggtctgygccctggggttgtctgtgggcctcgtgggcattgtggtggggaccgtcttgatcatccgaggcctgcgttcagttggtgcttccagacaccaagggccct

SEQ ID NO: 2261 - DNA, 201 bp, Homo sapiens
cctcaccttcctcccttctgatgatgagatttatgactgcaaggtggagcactggggcctggatgagcctcttctgaaacactgggagcctgagattccarcacctatgtcagagctcacagagactgtggtctgtgccctggggttgtctgtgggcctcgtgggcattgtggtggggaccgtcttgatcatccgaggcct

SEQ ID NO: 2262 - DNA, 201 bp, Homo sapiens
agacaccaagggcccttgtgaatcccatcctgaaaaagaaggtgttacctactaagagatgcctggggtaagccgcccagctacctaattcctcagtaacmtcgatctaaaatctccatggaagcaataaattccctttaagagatctatgtcaaatttttctatctttcatccggggctgactgaacctatggctaagaa

SEQ ID NO: 2263 - DNA, 144 bp, Homo sapiens
tcaccatagaggttcctgaggtcacagtgttttccaagtctccygtgacactgggtcagcccaacaccctcatctgtcttgtggacaacatctttcctcctgtggtcaacatcacctggctgagcaatgggcactcagtcacag

SEQ ID NO: 2264 - DNA, 201 bp, Homo sapiens
gggcccttgtgaatcccatcctgaaaaagaaggtgttacctactaagagatgcctggggtaagccgcccagctacctaattcctcagtaacatcgatctawaatctccatggaagcaataaattccctttaagagatctatgtcaaatttttctatctttcatccggggctgactgaacctatggctaagaattgtgacac

SEQ ID NO: 2265 - DNA, 201 bp, Homo sapiens
ctccaagagtgatcattccttcttcaagatcagttacctcaccttcctcccttctgatgatgagatttatgactgcaaggtggagcactggggcctggatragcctcttctgaaacactgggagcctgagattccagcacctatgtcagagctcacagagactgtggtctgtgccctggggttgtctgtgggcctcgtggg

SEQ ID NO: 2266 - DNA, 140 bp, Homo sapiens
tcaccatagaggttcctgaggtcacagtgttttccaagtytcccgtgacactgggtcagcccaacaccctcatctgtcttgtggacaacatctttcctcctgtggtcaacatcacctggctgagcaatgggcactcagtc

SEQ ID NO: 2267 - DNA, 201 bp, Homo sapiens
tcctgaaaaagaaggtgttacctactaagagatgcctggggtaagccgcccagctacctaattcctcagtaacatcgatctaaaatctccatggaagcaayaaattccctttaagagatctatgtcaaatttttctatctttcatccggggctgactgaacctatggctaagaattgtgacactctcatgtttcaagccaa

SEQ ID NO: 2268 - DNA, 201 bp, Homo sapiens
tctccaagagtgatcattccttcttcaagatcagttacctcaccttcctcccttctgatgatgagatttatgactgcaaggtggagcactggggcctggaygagcctcttctgaaacactgggagcctgagattccagcacctatgtcagagctcacagagactgtggtctgtgccctggggttgtctgtgggcctcgtgg

SEQ ID NO: 2269 - DNA, 201 bp, Homo sapiens
cctcgtgggcattgtggtggggaccgtcttgatcatccgaggcctgcgttcagttggtgcttccagacaccaagggcccttgtgaatcccatcctgaaaargaaggtgttacctactaagagatgcctggggtaagccgcccagctacctaattcctcagtaacatcgatctaaaatctccatggaagcaataaattccct

SEQ ID NO: 2270 - DNA, 201 bp, Homo sapiens
gatttatgactgcaaggtggagcactggggcctggatgagcctcttctgaaacactgggagcctgagattccagcacctatgtcagagctcacagagactktggtctgtgccctggggttgtctgtgggcctcgtgggcattgtggtggggaccgtcttgatcatccgaggcctgcgttcagttggtgcttccagacacca

SEQ ID NO: 2271 - DNA, 201 bp, Homo sapiens
ggtgtaaacttgtaccagttttacggtccctctggccagtacacccatgaatttgatggagatgaggagttctacgtggacctggagaggaaggagactgyctggcggtggcctgagttcagcaaatttggaggttttgacccgcagggtgcactgagaaacatggctgtggcaaaacacaacttgaacatcatgattaaa

SEQ ID NO: 2272 - DNA, 201 bp, Homo sapiens
cacgttgcctcttgtggtgtaaacttgtaccagttttacggtccctctggccagtacacccatgaatttgatggagatgaggagttctacgtggacctggrgaggaaggagactgcctggcggtggcctgagttcagcaaatttggaggttttgacccgcagggtgcactgagaaacatggctgtggcaaaacacaacttg

SEQ ID NO: 2273 - DNA, 192 bp, Homo sapiens
atcagctgaccacgttgcctcttgtggtgtaaacttgtaccagttttacggtccctctggccagtacacccatgaatttgatggagatgagsagttctacgtggacctggagaggaaggagactgcctggcggtggcctgagttcagcaaatttggaggttttgacccgcagggtgcactgagaaacatggc

SEQ ID NO: 2274 - DNA, 188 bp, Homo sapiens
atcagctgaccacgttgcctcttgtggtgtaaacttgtaccagttttacggtccctctggccagtacacccatgaatttgatggagaygaggagttctacgtggacctggagaggaaggagactgcctggcggtggcctgagttcagcaaatttggaggttttgacccgcagggtgcactgagaaaca

SEQ ID NO: 2275 - DNA, 145 bp, Homo sapiens
atcagctgaccacgttgcctcttgtggtgtaaacttgtaccagtyttacggtccctctggccagtacacccatgaatttgatggagatgaggagttctacgtggacctggagaggaaggagactgcctggcggtggcctgagttc

SEQ ID NO: 2276 - DNA, 201 bp, Homo sapiens
tggcaaaacacaacttgaacatcatgattaaacgctacaactctaccgctgctaccaatgaggttcctgaggtcacagtgttttccaagtctcccgtgacrctgggtcagcccaacaccctcatttgtcttgtggacaacatctttcctcctgtggtcaacatcacatggctgagcaatgggcagtcagtcacagaaggtg

SEQ ID NO: 2277 - DNA, 201 bp, Homo sapiens
cggtggcctgagttcagcaaatttggaggttttgacccgcagggtgcactgagaaacatggctgtggcaaaacacaacttgaacatcatgattaaacgctmcaactctaccgctgctaccaatgaggttcctgaggtcacagtgttttccaagtctcccgtgacactgggtcagcccaacaccctcatttgtcttgtggac

SEQ ID NO: 2278 - DNA, 201 bp, Homo sapiens
ctacgtggacctggagaggaaggagactgcctggcggtggcctgagttcagcaaatttggaggttttgacccgcagggtgcactgagaaacatggctgtgrcaaaacacaacttgaacatcatgattaaacgctacaactctaccgctgctaccaatgaggttcctgaggtcacagtgttttccaagtctcccgtgacact

SEQ ID NO: 2279 - DNA, 201 bp, Homo sapiens
aggagttctacgtggacctggagaggaaggagactgcctggcggtggcctgagttcagcaaatttggaggttttgacccgcagggtgcactgagaaacatsgctgtggcaaaacacaacttgaacatcatgattaaacgctacaactctaccgctgctaccaatgaggttcctgaggtcacagtgttttccaagtctcccg

SEQ ID NO: 2280 - DNA, 201 bp, Homo sapiens
ggagatgaggagttctacgtggacctggagaggaaggagactgcctggcggtggcctgagttcagcaaatttggaggttttgacccgcagggtgcactgasaaacatggctgtggcaaaacacaacttgaacatcatgattaaacgctacaactctaccgctgctaccaatgaggttcctgaggtcacagtgttttccaag

SEQ ID NO: 2281 - DNA, 177 bp, Homo sapiens
ccaagtctcccgtgacactgggtcagcccaacaccctcatttgtcttgtggacaacatctttcctcctgtggtcaacatcacatggctgagcaatgggcastcagtcacagaaggtgtttctgagaccagcttcctctccaagagtgatcattccttcttcaagatcagttacctca

SEQ ID NO: 2282 - DNA, 201 bp, Homo sapiens
gaatttgatggagatgaggagttctacgtggacctggagaggaaggagactgcctggcggtggcctgagttcagcaaatttggaggttttgacccgcaggktgcactgagaaacatggctgtggcaaaacacaacttgaacatcatgattaaacgctacaactctaccgctgctaccaatgaggttcctgaggtcacagtg

SEQ ID NO: 2283 - DNA, 201 bp, Homo sapiens
tgattaaacgctacaactctaccgctgctaccaatgaggttcctgaggtcacagtgttttccaagtctcccgtgacactgggtcagcccaacaccctcatytgtcttgtggacaacatctttcctcctgtggtcaacatcacatggctgagcaatgggcagtcagtcacagaaggtgtttctgagaccagcttcctctcca

SEQ ID NO: 2284 - DNA, 201 bp, Homo sapiens
tgaatttgatggagatgaggagttctacgtggacctggagaggaaggagactgcctggcggtggcctgagttcagcaaatttggaggttttgacccgcagkgtgcactgagaaacatggctgtggcaaaacacaacttgaacatcatgattaaacgctacaactctaccgctgctaccaatgaggttcctgaggtcacagt

SEQ ID NO: 2285 - DNA, 201 bp, Homo sapiens
aacatcatgattaaacgctacaactctaccgctgctaccaatgaggttcctgaggtcacagtgttttccaagtctcccgtgacactgggtcagcccaacaycctcatttgtcttgtggacaacatctttcctcctgtggtcaacatcacatggctgagcaatgggcagtcagtcacagaaggtgtttctgagaccagcttc

SEQ ID NO: 2286 - DNA, 201 bp, Homo sapiens
ctctggccagtacacccatgaatttgatggagatgaggagttctacgtggacctggagaggaaggagactgcctggcggtggcctgagttcagcaaatttrgaggttttgacccgcagggtgcactgagaaacatggctgtggcaaaacacaacttgaacatcatgattaaacgctacaactctaccgctgctaccaatga

SEQ ID NO: 2287 - DNA, 201 bp, Homo sapiens
aaacttgtaccagttttacggtccctctggccagtacacccatgaatttgatggagatgaggagttctacgtggacctggagaggaaggagactgcctggyggtggcctgagttcagcaaatttggaggttttgacccgcagggtgcactgagaaacatggctgtggcaaaacacaacttgaacatcatgattaaacgcta

SEQ ID NO: 2288 - DNA, 201 bp, Homo sapiens
agttcagcaaatttggaggttttgacccgcagggtgcactgagaaacatggctgtggcaaaacacaacttgaacatcatgattaaacgctacaactctacygctgctaccaatgaggttcctgaggtcacagtgttttccaagtctcccgtgacactgggtcagcccaacaccctcatttgtcttgtggacaacatctttc

SEQ ID NO: 2289 - DNA, 201 bp, Homo sapiens; identical to SEQ ID NO: 2271

SEQ ID NO: 2290 - DNA, 201 bp, Homo sapiens; identical to SEQ ID NO: 2272

SEQ ID NO: 2291 - DNA, 193 bp, Homo sapiens
catcagctgaccacgttgcctcttgtggtgtaaacttgtaccagttttacggtccctctggccagtacacccatgaatttgatggagatgagsagttctacgtggacctggagaggaaggagactgcctggcggtggcctgagttcagcaaatttggaggttttgacccgcagggtgcactgagaaacatggc

SEQ ID NO: 2292 - DNA, 189 bp, Homo sapiens
catcagctgaccacgttgcctcttgtggtgtaaacttgtaccagttttacggtccctctggccagtacacccatgaatttgatggagaygaggagttctacgtggacctggagaggaaggagactgcctggcggtggcctgagttcagcaaatttggaggttttgacccgcagggtgcactgagaaaca

SEQ ID NO: 2293 - DNA, 146 bp, Homo sapiens
catcagctgaccacgttgcctcttgtggtgtaaacttgtaccagtyttacggtccctctggccagtacacccatgaatttgatggagatgaggagttctacgtggacctggagaggaaggagactgcctggcggtggcctgagttc

SEQ ID NO: 2294 - DNA, 201 bp, Homo sapiens
catcatgattaaacgctacaactctaccgctgctaccaatgtgctgtttcctcaccacagaggttcctgaggtcacagtgttttccaagtctcccgtgacrctgggtcagcccaacaccctcatttgtcttgtggacaacatctttcctcctgtggtcaacatcacatggctgagcaatgggcagtcagtcacagaaggtg

SEQ ID NO: 2295 - DNA, 201 bp, Homo sapiens
cggtggcctgagttcagcaaatttggaggttttgacccgcagggtgcactgagaaacatggctgtggcaaaacacaacttgaacatcatgattaaacgctmcaactctaccgctgctaccaatgtgctgtttcctcaccacagaggttcctgaggtcacagtgttttccaagtctcccgtgacactgggtcagcccaacac

SEQ ID NO: 2296 - DNA, 201 bp, Homo sapiens
ctacgtggacctggagaggaaggagactgcctggcggtggcctgagttcagcaaatttggaggttttgacccgcagggtgcactgagaaacatggctgtgrcaaaacacaacttgaacatcatgattaaacgctacaactctaccgctgctaccaatgtgctgtttcctcaccacagaggttcctgaggtcacagtgtttt

SEQ ID NO: 2297 - DNA, 201 bp, Homo sapiens
aggagttctacgtggacctggagaggaaggagactgcctggcggtggcctgagttcagcaaatttggaggttttgacccgcagggtgcactgagaaacatsgctgtggcaaaacacaacttgaacatcatgattaaacgctacaactctaccgctgctaccaatgtgctgtttcctcaccacagaggttcctgaggtcaca

SEQ ID NO: 2298 - DNA, 201 bp, Homo sapiens
ggagatgaggagttctacgtggacctggagaggaaggagactgcctggcggtggcctgagttcagcaaatttggaggttttgacccgcagggtgcactgasaaacatggctgtggcaaaacacaacttgaacatcatgattaaacgctacaactctaccgctgctaccaatgtgctgtttcctcaccacagaggttcctga

SEQ ID NO: 2299 - DNA, 177 bp, Homo sapiens; identical to SEQ ID NO: 2281

SEQ ID NO: 2300 - DNA, 201 bp, Homo sapiens
gaatttgatggagatgaggagttctacgtggacctggagaggaaggagactgcctggcggtggcctgagttcagcaaatttggaggttttgacccgcaggktgcactgagaaacatggctgtggcaaaacacaacttgaacatcatgattaaacgctacaactctaccgctgctaccaatgtgctgtttcctcaccacaga

SEQ ID NO: 2301 - DNA, 201 bp, Homo sapiens
taccgctgctaccaatgtgctgtttcctcaccacagaggttcctgaggtcacagtgttttccaagtctcccgtgacactgggtcagcccaacaccctcatytgtcttgtggacaacatctttcctcctgtggtcaacatcacatggctgagcaatgggcagtcagtcacagaaggtgtttctgagaccagcttcctctcca

SEQ ID NO: 2302 - DNA, 201 bp, Homo sapiens
tgaatttgatggagatgaggagttctacgtggacctggagaggaaggagactgcctggcggtggcctgagttcagcaaatttggaggttttgacccgcagkgtgcactgagaaacatggctgtggcaaaacacaacttgaacatcatgattaaacgctacaactctaccgctgctaccaatgtgctgtttcctcaccacag

SEQ ID NO: 2303 - DNA, 201 bp, Homo sapiens
acaactctaccgctgctaccaatgtgctgtttcctcaccacagaggttcctgaggtcacagtgttttccaagtctcccgtgacactgggtcagcccaacaycctcatttgtcttgtggacaacatctttcctcctgtggtcaacatcacatggctgagcaatgggcagtcagtcacagaaggtgtttctgagaccagcttc

SEQ ID NO: 2304 - DNA, 201 bp, Homo sapiens
ctctggccagtacacccatgaatttgatggagatgaggagttctacgtggacctggagaggaaggagactgcctggcggtggcctgagttcagcaaatttrgaggttttgacccgcagggtgcactgagaaacatggctgtggcaaaacacaacttgaacatcatgattaaacgctacaactctaccgctgctaccaatgt

SEQ ID NO: 2305 - DNA, 201 bp, Homo sapiens; identical to SEQ ID NO: 2287

SEQ ID NO: 2306 - DNA, 201 bp, Homo sapiens
agttcagcaaatttggaggttttgacccgcagggtgcactgagaaacatggctgtggcaaaacacaacttgaacatcatgattaaacgctacaactctacygctgctaccaatgtgctgtttcctcaccacagaggttcctgaggtcacagtgttttccaagtctcccgtgacactgggtcagcccaacaccctcatttgt

SEQ ID NO: 2307 - DNA, 201 bp, Homo sapiens
atattcctaccgattttgagggctggttcttctgtaccgctttcagaaagtttatatgggttattcttcagcctctcttttatgcctttcgacctctgttyatcaaccccaaaccaattacgtatctggaagttatcaataccgtggcacaggtcacttttgacattttaatttattactttttgggaattaaatccttag

SEQ ID NO: 2308 - DNA, 201 bp, Homo sapiens
ttaaaaagcttctaaaaagctatttcgccaggcacggtggctcatgcctataatcccagcactttgggaggccaaggtgggtggatcacctgaggtcaggrgttcgagaccagcctggccaacacggtgaaaccccatctctactaaaaatgcaaaaattagccgggcgtggcggcacatgcctgtaatcccagctacatg

SEQ ID NO: 2309 - DNA, 201 bp, Homo sapiens
gttttgctttattaaaaagctaataaacagctattaatcacagtgtattagtatttgttacatttttgtatttcactatctttatactatataatatggtwacttgggtaccgggggaactttaaaatttcatctcaaaaataatttttaaaaagcctgaggtatgatatagcataaaagattgagatgaaaatatatttc

SEQ ID NO: 2310 - DNA, 201 bp, Homo sapiens
aaacttgtgacttgtgtattatcgtcattgaggatgtttcactcatgtctgtcattttataagcatatcatttaaaaagcttctaaaaagctatttcgccrggcacggtggctcatgcctataatcccagcactttgggaggccaaggtgggtggatcacctgaggtcaggagttcgagaccagcctggccaacacggtga

SEQ ID NO: 2311 - DNA, 132 bp, Homo sapiens
atttccctgtaagctgaattactcatttaaaaattttaacttctatatgggacccgaattagacactgctgaatcctgtacagccttactcataaataaartacttactgaatttccaccattcaaattcat

SEQ ID NO: 2312 - DNA, 201 bp, Homo sapiens
actcaagaatgaagaggcaccaaaaaggagagatggtgctggagtaaatatcattagtgccaaagggattcttctccaaaactttagatgataaaatggartttttgcattattaaacttgagaccagtgatgctcagaagctcccctggcacaatttcagagtaagagctcggtgataccaagaagtgaatctggctttt

SEQ ID NO: 2313 - DNA, 201 bp, Homo sapiens
tacatgttcttaaagggtcatgaaacttactcatattatgggcctctgaatttacttaccttcaatgtgggttatcataatgaacatcatgatttccccarcattcctggaaaaagtcttccactggtgaggaaaatagcagctgaatactatgacaacctccctcactacaattcctggataaaagtactgtatgatttt

SEQ ID NO: 2314 - DNA, 142 bp, Homo sapiens
atgaaaatatatttccctgtaagctgaattactcatttaaaaattttaacttctatatgggacccgaattagacactgctgaatcctgtacagccttactrataaataaagtacttactgaatttccaccattcaaattcat

SEQ ID NO: 2315 - DNA, 201 bp, Homo sapiens; identical to SEQ ID NO: 2307

SEQ ID NO: 2316 - DNA, 150 bp, Homo sapiens
gttttgctttattaaaaagctaataaacagctattaatcacagtgtattagtatttgttacatttttgtatttcactatctttatactatataatatggtwacttgggtaccgggggaactttaaaatttcatctcaaaaataattttta

SEQ ID NO: 2317 - DNA, 201 bp, Homo sapiens
actcaagaatgaagaggcaccaaaaaggagagatggtgctggagtaaatatcattagtgccaaagggattcttctccaaaactttagatgataaaatggarccgggcgtggcggcacatgcctgtaatcccagctacatgggaggctgaggtgggagaattgcttgaacccaggaggcggaggcagaggctgcagtgaccc

SEQ ID NO: 2318 - DNA, 201 bp, Homo sapiens; identical to SEQ ID NO: 2313

SEQ ID NO: 2319 - DNA, 201 bp, Homo sapiens
gaccctcaaacagttcctcgactattttaagacagagcacaaattagagatcaccatgctgtcccagggcgtgtccatgctctattccttcttcatgccakctgccaagctcaaggaacggttggatcagccgatgacagagattgtgagccgtgtgtcgaagcgaaagctgggccgccacgtgcgggcgctggtgcttga

SEQ ID NO: 2320 - DNA, 201 bp, Homo sapiens
tgggatcgctttgaggtacaagggctgcagcctaatggtgaggagatgaccctcaaacagttcctcgactattttaagacagagcacaaattagagatcamcatgctgtcccagggcgtgtccatgctctattccttcttcatgccagctgccaagctcaaggaacggttggatcagccgatgacagagattgtgagccgt

SEQ ID NO: 2321 - DNA, 201 bp, Homo sapiens
acattggcttccaggccctgcaccagttctgtgctcagcatggccggccacctcggccccgcaatgaggaggatgcagcagaactggtagccttagcacargctgtgaatgctcgagccctgccagcagtgcagcaaaataacctggacgaggacctcatccggaagctggcatatgtggctgctggggatctggcaccca

SEQ ID NO: 2322 - DNA, 201 bp, Homo sapiens
gaaccgtgtgggtcctgacacggagcgcatctatgatgacgattttttccaaaacctagatggcgtggccaatgccctggacaacgtggatgcccgtgagsttggaggcgggtgaggtggtcacgggcaaagttgtgtgtgtttcggtgtgtatataccaagaggggtgtccgtctttctgtcctctcctgatgtttcttt

SEQ ID NO: 2323 - DNA, 201 bp, Homo sapiens
agaactggtagccttagcacaggctgtgaatgctcgagccctgccagcagtgcaggatctggcacccataaacgccttcattgggggcctggctgcccagraagtcatgaaggcctgctccgggaagttcatgcccatcatgcagtggctatactttgatgcccttgagtgtctccctgaggacaaagaggtcctcacaga

SEQ ID NO: 2324 - DNA, 201 bp, Homo sapiens
gcagctgtgcgccaaatgaatccacatatccgggtgacaagccaccagaaccgtgtgggtcctgacacggagcgcatctatgatgacgattttttccaaaycctagatggcgtggccaatgccctggacaacgtggatgcccgtgagtttggaggcgggtgaggtggtcacgggcaaagttgtgtgtgtttcggtgtgtat

SEQ ID NO: 2325 - DNA, 201 bp, Homo sapiens
gccaccagaaccgtgtgggtcctgacacggagcgcatctatgatgacgattttttccaaaacctagatggcgtggccaatgccctggacaacgtggatgcrcgtgagtttggaggcgggtgaggtggtcacgggcaaagttgtgtgtgtttcggtgtgtatataccaagaggggtgtccgtctttctgtcctctcctgatg

SEQ ID NO: 2326 - DNA, 201 bp, Homo sapiens
cagaccggcacaagagcaagctgattgcagggaagatcatcccagccattgccacgaccacagcagccgtggttggccttgtgtgtctggagctgtacaakgttgtgcaggggcaccgacagcttgactcctacaagaatggtttcctcaacttggccctgcctttctttggtttctctgaaccccttgccgcaccacgtc

SEQ ID NO: 2327 - DNA, 201 bp, Homo sapiens
cgtggctgcatccaacctccgggcagaaaactatgacattccttctgcagaccggcacaagagcaagctgattgcagggaagatcatcccagccattgccmcgaccacagcagccgtggttggccttgtgtgtctggagctgtacaaggttgtgcaggggcaccgacagcttgactcctacaagaatggtttcctcaactt

SEQ ID NO: 2328 - DNA, 201 bp, Homo sapiens
gcccgacacgggtttgagagcggggactttgtctccttttcagaagtacagggcatggttgaactcaacggaaatcagcccatggagatcaaagtcctggrtccttatacctttagcatctgtgacacctccaacttctccgactacatccgtggaggcatcgtcagtcaggtcaaagtacctaagaagattagctttaaa

SEQ ID NO: 2329 - DNA, 201 bp, Homo sapiens
atgacagagattgtgagccgtgtgtcgaagcgaaagctgggccgccacgtgcgggcgctggtgcttgagctgtgctgtaacgacgagagcggcgaggatgkcgaggttccctatgtccgatacaccatccgctgaccccgtctgctcctctaggctggccccttgtccacccctctccacaccccttccagcccagggttc

SEQ ID NO: 2330 - DNA, 201 bp, Homo sapiens
ccttcttcatgccagctgccaagctcaaggaacggttggatcagccgatgacagagattgtgagccgtgtgtcgaagcgaaagctgggccgccacgtgcgmgcgctggtgcttgagctgtgctgtaacgacgagagcggcgaggatgtcgaggttccctatgtccgatacaccatccgctgaccccgtctgctcctctagg

SEQ ID NO: 2331 - DNA, 201 bp, Homo sapiens
gcaaaataacctggacgaggacctcatccggaagctggcatatgtggctgctggggatctggcacccataaacgccttcattgggggcctggctgcccagraagtcatgaaggcctgctccgggaagttcatgcccatcatgcagtggctatactttgatgcccttgagtgtctccctgaggacaaagaggtcctcacaga

SEQ ID NO: 2332 - DNA, 174 bp, Homo sapiens
gtcaggagatcgagaccatcctggctaacaaggtgaaaccccgtctctactaaaaatacaaaaaattagccgggcgcggtggcgggcgcctgtagtcccarctactcgggaggctgaggcaggagaatggcgtgaacctgggaagcggagcttgcagtgagccgagattgcacc

SEQ ID NO: 2333 - DNA, 201 bp, Homo sapiens
tggactgaggtgcgagaggctccatcaggcacacatgcagtcgaggattactggtttgaaacaaagatgtcagccctaaagcaaagcacttctgaagcatrtgttctgggagagcgaacgaaaagtgtcatgatggaaaaaggcctggactgggagggcagaagctccacagagaagaactataagtgcaaggaatgtggg

SEQ ID NO: 2334 - DNA, 201 bp, Homo sapiens
gcaggattctcagcccttgcctgggagaacagttcaggagacagatggccccaagagcccagatccagggaccgctgacatttggggatgtggctgtggcytttacccggattgagtggagacacctggatgctgctcagcgggccctgtacagggatgtgatgctggagaactatgggaatctggtgtctgtggggcttc

SEQ ID NO: 2335 - DNA, 201 bp, Homo sapiens
gagccctggactgaggtgcgagaggctccatcaggcacacatgcagtcgaggattactggtttgaaacaaagatgtcagccctaaagcaaagcacttctgyagcatctgttctgggagagcgaacgaaaagtgtcatgatggaaaaaggcctggactgggagggcagaagctccacagagaagaactataagtgcaaggaa

SEQ ID NO: 2336 - DNA, 201 bp, Homo sapiens
  misc_feature (1)...(201): n = A,T,C or G, or insertion/deletion polymorphism (see Tables 1-2)
agaattcattctagggagaaaccccacaaatgcattgaatgtggaaaaactttcagaaagaactcaatccttttaagtcatcagagaattcatactggccngaaaccctacaaatgtaatgactgtgggaaagccttcgctcagaatgcagctcttactcgtcatgaaagaatacatagtggagagaagccttttaaatgt

SEQ ID NO: 2337 - DNA, 201 bp, Homo sapiens
gcattgaatgtggaaaaactttcagaaagaactcaatccttttaagtcatcagagaattcatactggccagaaaccctacaaatgtaatgactgtgggaargccttcgctcagaatgcagctcttactcgtcatgaaagaatacatagtggagagaagccttttaaatgtaacaagtgtgggagagctttcagggataatt

SEQ ID NO: 2338 - DNA, 201 bp, Homo sapiens
tacccttgttaaagaagcaagtttcaggaaatctatattatatgcattcaaaaagacctggacaaataaagaccaatcttaacagcagttatctctctctttctctcttttttttttttttttaaaagaaactagctcttactctgtcacccaggctggagtgccatgtgatcatagctcactgtagttttgaacttgggc

SEQ ID NO: 2339 - DNA, 201 bp, Homo sapiens
tagctcactgtagttttgaacttgggcttgaacaaccttcccacttcagtctctggagtagctggggctacaggcacgtaccaccacactcagctaacagyagttatctttgatgaggatgtagtataggttgagcatccataactggaaaatctgaaatctgaagtgctccaaaatccaaaatttgtctgagcaccaaca

SEQ ID NO: 2340 - DNA, 174 bp, Homo sapiens; identical to SEQ ID NO: 2332

SEQ ID NO: 2341 - DNA, 201 bp, Homo sapiens; identical to SEQ ID NO: 2333

SEQ ID NO: 2342 - DNA, 201 bp, Homo sapiens; identical to SEQ ID NO: 2334

SEQ ID NO: 2343 - DNA, 201 bp, Homo sapiens; identical to SEQ ID NO: 2335

SEQ ID NO: 2344 - DNA, 201 bp, Homo sapiens; identical to SEQ ID NO: 2336
  misc_feature (1)...(201): n = A,T,C or G, or insertion/deletion polymorphism (see Tables 1-2)

SEQ ID NO: 2345 - DNA, 201 bp, Homo sapiens; identical to SEQ ID NO: 2337

SEQ ID NO: 2346 - DNA, 201 bp, Homo sapiens; identical to SEQ ID NO: 2338

SEQ ID NO: 2347 - DNA, 201 bp, Homo sapiens; identical to SEQ ID NO: 2339

SEQ ID NO: 2348 - DNA, 201 bp, Homo sapiens
gagccctggactgaggtgcgagaggctccatcaggcacacatgcagtcgaggattactggtttgaaacaaagatgtcagccctaaagcaaagcacttctgyagcatccgttctgggagagcgaacgaaaagtgtcatgatggaaaaaggcctggactgggagggcagaagctccacagagaagaactataagtgcaaggaa

SEQ ID NO: 2349 - DNA, 201 bp, Homo sapiens
tggactgaggtgcgagaggctccatcaggcacacatgcagtcgaggattactggtttgaaacaaagatgtcagccctaaagcaaagcacttctgaagcatrcgttctgggagagcgaacgaaaagtgtcatgatggaaaaaggcctggactgggagggcagaagctccacagagaagaactataagtgcaaggaatgtggg

SEQ ID NO: 2350 - DNA, 201 bp, Homo sapiens; identical to SEQ ID NO: 2336
  misc_feature (1)...(201): n = A,T,C or G, or insertion/deletion polymorphism (see Tables 1-2)

SEQ ID NO: 2351 - DNA, 201 bp, Homo sapiens
caggattctcagcccttgcctgggagaacagttcaggagacagatggcccccaagagcccagatccagggaccgctgacatttggggatgtggctgtggcytttacccggattgagtggagacacctggatgctgctcagcgggccctgtacagggatgtgatgctggagaactatgggaatctggtgtctgtggggcttc

SEQ ID NO: 2352 - DNA, 201 bp, Homo sapiens; identical to SEQ ID NO: 2337

SEQ ID NO: 2353 - DNA, 201 bp, Homo sapiens
cgctgcctaatgaagttctatgctgtggtggccacctcacctgcatcttgggagagccacaagattgcagagaggatagaacagaggatcctgaactccarccctgtcatggaagcttttgggaatgcgtgtacactgaggaataacaacagcagtcgctttgggaagttcatccagctccagctgaacagggctcagcaa

SEQ ID NO: 2354 - DNA, 201 bp, Homo sapiens
cccgcccgcctttccagtctggccgggcgggggcctgaagcacggcggctcgggccgtgggaccgtgttcacaccctttccagaaattcttggctggtaascgcgaaaccgactggagcaggagctgggagaactggagaaaactgctctaatctcacttgactccagctaggagctgatgctgcatcgtaataacatttg

SEQ ID NO: 2355 - DNA, 201 bp, Homo sapiens
gtgaacagacctacaggaatgtcaagagcctgattgaaccagtcaaccagtctattgttgtcagtggagagagtggtgctggaaagacatggacgtctcgytgcctaatgaagttctatgctgtggtggccacctcacctgcatcttgggagagccacaagattgcagagaggatagaacagaggatcctgaactccaacc

SEQ ID NO: 2356 - DNA, 201 bp, Homo sapiens
ccatgactaggtggatagtactccttgtacctcctgcaacccagaaccctggctgaccactttgaaggaggatgctccagcaggtcaatggccacaatccrgggtctgatggccaagccagggagtacctcagagaagacctgcaggagttcctgggtggggaggtcctgctgtacaaactggatgacctcaccagggtga

SEQ ID NO: 2357 - DNA, 201 bp, Homo sapiens
  misc_feature (1)...(201): n = A,T,C or G, or insertion/deletion polymorphism (see Tables 1-2)
cgccacttaagtttggcagagatgacgggcagccctttgcatagagcttttccctggacttggagttggtctttccctgaggatctaggactttgggcccntctgtgctacctccaaggaatcagtcacctctgttctgctgagtctggagaccaggtggtggggtggacggggcataaggaagagtgatgcatacacagt

SEQ ID NO: 2358 - DNA, 201 bp, Homo sapiens
agacctacaggaatgtcaagagcctgattgaaccagtcaaccagtctattgttgtcagtggagagagtggtgctggaaagacatggacgtctcgctgcctratgaagttctatgctgtggtggccacctcacctgcatcttgggagagccacaagattgcagagaggatagaacagaggatcctgaactccaaccctgtca

SEQ ID NO: 2359 - DNA, 201 bp, Homo sapiens
ccagcccatggtcccatgactaggtggatagtactccttgtacctcctgcaacccagaaccctggctgaccactttgaaggaggatgctccagcaggtcartggccacaatccggggtctgatggccaagccagggagtacctcagagaagacctgcaggagttcctgggtggggaggtcctgctgtacaaactggatgac

SEQ ID NO: 2360 - DNA, 201 bp, Homo sapiens; identical to SEQ ID NO: 2353

SEQ ID NO: 2361 - DNA, 201 bp, Homo sapiens
  misc_feature (1)...(201): n = A,T,C or G, or insertion/deletion polymorphism (see Tables 1-2)
taaagagctggatggtgtggaagaaaaacacttctctcaagctccctgttccctgagcacctcgccgctgcagaccaggctcctggaggcaataatccgcntctggcccctgggactggtcctggccaatacggctatgggtgtaggcagctttcagaggaaattagtggtctgggcttgcctccagctccccaggggcag

SEQ ID NO: 2362 - DNA, 184 bp, Homo sapiens
ttagtatttaattagttgatttatttaatgtaatttcaaacaattaaattatgaataatgcaatgtacagtagaatcacgttttgattttattaacactgmccaagtttaactccatatgaagtgtaagcttgatatcgtttatgatgtctatcaactgtaccaaaagtaaaacatttaaaaac

SEQ ID NO: 2363 - DNA, 201 bp, Homo sapiens; identical to SEQ ID NO: 2354

SEQ ID NO: 2364 - DNA, 201 bp, Homo sapiens
cctcgtggagaccatccatatcagtgctgctggcttccccatccgggtctctcaccgaaactttgtagaacgatacaagttactaagaaggcttcatcctygcacatcctctggccccgacagcccatatcctgccaaagggctccctgaatggtgtccacacagcgaggaagccacgcttgaacctctcatccaggacat

SEQ ID NO: 2365 - DNA, 201 bp, Homo sapiens; identical to SEQ ID NO: 2358

SEQ ID NO: 2366 - DNA, 201 bp, Homo sapiens
gaacctctcatccaggacattctccacactctgccggtcctaactcaggcagcagccataactggtgactcggctgaggccatgccagcccccatgcactrtggcaggaccaaggtgttcatgactgactctatgctggagcttctggaatgtgggcgtgcccgggtgctggagcagtgtgcccgctgcatccagggtggc

SEQ ID NO: 2367 - DNA, 201 bp, Homo sapiens; identical to SEQ ID NO: 2355

SEQ ID NO: 2368 - DNA, 201 bp, Homo sapiens; identical to SEQ ID NO: 2356

SEQ ID NO: 2369 - DNA, 201 bp, Homo sapiens
tgtgcatcaactacgccaatgagaagctgcactggaggcctgtggcctcgtggagaccatccatatcagtgctgctggcttccccatccgggtctctcacmgaaactttgtagaacgatacaagttactaagaaggcttcatccttgcacatcctctggccccgacagcccatatcctgccaaagggctccctgaatggtg

SEQ ID NO: 2370 - DNA, 201 bp, Homo sapiens
ggagcttctggaatgtgggcgtgcccgggtgctggagcagtgtgcccgctgcatccagggtggctggaggcgacaccggcaccgagagcaggagcggcagyggcgggccgtcatgctcatccaggcagccattcgttcctggttaactcggaaacacatccagaggctgcatgcagctgccacagtcatcaagcgtgcatg

SEQ ID NO: 2371 - DNA, 201 bp, Homo sapiens; identical to SEQ ID NO: 2359

SEQ ID NO: 2372 - DNA, 201 bp, Homo sapiens
tggagatggtgcagattagaaccatcagggcaggcagacagcagcaggtgttccggaagccctgcgcccgagccgagtgtgacacccgtagagactgcctrgccaaactgatctatgcgcggttgtttgactggctggtatcagtgatcaacagcagcatctgtgcagacaccgactcgtggaccactttcataggcctgc

SEQ ID NO: 2373 - DNA, 201 bp, Homo sapiens; identical to SEQ ID NO: 2353

SEQ ID NO: 2374 - DNA, 201 bp, Homo sapiens; identical to SEQ ID NO: 2361
  misc_feature (1)...(201): n = A,T,C or G, or insertion/deletion polymorphism (see Tables 1-2)

SEQ ID NO: 2375 - DNA, 184 bp, Homo sapiens; identical to SEQ ID NO: 2362

SEQ ID NO: 2376 - DNA, 201 bp, Homo sapiens; identical to SEQ ID NO: 2354

SEQ ID NO: 2377 - DNA, 201 bp, Homo sapiens; identical to SEQ ID NO: 2364

SEQ ID NO: 2378 - DNA, 201 bp, Homo sapiens
gtctggcagagatgggcacttgggccatgattgggagctgcccttctgctgtcgtgattgtactcagcagaacggcccttcccagagtaggcccacgtcaygccctctcctactcccacccatccttttctttcccccaggtcctagctggactgctgcaccttggcaatatccagtttgctgcctccgaggatgaagccc

SEQ ID NO: 2379 - DNA, 201 bp, Homo sapiens; identical to SEQ ID NO: 2358

SEQ ID NO: 2380 - DNA, 201 bp, Homo sapiens; identical to SEQ ID NO: 2366

SEQ ID NO: 2381 - DNA, 201 bp, Homo sapiens; identical to SEQ ID NO: 2355

SEQ ID NO: 2382 - DNA, 201 bp, Homo sapiens; identical to SEQ ID NO: 2356

SEQ ID NO: 2383 - DNA, 201 bp, Homo sapiens; identical to SEQ ID NO: 2369

SEQ ID NO: 2384 - DNA, 201 bp, Homo sapiens; identical to SEQ ID NO: 2370

SEQ ID NO: 2385 - DNA, 201 bp, Homo sapiens; identical to SEQ ID NO: 2359

SEQ ID NO: 2386 - DNA, 201 bp, Homo sapiens; identical to SEQ ID NO: 2372

SEQ ID NO: 2387 - DNA, 201 bp, Homo sapiens; identical to SEQ ID NO: 2353

SEQ ID NO: 2388 - DNA, 201 bp, Homo sapiens; identical to SEQ ID NO: 2354

SEQ ID NO: 2389 - DNA, 201 bp, Homo sapiens; identical to SEQ ID NO: 2356

SEQ ID NO: 2390 - DNA, 201 bp, Homo sapiens; identical to SEQ ID NO: 2355

SEQ ID NO: 2391 - DNA, 201 bp, Homo sapiens
  misc_feature (1)...(201): n = A,T,C or G, or insertion/deletion polymorphism (see Tables 1-2)
ttaaagatgagaaaatgagtcagaggtttgtaaagtgatttgtcccatacatggcagcatggactggtacatgaaagtgctgggtttgagttctgactgcngtttatggagtcctttgggtgagtcacttcactgatcagaacttaggtttcttctgtccagttgggcaagtcatggtcccgctgtgatgacttcacagtg

SEQ ID NO: 2392 - DNA, 201 bp, Homo sapiens; identical to SEQ ID NO: 2359

SEQ ID NO: 2393 - DNA, 121 bp, Homo sapiens
tggagatggtgcagattagaaccatcagggcaggcagacagcagcaggtgttccggaagccctgcgcccgagccgagtgtgacacccgtagagactgcctrgccaaactgatctatgcgcg

SEQ ID NO: 2394 - DNA, 201 bp, Homo sapiens; identical to SEQ ID NO: 2358

SEQ ID NO: 2395 - DNA, 201 bp, Homo sapiens; identical to SEQ ID NO: 2353

SEQ ID NO: 2396 - DNA, 201 bp, Homo sapiens; identical to SEQ ID NO: 2354

SEQ ID NO: 2397 - DNA, 201 bp, Homo sapiens; identical to SEQ ID NO: 2355

SEQ ID NO: 2398 - DNA, 201 bp, Homo sapiens; identical to SEQ ID NO: 2356

SEQ ID NO: 2399 - DNA, 201 bp, Homo sapiens; identical to SEQ ID NO: 2357
  misc_feature (1)...(201): n = A,T,C or G, or insertion/deletion polymorphism (see Tables 1-2)

SEQ ID NO: 2400 - DNA, 201 bp, Homo sapiens; identical to SEQ ID NO: 2358

SEQ ID NO: 2401 - DNA, 201 bp, Homo sapiens; identical to SEQ ID NO: 2359

SEQ ID NO: 2402 - DNA, 201 bp, Homo sapiens; identical to SEQ ID NO: 2361
  misc_feature (1)...(201): n = A,T,C or G, or insertion/deletion polymorphism (see Tables 1-2)

SEQ ID NO: 2403 - DNA, 201 bp, Homo sapiens; identical to SEQ ID NO: 2353

SEQ ID NO: 2404 - DNA, 184 bp, Homo sapiens; identical to SEQ ID NO: 2362

SEQ ID NO: 2405 - DNA, 201 bp, Homo sapiens; identical to SEQ ID NO: 2354

SEQ ID NO: 2406 - DNA, 201 bp, Homo sapiens; identical to SEQ ID NO: 2364

SEQ ID NO: 2407 - DNA, 201 bp, Homo sapiens; identical to SEQ ID NO: 2358

SEQ ID NO: 2408 - DNA, 201 bp, Homo sapiens; identical to SEQ ID NO: 2355

SEQ ID NO: 2409 - DNA, 201 bp, Homo sapiens; identical to SEQ ID NO: 2356

SEQ ID NO: 2410 - DNA, 201 bp, Homo sapiens; identical to SEQ ID NO: 2366

SEQ ID NO: 2411 - DNA, 201 bp, Homo sapiens; identical to SEQ ID NO: 2370

SEQ ID NO: 2412 - DNA, 201 bp, Homo sapiens
gacctttctccaagaggaggtcctgagccagctggaggcctgtggcctcgtggagaccatccatatcagtgctgctggcttccccatccgggtctctcacmgaaactttgtagaacgatacaagttactaagaaggcttcatccttgcacatcctctggccccgacagcccatatcctgccaaagggctccctgaatggtg

SEQ ID NO: 2413 - DNA, 201 bp, Homo sapiens; identical to SEQ ID NO: 2372

SEQ ID NO: 2414 - DNA, 201 bp, Homo sapiens; identical to SEQ ID NO: 2359

SEQ ID NO: 2415 - DNA, 201 bp, Homo sapiens; identical to SEQ ID NO: 2354

SEQ ID NO: 2416 - DNA, 201 bp, Homo sapiens; identical to SEQ ID NO: 2372

SEQ ID NO: 2417 - DNA, 201 bp, Homo sapiens; identical to SEQ ID NO: 2361
  misc_feature (1)...(201): n = A,T,C or G, or insertion/deletion polymorphism (see Tables 1-2)

SEQ ID NO: 2418 - DNA, 201 bp, Homo sapiens; identical to SEQ ID NO: 2353

SEQ ID NO: 2419 - DNA, 201 bp, Homo sapiens; identical to SEQ ID NO: 2356

SEQ ID NO: 2420 - DNA, 201 bp, Homo sapiens; identical to SEQ ID NO: 2370

SEQ ID NO: 2421 - DNA, 201 bp, Homo sapiens; identical to SEQ ID NO: 2364

SEQ ID NO: 2422 - DNA, 201 bp, Homo sapiens
gtgcatcaactacgccaatgagaagctgcagctggaggcctgtggcctcgtggagaccatccatatcagtgctgctggcttccccatccgggtctctcacmgaaactttgtagaacgatacaagttactaagaaggcttcatccttgcacatcctctggccccgacagcccatatcctgccaaagggctccctgaatggtg

SEQ ID NO: 2423 - DNA, 201 bp, Homo sapiens; identical to SEQ ID NO: 2359

SEQ ID NO: 2424 - DNA, 201 bp, Homo sapiens; identical to SEQ ID NO: 2355

SEQ ID NO: 2425 - DNA, 201 bp, Homo sapiens; identical to SEQ ID NO: 2366

SEQ ID NO: 2426 - DNA, 201 bp, Homo sapiens; identical to SEQ ID NO: 2358

SEQ ID NO: 2427 - DNA, 108 bp, Homo sapiens
atgtggasgggtagtgacctgcgcccccggccggtgtcactcacaggcctcactctggttgtagtagccgctcagggtccgcaggttcactcggtaaaactgtgcttt

SEQ ID NO: 2428 - DNA, 201 bp, Homo sapiens
ctggttgtagtagccgctcagggtccgcaggttcactcggtaaaactgtgctttggccttggcggtccctgtctcctcttcccaatattccggcccctcckgctccatccacggcgcccgcggctccatcctgggactcgtggcgtcgctgtcgagccgcacgcactgcgtgtcgtccacgtcgcccacggagaggaagcg

SEQ ID NO: 2429 - DNA, 201 bp, Homo sapiens
agggtccgcaggttcactcggtaaaactgtgctttggccttggcggtccctgtctcctcttcccaatattccggcccctcctgctccatccacggcgcccgcggctccatcctgggactcgtggcgtcgctgtcgagccgcacgcactgcgtgtcgtccacgtcgcccacggagaggaagcggggatccgcgcggccgggc

SEQ ID NO: 2430 - DNA, 118 bp, Homo sapiens
atgtggaggggtagtgabctgcgcccccggccggtgtcactcacaggcctcactctggttgtagtagccgctcagggtccgcaggttcactcggtaaaactgtgctttggccttggcg

SEQ ID NO: 2431 - DNA, 105 bp, Homo sapiens
atgtrgaggggtagtgacctgcgcccccggccggtgtcactcacaggcctcactctggttgtagtagccgctcagggtccgcaggttcactcggtaaaactgtgc

SEQ ID NO: 2432 - DNA, 201 bp, Homo sapiens
ccttggcggtccctgtctcctcttcccaatattccggcccctcctgctccatccacggcgcccgcggctccatcctgggactcgtggcgtcgctgtcgagscgcacgcactgcgtgtcgtccacgtcgcccacggagaggaagcggggatccgcgcggccgggccgggacatggtggtgtggaaatacctcaaggagtgga

SEQ ID NO: 2433 - DNA, 166 bp, Homo sapiens
atgtggaggggtagtgacctgcgcccccggccggtgtcactcacaggcctcactctggttgtagtrgccgctcagggtccgcaggttcactcggtaaaactgtgctttggccttggcggtccctgtctcctcttcccaatattccggcccctcctgctccatccac

SEQ ID NO: 2434 - DNA, 201 bp, Homo sapiens
gccgccatgtccgccgcggtccaagagcgcaggtcctcgttcaaggcgatgtaatccttgccgtcgtaggcgtcctgccggtacccgcggaggaagcgccmgtccgaccccacgtcgcagccatacatcatctggatgggtgttagaccctggccccgcccccgctgtcagccccgcccaccgagccccgcccccgccccg

SEQ ID NO: 2435 - DNA, 201 bp, Homo sapiens
atctgagccgccatgtccgccgcggtccaagagcgcaggtcctcgttcaaggcgatgtaatccttgccgtcgtaggcgtcctgccggtacccgcggaggargcgcccgtccgaccccacgtcgcagccatacatcatctggatgggtgttagaccctggccccgcccccgctgtcagccccgcccaccgagccccgccccc

SEQ ID NO: 2436 - DNA, 201 bp, Homo sapiens
ccacttgcgctgggtgatctgagccgccatgtccgccgcggtccaagagcgcaggtcctcgttcaaggcgatgtaatccttgccgtcgtaggcgtcctgcyggtacccgcggaggaagcgcccgtccgaccccacgtcgcagccatacatcatctggatgggtgttagaccctggccccgcccccgctgtcagccccgccc

SEQ ID NO: 2437 - DNA, 201 bp, Homo sapiens
tggttgtagtagctgtctcctcttcccaatactccggcccctcctgctccacccacggcgcccgcggctccatcctgggactcgtggcgtcgctgtcgagscgcacgcactgcgtgtcgtccacgtcgcccacggagaggaagcggggatccgcgcggccgggccgggacatggtggtgtggaaatacctcaaggagtgga

SEQ ID NO: 2438 - DNA, 201 bp, Homo sapiens
taggctctcaactgctccgccacacgggccgcctcccacttgcgctgggtgatctgagccgccatgtccgccgcggtccaagagcgcaggtcctcgttcarggcgatgtaatccttgccgtcgtaggcgtcctgccggtacccgcggaggaagcgcccgtccgaccccacgtcgcagccatacatcatctggatgggtgtt

SEQ ID NO: 2439 - DNA, 201 bp, Homo sapiens
caggtcctcgttcaaggcgatgtaatccttgccgtcgtaggcgtcctgccggtacccgcggaggaagcgcccgtccgaccccacgtcgcagccatacatcmtctggatgggtgttagaccctggccccgcccccgctgtcagccccgcccaccgagccccgcccccgccccgaccaacccgcggggattttggctgaaaat

SEQ ID NO: 2440 - DNA, 201 bp, Homo sapiens
ccaggtatctgcggagccactccacgcacgtgccctccaggtaggctctcaactgctccgccacacgggccgcctcccacttgcgctgggtgatctgagcygccatgtccgccgcggtccaagagcgcaggtcctcgttcaaggcgatgtaatccttgccgtcgtaggcgtcctgccggtacccgcggaggaagcgcccgt

SEQ ID NO: 2441 - DNA, 201 bp, Homo sapiens
cccgttctccaggtatctgcggagccactccacgcacgtgccctccaggtaggctctcaactgctccgccacacgggccgcctcccacttgcgctgggtgrtctgagccgccatgtccgccgcggtccaagagcgcaggtcctcgttcaaggcgatgtaatccttgccgtcgtaggcgtcctgccggtacccgcggaggaa

SEQ ID NO: 2442 - DNA, 201 bp, Homo sapiens
tctctcttcactttgcatcacggaatccccgtcccagaactggactccctgcctcctactccttacctgtccccgtggactcttctagaagaaaaatcacyccagggagcttgttgccagagagtgagcttgccctgggaatggaggtgtagagacagggttttttgttgttattgtttgtttgttttttaaatctggaaa

SEQ ID NO: 2443 - DNA, 201 bp, Homo sapiens
tccttcccgttctccaggtatctgcggagccactccacgcacgtgccctccaggtaggctctcaactgctccgccacacgggccgcctcccacttgcgctkggtgatctgagccgccatgtccgccgcggtccaagagcgcaggtcctcgttcaaggcgatgtaatccttgccgtcgtaggcgtcctgccggtacccgcgg

SEQ ID NO: 2444 - DNA, 201 bp, Homo sapiens
cgtctccttcccgttctccaggtatctgcggagccactccacgcacgtgccctccaggtaggctctcaactgctccgccacacgggccgcctcccacttgygctgggtgatctgagccgccatgtccgccgcggtccaagagcgcaggtcctcgttcaaggcgatgtaatccttgccgtcgtaggcgtcctgccggtaccc

SEQ ID NO: 2445 - DNA, 201 bp, Homo sapiens
gtgcgctgcagcgtctccttcccgttctccaggtatctgcggagccactccacgcacgtgccctccaggtaggctctcaactgctccgccacacgggccgyctcccacttgcgctgggtgatctgagccgccatgtccgccgcggtccaagagcgcaggtcctcgttcaaggcgatgtaatccttgccgtcgtaggcgtcc

SEQ ID NO: 2446 - DNA, 201 bp, Homo sapiens
taccttcattccatagccctgagtttctgtgtgagtccaggacatctcctaatacaaggtagccactgtgttactatatgttgtaaccaggagccagtacrgactttattcatctcacagtggcaagcactcaatgcagtcacaatgcccctcaccagtgctcatgcactgcctgtttttaggaagtatccacttctaagt

SEQ ID NO: 2447 - DNA, 201 bp, Homo sapiens
atgatgcccacgatggggatggtgggctgggaagacggctcccatctcagggtgaggggcttgggcaaaccctcatgctgcacatggcaggtgtatctctkctcctgtccagaaggcaccaccacagccgcccacttctggaaggttccatcccctgcaggcctggtctccacgagctccgtgtcctgggtctggtcctcc

SEQ ID NO: 2448 - DNA, 201 bp, Homo sapiens
atagccctgagtttctgtgtgagtccaggacatctcctaatacaaggtagccactgtgttactatatgttgtaaccaggagccagtacggactttattcayctcacagtggcaagcactcaatgcagtcacaatgcccctcaccagtgctcatgcactgcctgtttttaggaagtatccacttctaagtgttgtgtatatt

SEQ ID NO: 2449 - DNA, 201 bp, Homo sapiens
ccacgagctccgtgtcctgggtctggtcctccccatcccgctgccaggtcagtgtgatctccgcagggtagaagctcagggcccagcacctcagggtggcytcatggtcagagacagcgtggtgagtcatatgcgttttgggggcgtccgtgcgctgcagcgtctccttcccgttctccaggtatctgcggagccactcca

SEQ ID NO: 2450 - DNA, 201 bp, Homo sapiens
tggtctccacgagctccgtgtcctgggtctggtcctccccatcccgctgccaggtcagtgtgatctccgcagggtagaagctcagggcccagcacctcagrgtggcttcatggtcagagacagcgtggtgagtcatatgcgttttgggggcgtccgtgcgctgcagcgtctccttcccgttctccaggtatctgcggagcc

SEQ ID NO: 2451 - DNA, 201 bp, Homo sapiens
ctccgtgggggatggggaggggtcgtgacctgcgccccgggccggggtcactcaccgccctcgctctggttgtagtagctgtctcctcttcccaatactcyggcccctcctgctccacccacggcgcccgcggctccatcctgggactcgtggcgtcgctgtcgagccgcacgcactgcgtgtcgtccacgtcgcccacgg

SEQ ID NO: 2452 - DNA, 201 bp, Homo sapiens
acatggtggtgtggaaatacctcaaggagtggaagcctgggagcaaggagggggctgagactctcccgaccctcctcccggcaccgcaaccgggttcctgmgcccccgccgggcaggcccctagctactccccacagaggccgtttccctcccgaccccgcactcacctgcccaggtctgggtcaggaccagggcccccga

SEQ ID NO: 2453 - DNA, 201 bp, Homo sapiens
tacctcaaggagtggaagcctgggagcaaggagggggctgagactctcccgaccctcctcccggcaccgcaaccgggttcctgcgcccccgccgggcaggmccctagctactccccacagaggccgtttccctcccgaccccgcactcacctgcccaggtctgggtcaggaccagggcccccgagagcagcagaagcaggg

SEQ ID NO: 2454 - DNA, 201 bp, Homo sapiens
gagacagagatggagacacctcagccccacctctctggaacaggaaagatgattggggagggagcacaggtcagcgtgggaagagggtcatggtggacatsggggtggggtggtctccccacctcctcacattatgcctacacgaacacagacacatgcaggtgcctttgcagaaacaaagtcagggttcttcaagtcaca

SEQ ID NO: 2455 - DNA, 201 bp, Homo sapiens
gggccgcctcccacttgcgctgggtgatctgagccgccatgtccgccgcggtccaagagcgcaggtcctcgttcaaggcgatgtaatccttgccgtcgtargcgtcctgccggtacccgcggaggaagcgcccgtccgaccccacgtcgcagccatacatcatctggatgggtgttagaccctggccccgcccccgctgtc

SEQ ID NO: 2456 - DNA, 201 bp, Homo sapiens
ttaatagggaaggaagaagttacagctcagtgcaccatgaagttgagacagagatggagacacctcagccccacctctctggaacaggaaagatgattggrgagggagcacaggtcagcgtgggaagagggtcatggtggacatgggggtggggtggtctccccacctcctcacattatgcctacacgaacacagacacat

SEQ ID NO: 2457 - DNA, 201 bp, Homo sapiens
gcaggtcctcgttcaaggcgatgtaatccttgccgtcgtaggcgtcctgccggtacccgcggaggaagcgcccgtccgaccccacgtcgcagccatacatyatctggatgggtgttagaccctggccccgcccccgctgtcagccccgcccaccgagccccgcccccgccccgaccaacccgcggggattttggctgaaaa

SEQ ID NO: 2458 - DNA, 201 bp, Homo sapiens
ttatactcaggttctaattttaatagggaaggaagaagttacagctcagtgcaccatgaagttgagacagagatggagacacctcagccccacctctctgsaacaggaaagatgattggggagggagcacaggtcagcgtgggaagagggtcatggtggacatgggggtggggtggtctccccacctcctcacattatgcc

SEQ ID NO: 2459 - DNA, 201 bp, Homo sapiens
agagcgcaggtcctcgttcaaggcgatgtaatccttgccgtcgtaggcgtcctgccggtacccgcggaggaagcgcccgtccgaccccacgtcgcagccawacatcatctggatgggtgttagaccctggccccgcccccgctgtcagccccgcccaccgagccccgcccccgccccgaccaacccgcggggattttggct

SEQ ID NO: 2460 - DNA, 201 bp, Homo sapiens
ggaaagatgattggggagggagcacaggtcagcgtgggaagagggtcatggtggacatgggggtggggtggtctccccacctcctcacattatgcctacaygaacacagacacatgcaggtgcctttgcagaaacaaagtcagggttcttcaagtcacaaagggaagggcaggaacaactcttgcctctcagtcccacaca

SEQ ID NO: 2461 - DNA, 201 bp, Homo sapiens
atgtgttccatttattttgtctctcaaattttaggaatcttctcctttaattaactcatcaacctctcatggcaagaatttgagaaagtaaatttatactmaggttctaattttaatagggaaggaagaagttacagctcagtgcaccatgaagttgagacagagatggagacacctcagccccacctctctggaacagga

SEQ ID NO: 2462 - DNA, 201 bp, Homo sapiens
ggcgtccgtgcgctgcagcgtctccttcccgttctccaggtatctgcggagccactccacgcacgtgccctccaggtaggctctcaactgctccgccacaygggccgcctcccacttgcgctgggtgatctgagccgccatgtccgccgcggtccaagagcgcaggtcctcgttcaaggcgatgtaatccttgccgtcgta

SEQ ID NO: 2463 - DNA, 201 bp, Homo sapiens
ccaggtaggctctcaactgctccgccacacgggccgcctcccacttgcgctgggtgatctgagccgccatgtccgccgcggtccaagagcgcaggtcctckttcaaggcgatgtaatccttgccgtcgtaggcgtcctgccggtacccgcggaggaagcgcccgtccgaccccacgtcgcagccatacatcatctggatgg

SEQ ID NO: 2464 - DNA, 195 bp, Homo sapiens
gttctcatgtgttccatttattttgtctctcaaattttaggaatcttctcctttaattaactcatcaacctctcatggcaagaatttgagaaagkaaatttatactcaggttctaattttaatagggaaggaagaagttacagctcagtgcaccatgaagttgagacagagatggagacacctcagccccacctc

SEQ ID NO: 2465 - DNA, 201 bp, Homo sapiens
ggggcgtccgtgcgctgcagcgtctccttcccgttctccaggtatctgcggagccactccacgcacgtgccctccaggtaggctctcaactgctccgccasacgggccgcctcccacttgcgctgggtgatctgagccgccatgtccgccgcggtccaagagcgcaggtcctcgttcaaggcgatgtaatccttgccgtcg

SEQ ID NO: 2466 - DNA, 201 bp, Homo sapiens
agacagcgtggtgagtcatatgcgttttgggggcgtccgtgcgctgcagcgtctccttcccgttctccaggtatctgcggagccactccacgcacgtgccmtccaggtaggctctcaactgctccgccacacgggccgcctcccacttgcgctgggtgatctgagccgccatgtccgccgcggtccaagagcgcaggtcct

SEQ ID NO: 2467 - DNA, 201 bp, Homo sapiens
tgggaagacggctcccatctcagggtgaggggcttgggcaaaccctcatgctgcacatggcaggtgtatctctgctcctgtccagaaggcaccaccacagmcgcccacttctggaaggttccatcccctgcaggcctggtctccacgagctccgtgtcctgggtctggtcctccccatcccgctgccaggtcagtgtgatc

SEQ ID NO: 2468 - DNA, 201 bp, Homo sapiens
gcctgagtgcatgagatagaatagagaccagtttgctttttgtttattaactacagtgggtagcagaatcttggtaactcctaatgatcaggaatctaatyggccaaaaatgtgactttggtcccttgacatataaatgtgtctaaaagcattacaacaggaatcacaaagctcctaagtttcactttcccagacaatgta

SEQ ID NO: 2469 - DNA, 201 bp, Homo sapiens
ccgtggactcttctagaagaaaaatcactccagggagcttgttgccagagagtgagcttgccctgggaatggaggtgtagagacagggttttttgttgttrttgtttgtttgttttttaaatctggaaaagttgtgcctgagtgcatgagatagaatagagaccagtttgctttttgtttattaactacagtgggtagcag

SEQ ID NO: 2470 - DNA, 201 bp, Homo sapiens
ggatggtgggctgggaagacggctcccatctcagggtgaggggcttgggcaaaccctcatgctgcacatggcaggtgtatctctgctcctgtccagaaggyaccaccacagccgcccacttctggaaggttccatcccctgcaggcctggtctccacgagctccgtgtcctgggtctggtcctccccatcccgctgccagg

SEQ ID NO: 2471 - DNA, 201 bp, Homo sapiens
gggagcaaggagggggctgagactctcccgaccctcctcccggcaccgcaaccgggttcctgcgcccccgccgggcaggcccctagctactccccacagasgccgtttccctcccgaccccgcactcacctgcccaggtctgggtcaggaccagggcccccgagagcagcagaagcagggttcggggcgccatgacaccat

SEQ ID NO: 2472 - DNA, 201 bp, Homo sapiens
acatgggggtggggtggtctccccacctcctcacattatgcctacacgaacacagacacatgcaggtgcctttgcagaaacaaagtcagggttcttcaagycacaaagggaagggcaggaacaactcttgcctctcagtcccacacaaggcagctgtctcacactttacaagctgtgagagacacatcagagccctgggca

SEQ ID NO: 2473 - DNA, 201 bp, Homo sapiens
ccacggagaggaagcggggatccgcgcggccgggccgggacatggtggtgtggaaatacctcaaggagtggaagcctgggagcaaggagggggctgagacyctcccgaccctcctcccggcaccgcaaccgggttcctgcgcccccgccgggcaggcccctagctactccccacagaggccgtttccctcccgaccccgca

SEQ ID NO: 2474 - DNA, 201 bp, Homo sapiens
gcctcccacttgcgctgggtgatctgagccgccatgtccgccgcggtccaagagcgcaggtcctcgttcaaggcgatgtaatccttgccgtcgtaggcgtmctgccggtacccgcggaggaagcgcccgtccgaccccacgtcgcagccatacatcatctggatgggtgttagaccctggccccgcccccgctgtcagccc

SEQ ID NO: 2475 - DNA, 201 bp, Homo sapiens
gaggatggccgtcatggcgccccgaaccctcctcctgctactcttgggggccctggccctgacccagacctgggcgggctcccactccatgaggtatttcwccacatccgtgtcccggcccggccgcggggagccccgcttcatcgccgtgggctacgtggacgacacgcagttcgtgcggtttgacagcgacgccgcgag

SEQ ID NO: 2476 - DNA, 201 bp, Homo sapiens
aaccctcctcctgctactcttgggggccctggccctgacccagacctgggcgggctcccactccatgaggtatttcaccacatccgtgtcccggcccggcmgcggggagccccgcttcatcgccgtgggctacgtggacgacacgcagttcgtgcggtttgacagcgacgccgcgagccagaggatggagccgcgggcacc

SEQ ID NO: 2477 - DNA, 201 bp, Homo sapiens
tgaccgagcgaacctggggaccctgcgcggctactacaaccagagcgaggccggttctcacaccatccagatgatgtatggctgcgacgtggggtcggackggcgcttcctccgcgggtaccggcaggacgcctacgacggcaaggattacatcgccttgaacgaggacctgcgctcttggaccgcggcggacatggcggc

SEQ ID NO: 2478 - DNA, 201 bp, Homo sapiens
agcgaacctggggaccctgcgcggctactacaaccagagcgaggccggttctcacaccatccagatgatgtatggctgcgacgtggggtcggacgggcgcytcctccgcgggtaccggcaggacgcctacgacggcaaggattacatcgccttgaacgaggacctgcgctcttggaccgcggcggacatggcggctcagat

SEQ ID NO: 2479 - DNA, 201 bp, Homo sapiens
ctgcgcggctactacaaccagagcgaggccggttctcacaccatccagatgatgtatggctgcgacgtggggtcggacgggcgcttcctccgcgggtaccrgcaggacgcctacgacggcaaggattacatcgccttgaacgaggacctgcgctcttggaccgcggcggacatggcggctcagatcacccagcgcaagtgg

SEQ ID NO: 2480 - DNA, 201 bp, Homo sapiens
tcacaccatccagatgatgtatggctgcgacgtggggtcggacgggcgcttcctccgcgggtaccggcaggacgcctacgacggcaaggattacatcgccytgaacgaggacctgcgctcttggaccgcggcggacatggcggctcagatcacccagcgcaagtgggaggcggcccgtgtggcggagcagttgagagccta

SEQ ID NO: 2481 - DNA, 201 bp, Homo sapiens
acacggaatgtgaaggcccagtcacagactgaccgagcgaacctggggaccctgcgcggctactacaaccagagcgaggccggttctcacaccatccagakgatgtatggctgcgacgtggggtcggacgggcgcttcctccgcgggtaccggcaggacgcctacgacggcaaggattacatcgccttgaacgaggacctg

SEQ ID NO: 2482 - DNA, 201 bp, Homo sapiens
acgggcgcttcctccgcgggtaccggcaggacgcctacgacggcaaggattacatcgccttgaacgaggacctgcgctcttggaccgcggcggacatggcrgctcagatcacccagcgcaagtgggaggcggcccgtgtggcggagcagttgagagcctacctggagggcacgtgcgtggagtggctccgcagatacctgg

SEQ ID NO: 2483 - DNA, 201 bp, Homo sapiens
ttcctccgcgggtaccggcaggacgcctacgacggcaaggattacatcgccttgaacgaggacctgcgctcttggaccgcggcggacatggcggctcagaycacccagcgcaagtgggaggcggcccgtgtggcggagcagttgagagcctacctggagggcacgtgcgtggagtggctccgcagatacctggagaacggg

SEQ ID NO: 2484 - DNA, 201 bp, Homo sapiens
ccgcgggtaccggcaggacgcctacgacggcaaggattacatcgccttgaacgaggacctgcgctcttggaccgcggcggacatggcggctcagatcaccmagcgcaagtgggaggcggcccgtgtggcggagcagttgagagcctacctggagggcacgtgcgtggagtggctccgcagatacctggagaacgggaagga

SEQ ID NO: 2485 - DNA, 201 bp, Homo sapiens
gggtaccggcaggacgcctacgacggcaaggattacatcgccttgaacgaggacctgcgctcttggaccgcggcggacatggcggctcagatcacccagcrcaagtgggaggcggcccgtgtggcggagcagttgagagcctacctggagggcacgtgcgtggagtggctccgcagatacctggagaacgggaaggagacg

SEQ ID NO: 2486 - DNA, 201 bp, Homo sapiens
ggacgcctacgacggcaaggattacatcgccttgaacgaggacctgcgctcttggaccgcggcggacatggcggctcagatcacccagcgcaagtgggagrcggcccgtgtggcggagcagttgagagcctacctggagggcacgtgcgtggagtggctccgcagatacctggagaacgggaaggagacgctgcagcgcac

SEQ ID NO: 2487 - DNA, 201 bp, Homo sapiens
ggaggaccagacccaggacacggagctcgtggagaccaggcctgcaggggatggaaccttccagaagtgggcggctgtggtggtgccttctggacaggagmagagatacacctgccatgtgcagcatgagggtttgcccaagcccctcaccctgagatgggagccgtcttcccagcccaccatccccatcgtgggcatcat

SEQ ID NO: 2488 - DNA, 201 bp, Homo sapiens
gacgacacgcagttcgtgcggtttgacagcgacgccgcgagccagaggatggagccgcgggcaccgtggatagagcaggaggggccggagtattgggaccrgcagacacggaatgtgaaggcccagtcacagactgaccgagcgaacctggggaccctgcgcggctactacaaccagagcgaggccggttctcacaccatc

SEQ ID NO: 2489 - DNA, 201 bp, Homo sapiens
tggagtggctccgcagatacctggagaacgggaaggagacgctgcagcgcacggacgcccccaaaacgcatatgactcaccacgctgtctctgaccatgargccaccctgaggtgctgggccctgagcttctaccctgcggagatcacactgacctggcagcgggatggggaggaccagacccaggacacggagctcgtgg

SEQ ID NO: 2490 - DNA, 201 bp, Homo sapiens
acacgcagttcgtgcggtttgacagcgacgccgcgagccagaggatggagccgcgggcaccgtggatagagcaggaggggccggagtattgggacctgcasacacggaatgtgaaggcccagtcacagactgaccgagcgaacctggggaccctgcgcggctactacaaccagagcgaggccggttctcacaccatccaga

SEQ ID NO: 2491 - DNA, 201 bp, Homo sapiens
ggctccgcagatacctggagaacgggaaggagacgctgcagcgcacggacgcccccaaaacgcatatgactcaccacgctgtctctgaccatgaagccacyctgaggtgctgggccctgagcttctaccctgcggagatcacactgacctggcagcgggatggggaggaccagacccaggacacggagctcgtggagacca

SEQ ID NO: 2492 - DNA, 201 bp, Homo sapiens
gaggatggagccgcgggcaccgtggatagagcaggaggggccggagtattgggacctgcagacacggaatgtgaaggcccagtcacagactgaccgagcgracctggggaccctgcgcggctactacaaccagagcgaggccggttctcacaccatccagatgatgtatggctgcgacgtggggtcggacgggcgcttcct

SEQ ID NO: 2493 - DNA, 201 bp, Homo sapiens
cagtgtcgtcgcggtcgcggttctaaagtccgcacgcacccaccgggactcagattctccccagacgccgaggatggccgtcatggcgccccgaaccctcstcctgctactcttgggggccctggccctgacccagacctgggcgggctcccactccatgaggtatttcaccacatccgtgtcccggcccggccgcgggga

SEQ ID NO: 2494 - DNA, 201 bp, Homo sapiens
ggagccgcgggcaccgtggatagagcaggaggggccggagtattgggacctgcagacacggaatgtgaaggcccagtcacagactgaccgagcgaacctgsggaccctgcgcggctactacaaccagagcgaggccggttctcacaccatccagatgatgtatggctgcgacgtggggtcggacgggcgcttcctccgcgg

SEQ ID NO: 2495 - DNA, 201 bp, Homo sapiens
gcagttcgtgcggtttgacagcgacgccgcgagccagaggatggagccgcgggcaccgtggatagagcaggaggggccggagtattgggacctgcagacasggaatgtgaaggcccagtcacagactgaccgagcgaacctggggaccctgcgcggctactacaaccagagcgaggccggttctcacaccatccagatgat

SEQ ID NO: 2496 - DNA, 201 bp, Homo sapiens
tcgtgcggtttgacagcgacgccgcgagccagaggatggagccgcgggcaccgtggatagagcaggaggggccggagtattgggacctgcagacacggaawgtgaaggcccagtcacagactgaccgagcgaacctggggaccctgcgcggctactacaaccagagcgaggccggttctcacaccatccagatgatgtatg

SEQ ID NO: 2497 - DNA, 201 bp, Homo sapiens
ccggagtattgggacctgcagacacggaatgtgaaggcccagtcacagactgaccgagcgaacctggggaccctgcgcggctactacaaccagagcgaggmcggttctcacaccatccagatgatgtatggctgcgacgtggggtcggacgggcgcttcctccgcgggtaccggcaggacgcctacgacggcaaggattac

SEQ ID NO: 2498 - DNA, 201 bp, Homo sapiens
aggatggccgtcatggcgccccgaaccctcctcctgctactcttgggggccctggccctgacccagacctgggcgggctcccactccatgaggtatttcahcacatccgtgtcccggcccggccgcggggagccccgcttcatcgccgtgggctacgtggacgacacgcagttcgtgcggtttgacagcgacgccgcgagc

SEQ ID NO: 2499 - DNA, 201 bp, Homo sapiens
actacaaccagagcgaggccggttctcacaccatccagatgatgtatggctgcgacgtggggtcggacgggcgcttcctccgcgggtaccggcaggacgcytacgacggcaaggattacatcgccttgaacgaggacctgcgctcttggaccgcggcggacatggcggctcagatcacccagcgcaagtgggaggcggccc

SEQ ID NO: 2500 - DNA, 201 bp, Homo sapiens
actccatgaggtatttcaccacatccgtgtcccggcccggccgcggggagccccgcttcatcgccgtgggctacgtggacgacacgcagttcgtgcggttygacagcgacgccgcgagccagaggatggagccgcgggcaccgtggatagagcaggaggggccggagtattgggacctgcagacacggaatgtgaaggccc

SEQ ID NO: 2501 - DNA, 201 bp, Homo sapiens
tggccgtcatggcgccccgaaccctcctcctgctactcttgggggccctggccctgacccagacctgggcgggctcccactccatgaggtatttcaccacmtccgtgtcccggcccggccgcggggagccccgcttcatcgccgtgggctacgtggacgacacgcagttcgtgcggtttgacagcgacgccgcgagccaga

SEQ ID NO: 2502 - DNA, 201 bp, Homo sapiens
cacggaatgtgaaggcccagtcacagactgaccgagcgaacctggggaccctgcgcggctactacaaccagagcgaggccggttctcacaccatccagatratgtatggctgcgacgtggggtcggacgggcgcttcctccgcgggtaccggcaggacgcctacgacggcaaggattacatcgccttgaacgaggacctgc

SEQ ID NO: 2503 - DNA, 125 bp, Homo sapiens
tgttcctgcccttccctttgtgacttgaagaaccctgactttgtttctgcaaaggcaccttccaccatgaccctcttcccacgctgacctgtgctccctcyccaatcatctttcctgttccagag

SEQ ID NO: 2504 - DNA, 201 bp, Homo sapiens
aatgtgaaggcccagtcacagactgaccgagcgaacctggggaccctgcgcggctactacaaccagagcgaggccggttctcacaccatccagatgatgtwtggctgcgacgtggggtcggacgggcgcttcctccgcgggtaccggcaggacgcctacgacggcaaggattacatcgccttgaacgaggacctgcgctct

SEQ ID NO: 2505 - DNA, 106 bp, Homo sapiens
gtgacttgaagaaccctgactttgtttctgcaaaggcaccttccaccatgaccctcttcccacgctgacctgtgctccctccccaatcatctttcctgttscagag

SEQ ID NO: 2506 - DNA, 201 bp, Homo sapiens
ccctcctcctgctactcttgggggccctggccctgacccagacctgggcgggctcccactccatgaggtatttcaccacatccgtgtcccggcccggccgyggggagccccgcttcatcgccgtgggctacgtggacgacacgcagttcgtgcggtttgacagcgacgccgcgagccagaggatggagccgcgggcaccgt

SEQ ID NO: 2507 - DNA, 201 bp, Homo sapiens
tacgacggcaaggattacatcgccttgaacgaggacctgcgctcttggaccgcggcggacatggcggctcagatcacccagcgcaagtgggaggcggcccrtgtggcggagcagttgagagcctacctggagggcacgtgcgtggagtggctccgcagatacctggagaacgggaaggagacgctgcagcgcacggacgcc

SEQ ID NO: 2508 - DNA, 201 bp, Homo sapiens
ccatccagatgatgtatggctgcgacgtggggtcggacgggcgcttcctccgcgggtaccggcaggacgcctacgacggcaaggattacatcgccttgaamgaggacctgcgctcttggaccgcggcggacatggcggctcagatcacccagcgcaagtgggaggcggcccgtgtggcggagcagttgagagcctacctgg

SEQ ID NO: 2509 - DNA, 201 bp, Homo sapiens
gacctgggcgggctcccactccatgaggtatttcaccacatccgtgtcccggcccggccgcggggagccccgcttcatcgccgtgggctacgtggacgacwcgcagttcgtgcggtttgacagcgacgccgcgagccagaggatggagccgcgggcaccgtggatagagcaggaggggccggagtattgggacctgcagac

SEQ ID NO: 2510 - DNA, 201 bp, Homo sapiens
cgacggcaaggattacatcgccttgaacgaggacctgcgctcttggaccgcggcggacatggcggctcagatcacccagcgcaagtgggaggcggcccgtstggcggagcagttgagagcctacctggagggcacgtgcgtggagtggctccgcagatacctggagaacgggaaggagacgctgcagcgcacggacgcccc

SEQ ID NO: 2511 - DNA, 201 bp, Homo sapiens
catcgccgtgggctacgtggacgacacgcagttcgtgcggtttgacagcgacgccgcgagccagaggatggagccgcgggcaccgtggatagagcaggagrggccggagtattgggacctgcagacacggaatgtgaaggcccagtcacagactgaccgagcgaacctggggaccctgcgcggctactacaaccagagcga

SEQ ID NO: 2512 - DNA, 201 bp, Homo sapiens
aggacctgcgctcttggaccgcggcggacatggcggctcagatcacccagcgcaagtgggaggcggcccgtgtggcggagcagttgagagcctacctggakggcacgtgcgtggagtggctccgcagatacctggagaacgggaaggagacgctgcagcgcacggacgcccccaaaacgcatatgactcaccacgctgtct

SEQ ID NO: 2513 - DNA, 201 bp, Homo sapiens
gggccctggccctgacccagacctgggcgggctcccactccatgaggtatttcaccacatccgtgtcccggcccggccgcggggagccccgcttcatcgcmgtgggctacgtggacgacacgcagttcgtgcggtttgacagcgacgccgcgagccagaggatggagccgcgggcaccgtggatagagcaggaggggccgg

SEQ ID NO: 2514 - DNA, 201 bp, Homo sapiens
tccgtgtcccggcccggccgcggggagccccgcttcatcgccgtgggctacgtggacgacacgcagttcgtgcggtttgacagcgacgccgcgagccagargatggagccgcgggcaccgtggatagagcaggaggggccggagtattgggacctgcagacacggaatgtgaaggcccagtcacagactgaccgagcgaac

SEQ ID NO: 2515 - DNA, 201 bp, Homo sapiens
gatcacactgacctggcagcgggatggggaggaccagacccaggacacggagctcgtggagaccaggcctgcaggggatggaaccttccagaagtgggcgkctgtggtggtgccttctggacaggagcagagatacacctgccatgtgcagcatgagggtttgcccaagcccctcaccctgagatgggagccgtcttccca

SEQ ID NO: 2516 - DNA, 201 bp, Homo sapiens
atcgccgtgggctacgtggacgacacgcagttcgtgcggtttgacagcgacgccgcgagccagaggatggagccgcgggcaccgtggatagagcaggaggrgccggagtattgggacctgcagacacggaatgtgaaggcccagtcacagactgaccgagcgaacctggggaccctgcgcggctactacaaccagagcgag

SEQ ID NO: 2517 - DNA, 201 bp, Homo sapiens
cctggcagcgggatggggaggaccagacccaggacacggagctcgtggagaccaggcctgcaggggatggaaccttccagaagtgggcggctgtggtggtrccttctggacaggagcagagatacacctgccatgtgcagcatgagggtttgcccaagcccctcaccctgagatgggagccgtcttcccagcccaccatcc

SEQ ID NO: 2518 - DNA, 201 bp, Homo sapiens
tgcggtttgacagcgacgccgcgagccagaggatggagccgcgggcaccgtggatagagcaggaggggccggagtattgggacctgcagacacggaatgtsaaggcccagtcacagactgaccgagcgaacctggggaccctgcgcggctactacaaccagagcgaggccggttctcacaccatccagatgatgtatggct

SEQ ID NO: 2519 - DNA, 201 bp, Homo sapiens
tcgccgtgggctacgtggacgacacgcagttcgtgcggtttgacagcgacgccgcgagccagaggatggagccgcgggcaccgtggatagagcaggagggkccggagtattgggacctgcagacacggaatgtgaaggcccagtcacagactgaccgagcgaacctggggaccctgcgcggctactacaaccagagcgagg

SEQ ID NO: 2520 - DNA, 201 bp, Homo sapiens
acagcgacgccgcgagccagaggatggagccgcgggcaccgtggatagagcaggaggggccggagtattgggacctgcagacacggaatgtgaaggcccastcacagactgaccgagcgaacctggggaccctgcgcggctactacaaccagagcgaggccggttctcacaccatccagatgatgtatggctgcgacgtgg

SEQ ID NO: 2521 - DNA, 201 bp, Homo sapiens
ccgtgggctacgtggacgacacgcagttcgtgcggtttgacagcgacgccgcgagccagaggatggagccgcgggcaccgtggatagagcaggaggggcckgagtattgggacctgcagacacggaatgtgaaggcccagtcacagactgaccgagcgaacctggggaccctgcgcggctactacaaccagagcgaggccg

SEQ ID NO: 2522 - DNA, 201 bp, Homo sapiens
cagcgacgccgcgagccagaggatggagccgcgggcaccgtggatagagcaggaggggccggagtattgggacctgcagacacggaatgtgaaggcccagkcacagactgaccgagcgaacctggggaccctgcgcggctactacaaccagagcgaggccggttctcacaccatccagatgatgtatggctgcgacgtggg

SEQ ID NO: 2523 - DNA, 201 bp, Homo sapiens
tgcccagggctctgatgtgtctctcacagcttgtaaagtgtgagacagctgccttgtgtgggactgagaggcaagagttgttcctgcccttccctttgtgrcttgaagaaccctgactttgtttctgcaaaggcaccttccaccatgaccctcttcccacgctgacctgtgctccctccccaatcatctttcctgttccag

SEQ ID NO: 2524 - DNA, 201 bp, Homo sapiens
gtcgcggttctaaagtccgcacgcacccaccgggactcagattctccccagacgccgaggatggccgtcatggcgccccgaaccctcctcctgctactctygggggccctggccctgacccagacctgggcgggctcccactccatgaggtatttcaccacatccgtgtcccggcccggccgcggggagccccgcttcatc

SEQ ID NO: 2525 - DNA, 201 bp, Homo sapiens
ggacgacacgcagttcgtgcggtttgacagcgacgccgcgagccagaggatggagccgcgggcaccgtggatagagcaggaggggccggagtattgggacstgcagacacggaatgtgaaggcccagtcacagactgaccgagcgaacctggggaccctgcgcggctactacaaccagagcgaggccggttctcacaccat

SEQ ID NO: 2526 - DNA, 201 bp, Homo sapiens
gccgcgagccagaggatggagccgcgggcaccgtggatagagcaggaggggccggagtattgggacctgcagacacggaatgtgaaggcccagtcacagaytgaccgagcgaacctggggaccctgcgcggctactacaaccagagcgaggccggttctcacaccatccagatgatgtatggctgcgacgtggggtcggac

SEQ ID NO: 2527 - DNA, 201 bp, Homo sapiens
cagaggatggagccgcgggcaccgtggatagagcaggaggggccggagtattgggacctgcagacacggaatgtgaaggcccagtcacagactgaccgaghgaacctggggaccctgcgcggctactacaaccagagcgaggccggttctcacaccatccagatgatgtatggctgcgacgtggggtcggacgggcgcttc

SEQ ID NO: 2528 - DNA, 201 bp, Homo sapiens
cggctactacaaccagagcgaggccggttctcacaccatccagatgatgtatggctgcgacgtggggtcggacgggcgcttcctccgcgggtaccggcagkacgcctacgacggcaaggattacatcgccttgaacgaggacctgcgctcttggaccgcggcggacatggcggctcagatcacccagcgcaagtgggaggc

SEQ ID NO: 2529 - DNA, 201 bp, Homo sapiens
cgtcatggcgccccgaaccctcctcctgctactcttgggggccctggccctgacccagacctgggcgggctcccactccatgaggtatttcaccacatccrtgtcccggcccggccgcggggagccccgcttcatcgccgtgggctacgtggacgacacgcagttcgtgcggtttgacagcgacgccgcgagccagaggat

SEQ ID NO: 2530 - DNA, 201 bp, Homo sapiens
tcctcctgctactcttgggggccctggccctgacccagacctgggcgggctcccactccatgaggtatttcaccacatccgtgtcccggcccggccgcggrgagccccgcttcatcgccgtgggctacgtggacgacacgcagttcgtgcggtttgacagcgacgccgcgagccagaggatggagccgcgggcaccgtgga

SEQ ID NO: 2531 - DNA, 201 bp, Homo sapiens
cagattctccccagacgccgaggatggccgtcatggcgccccgaaccctcctcctgctactcttgggggccctggccctgacccagacctgggcgggctcycactccatgaggtatttcaccacatccgtgtcccggcccggccgcggggagccccgcttcatcgccgtgggctacgtggacgacacgcagttcgtgcggt

SEQ ID NO: 2532 - DNA, 201 bp, Homo sapiens
ttctaaagtccgcacgcacccaccgggactcagattctccccagacgccgaggatggccgtcatggcgccccgaaccctcctcctgctactcttgggggcyctggccctgacccagacctgggcgggctcccactccatgaggtatttcaccacatccgtgtcccggcccggccgcggggagccccgcttcatcgccgtgg

SEQ ID NO: 2533 - DNA, 201 bp, Homo sapiens; identical to SEQ ID NO: 2475

SEQ ID NO: 2534 - DNA, 201 bp, Homo sapiens; identical to SEQ ID NO: 2476

SEQ ID NO: 2535 - DNA, 201 bp, Homo sapiens; identical to SEQ ID NO: 2477

SEQ ID NO: 2536 - DNA, 201 bp, Homo sapiens; identical to SEQ ID NO: 2478

SEQ ID NO: 2537 - DNA, 201 bp, Homo sapiens; identical to SEQ ID NO: 2479

SEQ ID NO: 2538 - DNA, 201 bp, Homo sapiens; identical to SEQ ID NO: 2480

SEQ ID NO: 2539 - DNA, 201 bp, Homo sapiens; identical to SEQ ID NO: 2481

SEQ ID NO: 2540 - DNA, 201 bp, Homo sapiens; identical to SEQ ID NO: 2482

SEQ ID NO: 2541 - DNA, 201 bp, Homo sapiens; identical to SEQ ID NO: 2483

SEQ ID NO: 2542 - DNA, 201 bp, Homo sapiens; identical to SEQ ID NO: 2484

SEQ ID NO: 2543 - DNA, 201 bp, Homo sapiens; identical to SEQ ID NO: 2485

SEQ ID NO: 2544 - DNA, 201 bp, Homo sapiens; identical to SEQ ID NO: 2486

SEQ ID NO: 2545 - DNA, 201 bp, Homo sapiens; identical to SEQ ID NO: 2487

SEQ ID NO: 2546 - DNA, 201 bp, Homo sapiens; identical to SEQ ID NO: 2488

SEQ ID NO: 2547 - DNA, 201 bp, Homo sapiens; identical to SEQ ID NO: 2489

SEQ ID NO: 2548 - DNA, 201 bp, Homo sapiens; identical to SEQ ID NO: 2490

SEQ ID NO: 2549 - DNA, 201 bp, Homo sapiens; identical to SEQ ID NO: 2491

SEQ ID NO: 2550 - DNA, 201 bp, Homo sapiens; identical to SEQ ID NO: 2492

SEQ ID NO: 2551 - DNA, 201 bp, Homo sapiens; identical to SEQ ID NO: 2493

SEQ ID NO: 2552 - DNA, 201 bp, Homo sapiens; identical to SEQ ID NO: 2494

SEQ ID NO: 2553 - DNA, 201 bp, Homo sapiens; identical to SEQ ID NO: 2495

SEQ ID NO: 2554 - DNA, 201 bp, Homo sapiens; identical to SEQ ID NO: 2496

SEQ ID NO: 2555 - DNA, 201 bp, Homo sapiens; identical to SEQ ID NO: 2497

SEQ ID NO: 2556 - DNA, 201 bp, Homo sapiens
tgtgacttgaagaaccctgactttgtttctgcaaaggcacctgcatgtgtctgtgttcgtgtaggcataatgtgaggaggtggggagaccaccccaccccsatgtccaccatgaccctcttcccacgctgacctgtgctccctccccaatcatctttcctgttccagagaggtggggctgaggtgtctccatctctgtctc

SEQ ID NO: 2557 - DNA, 201 bp, Homo sapiens; identical to SEQ ID NO: 2498

SEQ ID NO: 2558 - DNA, 201 bp, Homo sapiens; identical to SEQ ID NO: 2499

SEQ ID NO: 2559 - DNA, 201 bp, Homo sapiens; identical to SEQ ID NO: 2500

SEQ ID NO: 2560 - DNA, 201 bp, Homo sapiens; identical to SEQ ID NO: 2501

SEQ ID NO: 2561 - DNA, 201 bp, Homo sapiens; identical to SEQ ID NO: 2502

SEQ ID NO: 2562 - DNA, 201 bp, Homo sapiens
atgtgtctgtgttcgtgtaggcataatgtgaggaggtggggagaccaccccacccccatgtccaccatgaccctcttcccacgctgacctgtgctccctcyccaatcatctttcctgttccagagaggtggggctgaggtgtctccatctctgtctcaacttcatggtgcactgagctgtaacttcttccttccctattaa

SEQ ID NO: 2563 - DNA, 201 bp, Homo sapiens; identical to SEQ ID NO: 2504

SEQ ID NO: 2564 - DNA, 201 bp, Homo sapiens
ggcataatgtgaggaggtggggagaccaccccacccccatgtccaccatgaccctcttcccacgctgacctgtgctccctccccaatcatctttcctgttscagagaggtggggctgaggtgtctccatctctgtctcaacttcatggtgcactgagctgtaacttcttccttccctattaaaattagaacctgagtataa

SEQ ID NO: 2565 - DNA, 201 bp, Homo sapiens
tgtgtgggactgagaggcaagagttgttcctgcccttccctttgtgacttgaagaaccctgactttgtttctgcaaaggcacctgcatgtgtctgtgttcrtgtaggcataatgtgaggaggtggggagaccaccccacccccatgtccaccatgaccctcttcccacgctgacctgtgctccctccccaatcatctttcc

SEQ ID NO: 2566 - DNA, 201 bp, Homo sapiens; identical to SEQ ID NO: 2506

SEQ ID NO: 2567 - DNA, 201 bp, Homo sapiens
tcctgttccagagaggtggggctgaggtgtctccatctctgtctcaacttcatggtgcactgagctgtaacttcttccttccctattaaaattagaacctkagtataaatttactttctcaaattcttgccatgagaggttgatgagttaattaaaggagaagattcctaaaatttgagagacaaaataaatggaacacat

SEQ ID NO: 2568 - DNA, 201 bp, Homo sapiens; identical to SEQ ID NO: 2507

SEQ ID NO: 2569 - DNA, 201 bp, Homo sapiens; identical to SEQ ID NO: 2508

SEQ ID NO: 2570 - DNA, 201 bp, Homo sapiens; identical to SEQ ID NO: 2509

SEQ ID NO: 2571 - DNA, 198 bp, Homo sapiens
gaggtggggctgaggtgtctccatctctgtctcaacttcatggtgcactgagctgtaacttcttccttccctattaaaattagaacctgagtataaatttmctttctcaaattcttgccatgagaggttgatgagttaattaaaggagaagattcctaaaatttgagagacaaaataaatggaacacatgagaacctt

SEQ ID NO: 2572 - DNA, 201 bp, Homo sapiens; identical to SEQ ID NO: 2510

SEQ ID NO: 2573 - DNA, 201 bp, Homo sapiens; identical to SEQ ID NO: 2511

SEQ ID NO: 2574 - DNA, 201 bp, Homo sapiens; identical to SEQ ID NO: 2512

SEQ ID NO: 2575 - DNA, 201 bp, Homo sapiens; identical to SEQ ID NO: 2513

SEQ ID NO: 2576 - DNA, 201 bp, Homo sapiens; identical to SEQ ID NO: 2514

SEQ ID NO: 2577 - DNA, 201 bp, Homo sapiens; identical to SEQ ID NO: 2515

SEQ ID NO: 2578 - DNA, 201 bp, Homo sapiens; identical to SEQ ID NO: 2516

SEQ ID NO: 2579 - DNA, 201 bp, Homo sapiens; identical to SEQ ID NO: 2517

SEQ ID NO: 2580 - DNA, 201 bp, Homo sapiens; identical to SEQ ID NO: 2518

SEQ ID NO: 2581 - DNA, 201 bp, Homo sapiens; identical to SEQ ID NO: 2519

SEQ ID NO: 2582 - DNA, 201 bp, Homo sapiens; identical to SEQ ID NO: 2520

SEQ ID NO: 2583 - DNA, 201 bp, Homo sapiens; identical to SEQ ID NO: 2521

SEQ ID NO: 2584 - DNA, 201 bp, Homo sapiens; identical to SEQ ID NO: 2522

SEQ ID NO: 2585 - DNA, 201 bp, Homo sapiens
tgcccagggctctgatgtgtctctcacagcttgtaaagtgtgagacagctgccttgtgtgggactgagaggcaagagttgttcctgcccttccctttgtgrcttgaagaaccctgactttgtttctgcaaaggcacctgcatgtgtctgtgttcgtgtaggcataatgtgaggaggtggggagaccaccccacccccatgt

SEQ ID NO: 2586 - DNA, 201 bp, Homo sapiens; identical to SEQ ID NO: 2524

SEQ ID NO: 2587 - DNA, 201 bp, Homo sapiens; identical to SEQ ID NO: 2525

SEQ ID NO: 2588 - DNA, 201 bp, Homo sapiens; identical to SEQ ID NO: 2526

SEQ ID NO: 2589 - DNA, 201 bp, Homo sapiens; identical to SEQ ID NO: 2527

SEQ ID NO: 2590 - DNA, 201 bp, Homo sapiens; identical to SEQ ID NO: 2528

SEQ ID NO: 2591 - DNA, 201 bp, Homo sapiens; identical to SEQ ID NO: 2529

SEQ ID NO: 2592 - DNA, 201 bp, Homo sapiens; identical to SEQ ID NO: 2530

SEQ ID NO: 2593 - DNA, 201 bp, Homo sapiens; identical to SEQ ID NO: 2531

SEQ ID NO: 2594 - DNA, 201 bp, Homo sapiens; identical to SEQ ID NO: 2532

SEQ ID NO: 2595 - DNA, 201 bp, Homo sapiens
aggatggagccgcgggcgccgtggatagagcaggaggggccggagtattgggaccaggagacacggaatgtgaaggcccagtcacagactgaccgagtggrcctggggaccctgcgcggctactacaaccagagcgaggccggttctcacaccatccagataatgtatggctgcgacgtggggtcggacgggcgcttcctc

SEQ ID NO: 2596 - DNA, 201 bp, Homo sapiens
gagccgcgggcgccgtggatagagcaggaggggccggagtattgggaccaggagacacggaatgtgaaggcccagtcacagactgaccgagtggacctggsgaccctgcgcggctactacaaccagagcgaggccggttctcacaccatccagataatgtatggctgcgacgtggggtcggacgggcgcttcctccgcggg

SEQ ID NO: 2597 - DNA, 201 bp, Homo sapiens
gcgggcgccgtggatagagcaggaggggccggagtattgggaccaggagacacggaatgtgaaggcccagtcacagactgaccgagtggacctggggaccstgcgcggctactacaaccagagcgaggccggttctcacaccatccagataatgtatggctgcgacgtggggtcggacgggcgcttcctccgcgggtaccg

SEQ ID NO: 2598 - DNA, 135 bp, Homo sapiens
ctctgatgtgtccctcacagcttgtaaagtgtgawgggcgggctcccactccatgaggtatttcttcacatccgtgtcccggcccggccgcggggagccccgcttcatcgccgtgggctacgtggacgacacgca

SEQ ID NO: 2599 - DNA, 121 bp, Homo sapiens
tcacagcttgtaaagtgtgavtccatgaggtatttcttcacatccgtgtcccggcccggccgcggggagccccgcttcatcgccgtgggctacgtggacgacacgcagttcgtgcggttcg

SEQ ID NO: 2600 - DNA, 110 bp, Homo sapiens
aaagtgtgartttcttcacatccgtgtcccggcccggccgcggggagccccgcttcatcgccgtgggctacgtggacgacacgcagttcgtgcggttcgacagcgacgcc

SEQ ID NO: 2601 - DNA, 201 bp, Homo sapiens
tcccactccatgaggtatttcttcacatccgtgtcccggcccggccgcggggagccccgcttcatcgccgtgggctacgtggacgacacgcagttcgtgcrgttcgacagcgacgccgcgagccagaggatggagccgcgggcgccgtggatagagcaggaggggccggagtattgggaccaggagacacggaatgtgaag

SEQ ID NO: 2602 - DNA, 201 bp, Homo sapiens
cgggcgccgtggatagagcaggaggggccggagtattgggaccaggagacacggaatgtgaaggcccagtcacagactgaccgagtggacctggggacccygcgcggctactacaaccagagcgaggccggttctcacaccatccagataatgtatggctgcgacgtggggtcggacgggcgcttcctccgcgggtaccgg

SEQ ID NO: 2603 - DNA, 201 bp, Homo sapiens
gcgccgtggatagagcaggaggggccggagtattgggaccaggagacacggaatgtgaaggcccagtcacagactgaccgagtggacctggggaccctgckcggctactacaaccagagcgaggccggttctcacaccatccagataatgtatggctgcgacgtggggtcggacgggcgcttcctccgcgggtaccggcag

SEQ ID NO: 2604 - DNA, 201 bp, Homo sapiens
cgtcatggcgccccgaaccctcctcctgctactctcgggggccctggccctgacccagacctgggcgggctcccactccatgaggtatttcttcacatccrtgtcccggcccggccgcggggagccccgcttcatcgccgtgggctacgtggacgacacgcagttcgtgcggttcgacagcgacgccgcgagccagaggat

SEQ ID NO: 2605 - DNA, 201 bp, Homo sapiens
cctcctgctactctcgggggccctggccctgacccagacctgggcgggctcccactccatgaggtatttcttcacatccgtgtcccggcccggccgcgggragccccgcttcatcgccgtgggctacgtggacgacacgcagttcgtgcggttcgacagcgacgccgcgagccagaggatggagccgcgggcgccgtggat

SEQ ID NO: 2606 - DNA, 201 bp, Homo sapiens
ttacatcgccctgaacgaggacctgcgctcttggaccgcggcggacatggcggctcagatcaccaagcgcaagtgggaggcggcccatgaggcggagcagytgagagcctacctggatggcacgtgcgtggagtggctccgcagatacctggagaacgggaaggagacgctgcagcgcacggacccccccaagacacatat

SEQ ID NO: 2607 - DNA, 201 bp, Homo sapiens
tacatcgccctgaacgaggacctgcgctcttggaccgcggcggacatggcggctcagatcaccaagcgcaagtgggaggcggcccatgaggcggagcagtdgagagcctacctggatggcacgtgcgtggagtggctccgcagatacctggagaacgggaaggagacgctgcagcgcacggacccccccaagacacatatg

SEQ ID NO: 2608 - DNA, 201 bp, Homo sapiens
gcaggaggggccggagtattgggaccaggagacacggaatgtgaaggcccagtcacagactgaccgagtggacctggggaccctgcgcggctactacaacsagagcgaggccggttctcacaccatccagataatgtatggctgcgacgtggggtcggacgggcgcttcctccgcgggtaccggcaggacgcctacgacgg

SEQ ID NO: 2609 - DNA, 201 bp, Homo sapiens
tgggcttctaccctgcggagatcacactgacctggcagcgggatggggaggaccagacccaggacacggagctcgtggagaccaggcctgcaggggatggraccttccagaagtgggcggctgtggtggtgccttctggagaggagcagagatacacctgccatgtgcagcatgagggtctgcccaagcccctcaccctga

SEQ ID NO: 2610 - DNA, 201 bp, Homo sapiens
gggggccctggccctgacccagacctgggcgggctcccactccatgaggtatttcttcacatccgtgtcccggcccggccgcggggagccccgcttcatckccgtgggctacgtggacgacacgcagttcgtgcggttcgacagcgacgccgcgagccagaggatggagccgcgggcgccgtggatagagcaggaggggcc

SEQ ID NO: 2611 - DNA, 201 bp, Homo sapiens
ccagacctgggcgggctcccactccatgaggtatttcttcacatccgtgtcccggcccggccgcggggagccccgcttcatcgccgtgggctacgtggacracacgcagttcgtgcggttcgacagcgacgccgcgagccagaggatggagccgcgggcgccgtggatagagcaggaggggccggagtattgggaccagga

SEQ ID NO: 2612 - DNA, 201 bp, Homo sapiens
actccatgaggtatttcttcacatccgtgtcccggcccggccgcggggagccccgcttcatcgccgtgggctacgtggacgacacgcagttcgtgcggttygacagcgacgccgcgagccagaggatggagccgcgggcgccgtggatagagcaggaggggccggagtattgggaccaggagacacggaatgtgaaggccc

SEQ ID NO: 2613 - DNA, 201 bp, Homo sapiens
actacaaccagagcgaggccggttctcacaccatccagataatgtatggctgcgacgtggggtcggacgggcgcttcctccgcgggtaccggcaggacgcytacgacggcaaggattacatcgccctgaacgaggacctgcgctcttggaccgcggcggacatggcggctcagatcaccaagcgcaagtgggaggcggccc

SEQ ID NO: 2614 - DNA, 201 bp, Homo sapiens
gtattgggaccaggagacacggaatgtgaaggcccagtcacagactgaccgagtggacctggggaccctgcgcggctactacaaccagagcgaggccggtwctcacaccatccagataatgtatggctgcgacgtggggtcggacgggcgcttcctccgcgggtaccggcaggacgcctacgacggcaaggattacatcgc

SEQ ID NO: 2615 - DNA, 201 bp, Homo sapiens
acacggaatgtgaaggcccagtcacagactgaccgagtggacctggggaccctgcgcggctactacaaccagagcgaggccggttctcacaccatccagakaatgtatggctgcgacgtggggtcggacgggcgcttcctccgcgggtaccggcaggacgcctacgacggcaaggattacatcgccctgaacgaggacctg

SEQ ID NO: 2616 - DNA, 201 bp, Homo sapiens
  misc_feature (1)...(201): n = A,T,C or G, or insertion/deletion polymorphism (see Tables 1-2)
gaaggcccagtcacagactgaccgagtggacctggggaccctgcgcggctactacaaccagagcgaggccggttctcacaccatccagataatgtatggcngcgacgtggggtcggacgggcgcttcctccgcgggtaccggcaggacgcctacgacggcaaggattacatcgccctgaacgaggacctgcgctcttggac

SEQ ID NO: 2617 - DNA, 201 bp, Homo sapiens
ttcttcacatccgtgtcccggcccggccgcggggagccccgcttcatcgccgtgggctacgtggacgacacgcagttcgtgcggttcgacagcgacgccgsgagccagaggatggagccgcgggcgccgtggatagagcaggaggggccggagtattgggaccaggagacacggaatgtgaaggcccagtcacagactgac

SEQ ID NO: 2618 - DNA, 201 bp, Homo sapiens
ggaggaccagacccaggacacggagctcgtggagaccaggcctgcaggggatggaaccttccagaagtgggcggctgtggtggtgccttctggagaggagmagagatacacctgccatgtgcagcatgagggtctgcccaagcccctcaccctgagatgggagctgtcttcccagcccaccatccccatcgtgggcatcat

SEQ ID NO: 2619 - DNA, 201 bp, Homo sapiens
gagtggacctggggaccctgcgcggctactacaaccagagcgaggccggttctcacaccatccagataatgtatggctgcgacgtggggtcggacgggcgmttcctccgcgggtaccggcaggacgcctacgacggcaaggattacatcgccctgaacgaggacctgcgctcttggaccgcggcggacatggcggctcaga

SEQ ID NO: 2620 - DNA, 201 bp, Homo sapiens
tggacctggggaccctgcgcggctactacaaccagagcgaggccggttctcacaccatccagataatgtatggctgcgacgtggggtcggacgggcgcttmctccgcgggtaccggcaggacgcctacgacggcaaggattacatcgccctgaacgaggacctgcgctcttggaccgcggcggacatggcggctcagatca

SEQ ID NO: 2621 - DNA, 201 bp, Homo sapiens
  misc_feature (1)...(201): n = A,T,C or G, or insertion/deletion polymorphism (see Tables 1-2)
acatccgtgtcccggcccggccgcggggagccccgcttcatcgccgtgggctacgtggacgacacgcagttcgtgcggttcgacagcgacgccgcgagccngaggatggagccgcgggcgccgtggatagagcaggaggggccggagtattgggaccaggagacacggaatgtgaaggcccagtcacagactgaccgagtg

SEQ ID NO: 2622 - DNA, 201 bp, Homo sapiens
ccggccgcggggagccccgcttcatcgccgtgggctacgtggacgacacgcagttcgtgcggttcgacagcgacgccgcgagccagaggatggagccgcgrgcgccgtggatagagcaggaggggccggagtattgggaccaggagacacggaatgtgaaggcccagtcacagactgaccgagtggacctggggaccctgc

SEQ ID NO: 2623 - DNA, 201 bp, Homo sapiens
gccgcggggagccccgcttcatcgccgtgggctacgtggacgacacgcagttcgtgcggttcgacagcgacgccgcgagccagaggatggagccgcgggcvccgtggatagagcaggaggggccggagtattgggaccaggagacacggaatgtgaaggcccagtcacagactgaccgagtggacctggggaccctgcgcg

SEQ ID NO: 2624 - DNA, 201 bp, Homo sapiens
gaccaggcctgcaggggatggaaccttccagaagtgggcggctgtggtggtgccttctggagaggagcagagatacacctgccatgtgcagcatgagggtytgcccaagcccctcaccctgagatgggagctgtcttcccagcccaccatccccatcgtgggcatcattgctggcctggttctccttggagctgtgatcac

SEQ ID NO: 2625 - DNA, 201 bp, Homo sapiens
ccaggcctgcaggggatggaaccttccagaagtgggcggctgtggtggtgccttctggagaggagcagagatacacctgccatgtgcagcatgagggtctscccaagcccctcaccctgagatgggagctgtcttcccagcccaccatccccatcgtgggcatcattgctggcctggttctccttggagctgtgatcactg

SEQ ID NO: 2626 - DNA, 201 bp, Homo sapiens
gcctgcaggggatggaaccttccagaagtgggcggctgtggtggtgccttctggagaggagcagagatacacctgccatgtgcagcatgagggtctgcccragcccctcaccctgagatgggagctgtcttcccagcccaccatccccatcgtgggcatcattgctggcctggttctccttggagctgtgatcactggagc

SEQ ID NO: 2627 - DNA, 201 bp, Homo sapiens
acctggggaccctgcgcggctactacaaccagagcgaggccggttctcacaccatccagataatgtatggctgcgacgtggggtcggacgggcgcttcctscgcgggtaccggcaggacgcctacgacggcaaggattacatcgccctgaacgaggacctgcgctcttggaccgcggcggacatggcggctcagatcacca

SEQ ID NO: 2628 - DNA, 201 bp, Homo sapiens
ctggggaccctgcgcggctactacaaccagagcgaggccggttctcacaccatccagataatgtatggctgcgacgtggggtcggacgggcgcttcctccrcgggtaccggcaggacgcctacgacggcaaggattacatcgccctgaacgaggacctgcgctcttggaccgcggcggacatggcggctcagatcaccaag

SEQ ID NO: 2629 - DNA, 201 bp, Homo sapiens
ccctgcgcggctactacaaccagagcgaggccggttctcacaccatccagataatgtatggctgcgacgtggggtcggacgggcgcttcctccgcgggtaycggcaggacgcctacgacggcaaggattacatcgccctgaacgaggacctgcgctcttggaccgcggcggacatggcggctcagatcaccaagcgcaagt

SEQ ID NO: 2630 - DNA, 201 bp, Homo sapiens
agccccgcttcatcgccgtgggctacgtggacgacacgcagttcgtgcggttcgacagcgacgccgcgagccagaggatggagccgcgggcgccgtggatrgagcaggaggggccggagtattgggaccaggagacacggaatgtgaaggcccagtcacagactgaccgagtggacctggggaccctgcgcggctactaca

SEQ ID NO: 2631 - DNA, 130 bp, Homo sapiens
atgtgtccctcacagcttgtaaagtgtgarggctcccactccatgaggtatttcttcacatccgtgtcccggcccggccgcggggagccccgcttcatcgccgtgggctacgtggacgacacgcagttcg

SEQ ID NO: 2632 - DNA, 201 bp, Homo sapiens
cgcttcatcgccgtgggctacgtggacgacacgcagttcgtgcggttcgacagcgacgccgcgagccagaggatggagccgcgggcgccgtggatagagcrggaggggccggagtattgggaccaggagacacggaatgtgaaggcccagtcacagactgaccgagtggacctggggaccctgcgcggctactacaaccag

SEQ ID NO: 2633 - DNA, 124 bp, Homo sapiens
ccctcacagcttgtaaagtgtgaycactccatgaggtatttcttcacatccgtgtcccggcccggccgcggggagccccgcttcatcgccgtgggctacgtggacgacacgcagttcgtgcggt

SEQ ID NO: 2634 - DNA, 201 bp, Homo sapiens
cgacacgcagttcgtgcggttcgacagcgacgccgcgagccagaggatggagccgcgggcgccgtggatagagcaggaggggccggagtattgggaccagvagacacggaatgtgaaggcccagtcacagactgaccgagtggacctggggaccctgcgcggctactacaaccagagcgaggccggttctcacaccatcca

SEQ ID NO: 2635 - DNA, 201 bp, Homo sapiens
ggatggggaggaccagacccaggacacggagctcgtggagaccaggcctgcaggggatggaaccttccagaagtgggcggctgtggtggtgccttctggavaggagcagagatacacctgccatgtgcagcatgagggtctgcccaagcccctcaccctgagatgggagctgtcttcccagcccaccatccccatcgtggg

SEQ ID NO: 2636 - DNA, 201 bp, Homo sapiens
aagtgggcggctgtggtggtgccttctggagaggagcagagatacacctgccatgtgcagcatgagggtctgcccaagcccctcaccctgagatgggagcygtcttcccagcccaccatccccatcgtgggcatcattgctggcctggttctccttggagctgtgatcactggagctgtggtcgctgccgtgatgtggagg

SEQ ID NO: 2637 - DNA, 201 bp, Homo sapiens
agtgggcggctgtggtggtgccttctggagaggagcagagatacacctgccatgtgcagcatgagggtctgcccaagcccctcaccctgagatgggagctrtcttcccagcccaccatccccatcgtgggcatcattgctggcctggttctccttggagctgtgatcactggagctgtggtcgctgccgtgatgtggagga

SEQ ID NO: 2638 - DNA, 201 bp, Homo sapiens
ggtgccttctggagaggagcagagatacacctgccatgtgcagcatgagggtctgcccaagcccctcaccctgagatgggagctgtcttcccagcccaccrtccccatcgtgggcatcattgctggcctggttctccttggagctgtgatcactggagctgtggtcgctgccgtgatgtggaggaggaagagctcagatag

SEQ ID NO: 2639 - DNA, 104 bp, Homo sapiens
tgahcacatccgtgtcccggcccggccgcggggagccccgcttcatcgccgtgggctacgtggacgacacgcagttcgtgcggttcgacagcgacgccgcgagc

SEQ ID NO: 2640 - DNA, 201 bp, Homo sapiens
tggccgtcatggcgccccgaaccctcctcctgctactctcgggggccctggccctgacccagacctgggcgggctcccactccatgaggtatttcttcacmtccgtgtcccggcccggccgcggggagccccgcttcatcgccgtgggctacgtggacgacacgcagttcgtgcggttcgacagcgacgccgcgagccaga

SEQ ID NO: 2641 - DNA, 201 bp, Homo sapiens
cctgcgcggctactacaaccagagcgaggccggttctcacaccatccagataatgtatggctgcgacgtggggtcggacgggcgcttcctccgcgggtacsggcaggacgcctacgacggcaaggattacatcgccctgaacgaggacctgcgctcttggaccgcggcggacatggcggctcagatcaccaagcgcaagtg

SEQ ID NO: 2642 - DNA, 201 bp, Homo sapiens
ccctcctcctgctactctcgggggccctggccctgacccagacctgggcgggctcccactccatgaggtatttcttcacatccgtgtcccggcccggccgyggggagccccgcttcatcgccgtgggctacgtggacgacacgcagttcgtgcggttcgacagcgacgccgcgagccagaggatggagccgcgggcgccgt

SEQ ID NO: 2643 - DNA, 201 bp, Homo sapiens
tgcgcggctactacaaccagagcgaggccggttctcacaccatccagataatgtatggctgcgacgtggggtcggacgggcgcttcctccgcgggtaccgvcaggacgcctacgacggcaaggattacatcgccctgaacgaggacctgcgctcttggaccgcggcggacatggcggctcagatcaccaagcgcaagtggg

SEQ ID NO: 2644 - DNA, 201 bp, Homo sapiens
cgcggctactacaaccagagcgaggccggttctcacaccatccagataatgtatggctgcgacgtggggtcggacgggcgcttcctccgcgggtaccggcrggacgcctacgacggcaaggattacatcgccctgaacgaggacctgcgctcttggaccgcggcggacatggcggctcagatcaccaagcgcaagtgggag

SEQ ID NO: 2645 - DNA, 201 bp, Homo sapiens
tgagatgggagctgtcttcccagcccaccatccccatcgtgggcatcattgctggcctggttctccttggagctgtgatcactggagctgtggtcgctgcygtgatgtggaggaggaagagctcagatagaaaaggagggagttacactcaggctgcaagcagtgacagtgcccagggctctgatgtgtccctcacagctt

SEQ ID NO: 2646 - DNA, 201 bp, Homo sapiens
tcctcctgctactctcgggggccctggccctgacccagacctgggcgggctcccactccatgaggtatttcttcacatccgtgtcccggcccggccgcggrgagccccgcttcatcgccgtgggctacgtggacgacacgcagttcgtgcggttcgacagcgacgccgcgagccagaggatggagccgcgggcgccgtgga

SEQ ID NO: 2647 - DNA, 201 bp, Homo sapiens
gacctgggcgggctcccactccatgaggtatttcttcacatccgtgtcccggcccggccgcggggagccccgcttcatcgccgtgggctacgtggacgacdcgcagttcgtgcggttcgacagcgacgccgcgagccagaggatggagccgcgggcgccgtggatagagcaggaggggccggagtattgggaccaggagac

SEQ ID NO: 2648 - DNA, 201 bp, Homo sapiens
cggctactacaaccagagcgaggccggttctcacaccatccagataatgtatggctgcgacgtggggtcggacgggcgcttcctccgcgggtaccggcagkacgcctacgacggcaaggattacatcgccctgaacgaggacctgcgctcttggaccgcggcggacatggcggctcagatcaccaagcgcaagtgggaggc

SEQ ID NO: 2649 - DNA, 201 bp, Homo sapiens
ggctactacaaccagagcgaggccggttctcacaccatccagataatgtatggctgcgacgtggggtcggacgggcgcttcctccgcgggtaccggcaggwcgcctacgacggcaaggattacatcgccctgaacgaggacctgcgctcttggaccgcggcggacatggcggctcagatcaccaagcgcaagtgggaggcg

SEQ ID NO: 2650 - DNA, 201 bp, Homo sapiens; identical to SEQ ID NO: 2613

SEQ ID NO: 2651 - DNA, 201 bp, Homo sapiens
cctgccatgtgcagcatgagggtctgcccaagcccctcaccctgagatgggagctgtcttcccagcccaccatccccatcgtgggcatcattgctggcctrgttctccttggagctgtgatcactggagctgtggtcgctgccgtgatgtggaggaggaagagctcagatagaaaaggagggagttacactcaggctgcaa

SEQ ID NO: 2652 - DNA, 201 bp, Homo sapiens
tcacaccatccagataatgtatggctgcgacgtggggtcggacgggcgcttcctccgcgggtaccggcaggacgcctacgacggcaaggattacatcgccytgaacgaggacctgcgctcttggaccgcggcggacatggcggctcagatcaccaagcgcaagtgggaggcggcccatgaggcggagcagttgagagccta

SEQ ID NO: 2653 - DNA, 201 bp, Homo sapiens
ccatccagataatgtatggctgcgacgtggggtcggacgggcgcttcctccgcgggtaccggcaggacgcctacgacggcaaggattacatcgccctgaamgaggacctgcgctcttggaccgcggcggacatggcggctcagatcaccaagcgcaagtgggaggcggcccatgaggcggagcagttgagagcctacctgg

SEQ ID NO: 2654 - DNA, 201 bp, Homo sapiens
tccagataatgtatggctgcgacgtggggtcggacgggcgcttcctccgcgggtaccggcaggacgcctacgacggcaaggattacatcgccctgaacgargacctgcgctcttggaccgcggcggacatggcggctcagatcaccaagcgcaagtgggaggcggcccatgaggcggagcagttgagagcctacctggatg

SEQ ID NO: 2655 - DNA, 201 bp, Homo sapiens
tgagggtctgcccaagcccctcaccctgagatgggagctgtcttcccagcccaccatccccatcgtgggcatcattgctggcctggttctccttggagctrtgatcactggagctgtggtcgctgccgtgatgtggaggaggaagagctcagatagaaaaggagggagttacactcaggctgcaagcagtgacagtgccca

SEQ ID NO: 2656 - DNA, 201 bp, Homo sapiens; identical to SEQ ID NO: 2615

SEQ ID NO: 2657 - DNA, 201 bp, Homo sapiens
aatgtatggctgcgacgtggggtcggacgggcgcttcctccgcgggtaccggcaggacgcctacgacggcaaggattacatcgccctgaacgaggacctgmgctcttggaccgcggcggacatggcggctcagatcaccaagcgcaagtgggaggcggcccatgaggcggagcagttgagagcctacctggatggcacgtg

SEQ ID NO: 2658 - DNA, 201 bp, Homo sapiens
atggctgcgacgtggggtcggacgggcgcttcctccgcgggtaccggcaggacgcctacgacggcaaggattacatcgccctgaacgaggacctgcgctcytggaccgcggcggacatggcggctcagatcaccaagcgcaagtgggaggcggcccatgaggcggagcagttgagagcctacctggatggcacgtgcgtgg

SEQ ID NO: 2659 - DNA, 201 bp, Homo sapiens
acgtggggtcggacgggcgcttcctccgcgggtaccggcaggacgcctacgacggcaaggattacatcgccctgaacgaggacctgcgctcttggaccgcrgcggacatggcggctcagatcaccaagcgcaagtgggaggcggcccatgaggcggagcagttgagagcctacctggatggcacgtgcgtggagtggctcc

SEQ ID NO: 2660 - DNA, 201 bp, Homo sapiens
tggggtcggacgggcgcttcctccgcgggtaccggcaggacgcctacgacggcaaggattacatcgccctgaacgaggacctgcgctcttggaccgcggcrgacatggcggctcagatcaccaagcgcaagtgggaggcggcccatgaggcggagcagttgagagcctacctggatggcacgtgcgtggagtggctccgca

SEQ ID NO: 2661 - DNA, 201 bp, Homo sapiens
tcggacgggcgcttcctccgcgggtaccggcaggacgcctacgacggcaaggattacatcgccctgaacgaggacctgcgctcttggaccgcggcggacadggcggctcagatcaccaagcgcaagtgggaggcggcccatgaggcggagcagttgagagcctacctggatggcacgtgcgtggagtggctccgcagatac

SEQ ID NO: 2662 - DNA, 201 bp, Homo sapiens
gcgcttcctccgcgggtaccggcaggacgcctacgacggcaaggattacatcgccctgaacgaggacctgcgctcttggaccgcggcggacatggcggctyagatcaccaagcgcaagtgggaggcggcccatgaggcggagcagttgagagcctacctggatggcacgtgcgtggagtggctccgcagatacctggagaa

SEQ ID NO: 2663 - DNA, 201 bp, Homo sapiens
gctgggccctgggcttctaccctgcggagatcacactgacctggcagcgggatggggaggaccagacccaggacacggagctcgtggagaccaggcctgcmggggatggaaccttccagaagtgggcggctgtggtggtgccttctggagaggagcagagatacacctgccatgtgcagcatgagggtctgcccaagcccc

SEQ ID NO: 2664 - DNA, 201 bp, Homo sapiens
agacccaggacacggagctcgtggagaccaggcctgcaggggatggaaccttccagaagtgggcggctgtggtggtgccttctggagaggagcagagatamacctgccatgtgcagcatgagggtctgcccaagcccctcaccctgagatgggagctgtcttcccagcccaccatccccatcgtgggcatcattgctggcc

SEQ ID NO: 2665 - DNA, 201 bp, Homo sapiens
ccttctggagaggagcagagatacacctgccatgtgcagcatgagggtctgcccaagcccctcaccctgagatgggagctgtcttcccagcccaccatccmcatcgtgggcatcattgctggcctggttctccttggagctgtgatcactggagctgtggtcgctgccgtgatgtggaggaggaagagctcagatagaaaa

SEQ ID NO: 2666 - DNA, 201 bp, Homo sapiens
tcctccgcgggtaccggcaggacgcctacgacggcaaggattacatcgccctgaacgaggacctgcgctcttggaccgcggcggacatggcggctcagatyaccaagcgcaagtgggaggcggcccatgaggcggagcagttgagagcctacctggatggcacgtgcgtggagtggctccgcagatacctggagaacggga

SEQ ID NO: 2667 - DNA, 201 bp, Homo sapiens
gggtaccggcaggacgcctacgacggcaaggattacatcgccctgaacgaggacctgcgctcttggaccgcggcggacatggcggctcagatcaccaagcrcaagtgggaggcggcccatgaggcggagcagttgagagcctacctggatggcacgtgcgtggagtggctccgcagatacctggagaacgggaaggagacg

SEQ ID NO: 2668 - DNA, 201 bp, Homo sapiens
aggacgcctacgacggcaaggattacatcgccctgaacgaggacctgcgctcttggaccgcggcggacatggcggctcagatcaccaagcgcaagtgggamgcggcccatgaggcggagcagttgagagcctacctggatggcacgtgcgtggagtggctccgcagatacctggagaacgggaaggagacgctgcagcgca

SEQ ID NO: 2669 - DNA, 201 bp, Homo sapiens
ctggagaggagcagagatacacctgccatgtgcagcatgagggtctgcccaagcccctcaccctgagatgggagctgtcttcccagcccaccatccccatygtgggcatcattgctggcctggttctccttggagctgtgatcactggagctgtggtcgctgccgtgatgtggaggaggaagagctcagatagaaaaggag

SEQ ID NO: 2670 - DNA, 201 bp, Homo sapiens
gcagagatacacctgccatgtgcagcatgagggtctgcccaagcccctcaccctgagatgggagctgtcttcccagcccaccatccccatcgtgggcatcmttgctggcctggttctccttggagctgtgatcactggagctgtggtcgctgccgtgatgtggaggaggaagagctcagatagaaaaggagggagttacac

SEQ ID NO: 2671 - DNA, 201 bp, Homo sapiens
tgtgcagcatgagggtctgcccaagcccctcaccctgagatgggagctgtcttcccagcccaccatccccatcgtgggcatcattgctggcctggttctcyttggagctgtgatcactggagctgtggtcgctgccgtgatgtggaggaggaagagctcagatagaaaaggagggagttacactcaggctgcaagcagtga

SEQ ID NO: 2672 - DNA, 201 bp, Homo sapiens
cagcatgagggtctgcccaagcccctcaccctgagatgggagctgtcttcccagcccaccatccccatcgtgggcatcattgctggcctggttctccttgsagctgtgatcactggagctgtggtcgctgccgtgatgtggaggaggaagagctcagatagaaaaggagggagttacactcaggctgcaagcagtgacagt

SEQ ID NO: 2673 - DNA, 201 bp, Homo sapiens
ggacgcctacgacggcaaggattacatcgccctgaacgaggacctgcgctcttggaccgcggcggacatggcggctcagatcaccaagcgcaagtgggagdcggcccatgaggcggagcagttgagagcctacctggatggcacgtgcgtggagtggctccgcagatacctggagaacgggaaggagacgctgcagcgcac

SEQ ID NO: 2674 - DNA, 201 bp, Homo sapiens
acgcctacgacggcaaggattacatcgccctgaacgaggacctgcgctcttggaccgcggcggacatggcggctcagatcaccaagcgcaagtgggaggcsgcccatgaggcggagcagttgagagcctacctggatggcacgtgcgtggagtggctccgcagatacctggagaacgggaaggagacgctgcagcgcacgg

SEQ ID NO: 2675 - DNA, 201 bp, Homo sapiens
gggtctgcccaagcccctcaccctgagatgggagctgtcttcccagcccaccatccccatcgtgggcatcattgctggcctggttctccttggagctgtgwtcactggagctgtggtcgctgccgtgatgtggaggaggaagagctcagatagaaaaggagggagttacactcaggctgcaagcagtgacagtgcccaggg

SEQ ID NO: 2676 - DNA, 201 bp, Homo sapiens
tctgcccaagcccctcaccctgagatgggagctgtcttcccagcccaccatccccatcgtgggcatcattgctggcctggttctccttggagctgtgatcrctggagctgtggtcgctgccgtgatgtggaggaggaagagctcagatagaaaaggagggagttacactcaggctgcaagcagtgacagtgcccagggctc

SEQ ID NO: 2677 - DNA, 201 bp, Homo sapiens
cacggaatgtgaaggcccagtcacagactgaccgagtggacctggggaccctgcgcggctactacaaccagagcgaggccggttctcacaccatccagatratgtatggctgcgacgtggggtcggacgggcgcttcctccgcgggtaccggcaggacgcctacgacggcaaggattacatcgccctgaacgaggacctgc

SEQ ID NO: 2678 - DNA, 201 bp, Homo sapiens
aatgtgaaggcccagtcacagactgaccgagtggacctggggaccctgcgcggctactacaaccagagcgaggccggttctcacaccatccagataatgtwtggctgcgacgtggggtcggacgggcgcttcctccgcgggtaccggcaggacgcctacgacggcaaggattacatcgccctgaacgaggacctgcgctct

SEQ ID NO: 2679 - DNA, 201 bp, Homo sapiens; identical to SEQ ID NO: 2653

SEQ ID NO: 2680 - DNA, 201 bp, Homo sapiens
gggccctggccctgacccagacctgggcgggctcccactccatgaggtatttcttcacatccgtgtcccggcccggccgcggggagccccgcttcatcgcmgtgggctacgtggacgacacgcagttcgtgcggttcgacagcgacgccgcgagccagaggatggagccgcgggcgccgtggatagagcaggaggggccgg

SEQ ID NO: 2681 - DNA, 201 bp, Homo sapiens
catcgccgtgggctacgtggacgacacgcagttcgtgcggttcgacagcgacgccgcgagccagaggatggagccgcgggcgccgtggatagagcaggagrggccggagtattgggaccaggagacacggaatgtgaaggcccagtcacagactgaccgagtggacctggggaccctgcgcggctactacaaccagagcga

SEQ ID NO: 2682 - DNA, 201 bp, Homo sapiens
gacgacacgcagttcgtgcggttcgacagcgacgccgcgagccagaggatggagccgcgggcgccgtggatagagcaggaggggccggagtattgggaccrggagacacggaatgtgaaggcccagtcacagactgaccgagtggacctggggaccctgcgcggctactacaaccagagcgaggccggttctcacaccatc

SEQ ID NO: 2683 - DNA, 201 bp, Homo sapiens
cgtgcggttcgacagcgacgccgcgagccagaggatggagccgcgggcgccgtggatagagcaggaggggccggagtattgggaccaggagacacggaatrtgaaggcccagtcacagactgaccgagtggacctggggaccctgcgcggctactacaaccagagcgaggccggttctcacaccatccagataatgtatgg

SEQ ID NO: 2684 - DNA, 201 bp, Homo sapiens
cgcgagccagaggatggagccgcgggcgccgtggatagagcaggaggggccggagtattgggaccaggagacacggaatgtgaaggcccagtcacagactvaccgagtggacctggggaccctgcgcggctactacaaccagagcgaggccggttctcacaccatccagataatgtatggctgcgacgtggggtcggacgg

SEQ ID NO: 2685 - DNA, 201 bp, Homo sapiens
cagaggatggagccgcgggcgccgtggatagagcaggaggggccggagtattgggaccaggagacacggaatgtgaaggcccagtcacagactgaccgaghggacctggggaccctgcgcggctactacaaccagagcgaggccggttctcacaccatccagataatgtatggctgcgacgtggggtcggacgggcgcttc

SEQ ID NO: 2686 - DNA, 201 bp, Homo sapiens
gaggatggagccgcgggcgccgtggatagagcaggaggggccggagtattgggaccaggagacacggaatgtgaaggcccagtcacagactgaccgagtgracctggggaccctgcgcggctactacaaccagagcgaggccggttctcacaccatccagataatgtatggctgcgacgtggggtcggacgggcgcttcct

SEQ ID NO: 2687 - DNA, 201 bp, Homo sapiens
ccgcgggcgccgtggatagagcaggaggggccggagtattgggaccaggagacacggaatgtgaaggcccagtcacagactgaccgagtggacctggggaycctgcgcggctactacaaccagagcgaggccggttctcacaccatccagataatgtatggctgcgacgtggggtcggacgggcgcttcctccgcgggtac

SEQ ID NO: 2688 - DNA, 201 bp, Homo sapiens
gccgtggatagagcaggaggggccggagtattgggaccaggagacacggaatgtgaaggcccagtcacagactgaccgagtggacctggggaccctgcgcsgctactacaaccagagcgaggccggttctcacaccatccagataatgtatggctgcgacgtggggtcggacgggcgcttcctccgcgggtaccggcagga

SEQ ID NO: 2689 - DNA, 201 bp, Homo sapiens
ccggagtattgggaccaggagacacggaatgtgaaggcccagtcacagactgaccgagtggacctggggaccctgcgcggctactacaaccagagcgaggmcggttctcacaccatccagataatgtatggctgcgacgtggggtcggacgggcgcttcctccgcgggtaccggcaggacgcctacgacggcaaggattac

SEQ ID NO: 2690 - DNA, 201 bp, Homo sapiens
ccaggagacacggaatgtgaaggcccagtcacagactgaccgagtggacctggggaccctgcgcggctactacaaccagagcgaggccggttctcacaccvtccagataatgtatggctgcgacgtggggtcggacgggcgcttcctccgcgggtaccggcaggacgcctacgacggcaaggattacatcgccctgaacga

SEQ ID NO: 2691 - DNA, 201 bp, Homo sapiens; identical to SEQ ID NO: 2677

SEQ ID NO: 2692 - DNA, 201 bp, Homo sapiens
ccatctctgaccatgaggccaccctgaggtgctgggccctgggcttctaccctgcggagatcacactgacctggcagcgggatggggaggaccagacccasgacacggagctcgtggagaccaggcctgcaggggatggaaccttccagaagtgggcggctgtggtggtgccttctggagaggagcagagatacacctgcc

SEQ ID NO: 2693 - DNA, 201 bp, Homo sapiens
catctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgcca

SEQ ID NO: 2694 - DNA, 201 bp, Homo sapiens
tgctgggccctgggcttctaccctgcggagatcacactgacctggcagcgggatggggaggaccagacccaggacacggagctcgtggagaccaggcctgmaggggatggaaccttccagaagtgggcggctgtggtggtgccttctggagaggagcagagatacacctgccatgtgcagcatgagggtctgcccaagccc

SEQ ID NO: 2695 - DNA, 201 bp, Homo sapiens; identical to SEQ ID NO: 2678

SEQ ID NO: 2696 - DNA, 201 bp, Homo sapiens
acagactgaccgagtggacctggggaccctgcgcggctactacaaccagagcgaggccggttctcacaccatccagataatgtatggctgcgacgtggggycggacgggcgcttcctccgcgggtaccggcaggacgcctacgacggcaaggattacatcgccctgaacgaggacctgcgctcttggaccgcggcggacat

SEQ ID NO: 2697 - DNA, 201 bp, Homo sapiens
tgaccgagtggacctggggaccctgcgcggctactacaaccagagcgaggccggttctcacaccatccagataatgtatggctgcgacgtggggtcggackggcgcttcctccgcgggtaccggcaggacgcctacgacggcaaggattacatcgccctgaacgaggacctgcgctcttggaccgcggcggacatggcggc

SEQ ID NO: 2698 - DNA, 201 bp, Homo sapiens
agtggacctggggaccctgcgcggctactacaaccagagcgaggccggttctcacaccatccagataatgtatggctgcgacgtggggtcggacgggcgcytcctccgcgggtaccggcaggacgcctacgacggcaaggattacatcgccctgaacgaggacctgcgctcttggaccgcggcggacatggcggctcagat

SEQ ID NO: 2699 - DNA, 201 bp, Homo sapiens
ctgcgcggctactacaaccagagcgaggccggttctcacaccatccagataatgtatggctgcgacgtggggtcggacgggcgcttcctccgcgggtaccrgcaggacgcctacgacggcaaggattacatcgccctgaacgaggacctgcgctcttggaccgcggcggacatggcggctcagatcaccaagcgcaagtgg

SEQ ID NO: 2700 - DNA, 201 bp, Homo sapiens
acgggcgcttcctccgcgggtaccggcaggacgcctacgacggcaaggattacatcgccctgaacgaggacctgcgctcttggaccgcggcggacatggcrgctcagatcaccaagcgcaagtgggaggcggcccatgaggcggagcagttgagagcctacctggatggcacgtgcgtggagtggctccgcagatacctgg

SEQ ID NO: 2701 - DNA, 201 bp, Homo sapiens
ttcctccgcgggtaccggcaggacgcctacgacggcaaggattacatcgccctgaacgaggacctgcgctcttggaccgcggcggacatggcggctcagaycaccaagcgcaagtgggaggcggcccatgaggcggagcagttgagagcctacctggatggcacgtgcgtggagtggctccgcagatacctggagaacggg

SEQ ID NO: 2702 - DNA, 201 bp, Homo sapiens
ccgcgggtaccggcaggacgcctacgacggcaaggattacatcgccctgaacgaggacctgcgctcttggaccgcggcggacatggcggctcagatcaccvagcgcaagtgggaggcggcccatgaggcggagcagttgagagcctacctggatggcacgtgcgtggagtggctccgcagatacctggagaacgggaagga

SEQ ID NO: 2703 - DNA, 201 bp, Homo sapiens
gcctacgacggcaaggattacatcgccctgaacgaggacctgcgctcttggaccgcggcggacatggcggctcagatcaccaagcgcaagtgggaggcggyccatgaggcggagcagttgagagcctacctggatggcacgtgcgtggagtggctccgcagatacctggagaacgggaaggagacgctgcagcgcacggac

SEQ ID NO: 2704 - DNA, 201 bp, Homo sapiens
tacgacggcaaggattacatcgccctgaacgaggacctgcgctcttggaccgcggcggacatggcggctcagatcaccaagcgcaagtgggaggcggcccdtgaggcggagcagttgagagcctacctggatggcacgtgcgtggagtggctccgcagatacctggagaacgggaaggagacgctgcagcgcacggacccc

SEQ ID NO: 2705 - DNA, 201 bp, Homo sapiens
cgacggcaaggattacatcgccctgaacgaggacctgcgctcttggaccgcggcggacatggcggctcagatcaccaagcgcaagtgggaggcggcccatbaggcggagcagttgagagcctacctggatggcacgtgcgtggagtggctccgcagatacctggagaacgggaaggagacgctgcagcgcacggacccccc

SEQ ID NO: 2706 - DNA, 201 bp, Homo sapiens
gacggcaaggattacatcgccctgaacgaggacctgcgctcttggaccgcggcggacatggcggctcagatcaccaagcgcaagtgggaggcggcccatghggcggagcagttgagagcctacctggatggcacgtgcgtggagtggctccgcagatacctggagaacgggaaggagacgctgcagcgcacggaccccccc

SEQ ID NO: 2707 - DNA, 105 bp, Homo sapiens
gtgawtcacatccgtgtcccggcccggccgcggggagccccgcttcatcgccgtgggctacgtggacgacacgcagttcgtgcggttcgacagcgacgccgcgag

SEQ ID NO: 2708 - DNA, 201 bp, Homo sapiens
aaccctcctcctgctactctcgggggccctggccctgacccagacctgggcgggctcccactccatgaggtatttcttcacatccgtgtcccggcccggcmgcggggagccccgcttcatcgccgtgggctacgtggacgacacgcagttcgtgcggttcgacagcgacgccgcgagccagaggatggagccgcgggcgcc

SEQ ID NO: 2709 - DNA, 170 bp, Homo sapiens
gcatcattgctggcctggttctccttggagctgtgatcactggagctgtggtcgctgccgtgatgtggaggaggaagagctcagatagaaaaggagggagytacactcaggctgcaagcagtgacagtgcccagggctctgatgtgtccctcacagcttgtaaagtgtga

SEQ ID NO: 2710 - DNA, 201 bp, Homo sapiens; identical to SEQ ID NO: 2642

SEQ ID NO: 2711 - DNA, 201 bp, Homo sapiens; identical to SEQ ID NO: 2697

SEQ ID NO: 2712 - DNA, 201 bp, Homo sapiens; identical to SEQ ID NO: 2698

SEQ ID NO: 2713 - DNA, 201 bp, Homo sapiens; identical to SEQ ID NO: 2699

SEQ ID NO: 2714 - DNA, 201 bp, Homo sapiens; identical to SEQ ID NO: 2652

SEQ ID NO: 2715 - DNA, 201 bp, Homo sapiens; identical to SEQ ID NO: 2700

SEQ ID NO: 2716 - DNA, 201 bp, Homo sapiens; identical to SEQ ID NO: 2701

SEQ ID NO: 2717 - DNA, 201 bp, Homo sapiens
ccgcgggtaccggcaggacgcctacgacggcaaggattacatcgccctgaacgaggacctgcgctcttggaccgcggcggacatggcggctcagatcaccmagcgcaagtgggaggcggcccatgaggcggagcagttgagagcctacctggatggcacgtgcgtggagtggctccgcagatacctggagaacgggaagga

SEQ ID NO: 2718 - DNA, 201 bp, Homo sapiens; identical to SEQ ID NO: 2667

SEQ ID NO: 2719 - DNA, 201 bp, Homo sapiens
ggacgcctacgacggcaaggattacatcgccctgaacgaggacctgcgctcttggaccgcggcggacatggcggctcagatcaccaagcgcaagtgggagrcggcccatgaggcggagcagttgagagcctacctggatggcacgtgcgtggagtggctccgcagatacctggagaacgggaaggagacgctgcagcgcac

SEQ ID NO: 2720 - DNA, 201 bp, Homo sapiens
tacgacggcaaggattacatcgccctgaacgaggacctgcgctcttggaccgcggcggacatggcggctcagatcaccaagcgcaagtgggaggcggcccrtgaggcggagcagttgagagcctacctggatggcacgtgcgtggagtggctccgcagatacctggagaacgggaaggagacgctgcagcgcacggacccc

SEQ ID NO: 2721 - DNA, 201 bp, Homo sapiens
gatcacactgacctggcagcgggatggggaggaccagacccaggacacggagctcgtggagaccaggcctgcaggggatggaaccttccagaagtgggcgkctgtggtggtgccttctggagaggagcagagatacacctgccatgtgcagcatgagggtctgcccaagcccctcaccctgagatgggagctgtcttccca

SEQ ID NO: 2722 - DNA, 201 bp, Homo sapiens
cctggcagcgggatggggaggaccagacccaggacacggagctcgtggagaccaggcctgcaggggatggaaccttccagaagtgggcggctgtggtggtrccttctggagaggagcagagatacacctgccatgtgcagcatgagggtctgcccaagcccctcaccctgagatgggagctgtcttcccagcccaccatcc

SEQ ID NO: 2723 - DNA, 201 bp, Homo sapiens; identical to SEQ ID NO: 2618

SEQ ID NO: 2724 - DNA, 201 bp, Homo sapiens
gttcgtgcggttcgacagcgacgccgcgagccagaggatggagccgcgggcgccgtggatagagcaggaggggccggagtattgggaccaggagacacggmatgtgaaggcccagtcacagactgaccgagtggacctggggaccctgcgcggctactacaaccagagcgaggccggttctcacaccatccagataatgta

SEQ ID NO: 2725 - DNA, 201 bp, Homo sapiens
cgccgcgagccagaggatggagccgcgggcgccgtggatagagcaggaggggccggagtattgggaccaggagacacggaatgtgaaggcccagtcacagrctgaccgagtggacctggggaccctgcgcggctactacaaccagagcgaggccggttctcacaccatccagataatgtatggctgcgacgtggggtcgga

SEQ ID NO: 2726 - DNA, 201 bp, Homo sapiens
cgagccagaggatggagccgcgggcgccgtggatagagcaggaggggccggagtattgggaccaggagacacggaatgtgaaggcccagtcacagactgaycgagtggacctggggaccctgcgcggctactacaaccagagcgaggccggttctcacaccatccagataatgtatggctgcgacgtggggtcggacgggc

SEQ ID NO: 2727 - DNA, 201 bp, Homo sapiens; identical to SEQ ID NO: 2648

SEQ ID NO: 2728 - DNA, 201 bp, Homo sapiens
gccaagctgctgccagaccagctcctgcggaactggctgtggcattggtggtggcattggctatggccaggagggcagcagtggagctgtgagcacccgtrtcaggtggtgccgcccagactgccgtgtggagggtacctgcctgcccccctgctgtgtggtgagctgcacacccccaacctgctgccagctgcaccacgc

SEQ ID NO: 2729 - DNA, 120 bp, Homo sapiens
aagcaacccagacttcatascagctcccaacaccatgacctgctgccagaccagcttctgtggatatcccagctgctccaccagtgggacatgcggctccagctgctgccagccaagctg

SEQ ID NO: 2730 - DNA, 201 bp, Homo sapiens
cccacctgctaaaagccagtttgctgattttcaacttgaaatttccactttcagttccattcatgaacgaattatttcttcaagcacttatggacaacgarcaaattcttcaacctttctttgtctttcttatgggggttaccaaatattttggcctcagaattatctgattcctttcaattccagaaagaccttactctt

SEQ ID NO: 2731 - DNA, 201 bp, Homo sapiens
cccatcctactgtggacagtcctgctgccgcccagtctgctgctgctactcctgtgagcccacctgctaaaagccagtttgctgattttcaacttgaaatwtccactttcagttccattcatgaacgaattatttcttcaagcacttatggacaacgaacaaattcttcaacctttctttgtctttcttatgggggttacc

SEQ ID NO: 2732 - DNA, 201 bp, Homo sapiens
tgagcacccgtatcaggtggtgccgcccagactgccgtgtggagggtacctgcctgcccccctgctgtgtggtgagctgcacacccccaacctgctgccarctgcaccacgccgaggcctcctgctgccgcccatcctactgtggacagtcctgctgccgcccagtctgctgctgctactcctgtgagcccacctgctaaa

SEQ ID NO: 2733 - DNA, 201 bp, Homo sapiens
ttcataccagctcccaacaccatgacctgctgccagaccagcttctgtggatatcccagctgctccaccagtgggacatgcggctccagctgctgccagcmaagctgctgtgagaccagctgctgccagccaagctgctgccagaccagcttctgcggatttcctagcttctcaactagtgggacctgcagctccagttgc

SEQ ID NO: 2734 - DNA, 201 bp, Homo sapiens
atgacctgctgccagaccagcttctgtggatatcccagctgctccaccagtgggacatgcggctccagctgctgccagccaagctgctgtgagaccagctsctgccagccaagctgctgccagaccagcttctgcggatttcctagcttctcaactagtgggacctgcagctccagttgctgccagccaagctgctgtgag

SEQ ID NO: 2735 - DNA, 201 bp, Homo sapiens
tagcttctcaactagtgggacctgcagctccagttgctgccagccaagctgctgtgagaccagctgctgccagccaagctgctgccagaccagctcctgcrgaactggctgtggcattggtggtggcattggctatggccaggagggcagcagtggagctgtgagcacccgtatcaggtggtgccgcccagactgccgtgt

SEQ ID NO: 2736 - DNA, 201 bp, Homo sapiens
gtggaccatcgagtcatcttgggcaatgaactgccaaaattctatgatgagtgaaccttccccagacttctctttcttattttgtaataaactctctaggrccaaaacctggtatggtcattgggaaatgagtgctcagggagatggagcttaggggaggtgggtgcttccctcctagatgtcagcatacactctttcttc

SEQ ID NO: 2737 - DNA, 201 bp, Homo sapiens
tgcagggatgctgcgggcgggagcaccaaccggggacttaccccgggcgggagaagtccacaccgggaccaccatcatggcagtggagtttgacgggggcrttgtgatgggttctgattcccgagtgtctgcaggcgaggcggtggtgaaccgagtgtttgacaagctgtccccgctgcacgagcgcatctactgtgcact

SEQ ID NO: 2738 - DNA, 201 bp, Homo sapiens
gagtttgacgggggcgttgtgatgggttctgattcccgagtgtctgcaggcgaggcggtggtgaaccgagtgtttgacaagctgtccccgctgcacgagcrcatctactgtgcactctctggttcagctgctgatgcccaagccgtggccgacatggccgcctaccagctggagctccatgggatagaactggaggaacct

SEQ ID NO: 2739 - DNA, 201 bp, Homo sapiens
ctcctgcctttccacttgcaccagttttcccaccccagcctcagggcggggctgcctcgtcacttgtctcggggcagatctgccctacacacgttagcgcmgcgcgcaaagcagccccgcagcacccaggcgcctcctggcggcgccgcgaaggggcggggctgtcggctgcgcgttgtgcgctgtcccaggttggaaacc

SEQ ID NO: 2740 - DNA, 201 bp, Homo sapiens
tcggctgcgcgttgtgcgctgtcccaggttggaaaccagtgccccaggcggcgaggagagcggtgccttgcagggatgctgcgggcgggagcaccaaccgrggacttaccccgggcgggagaagtccacaccgggaccaccatcatggcagtggagtttgacgggggcgttgtgatgggttctgattcccgagtgtctgca

SEQ ID NO: 2741 - DNA, 166 bp, Homo sapiens
cccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaa

SEQ ID NO: 2742 - DNA, 165 bp, Homo sapiens
ccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaa

SEQ ID NO: 2743 - DNA, 201 bp, Homo sapiens
tctccctgcctcctgcctttccacttgcaccagttttcccaccccagcctcagggcggggctgcctcgtcacttgtctcggggcagatctgccctacacamgttagcgccgcgcgcaaagcagccccgcagcacccaggcgcctcctggcggcgccgcgaaggggcggggctgtcggctgcgcgttgtgcgctgtcccagg

SEQ ID NO: 2744 - DNA, 201 bp, Homo sapiens
gaggtcaggtatatggaaccctgggaggaatgctgactcgacagccttttgccattggtggctccggcagcacctttatctatggttatgtggatgcagcrtataagccaggcatgtctcccgaggagtgcaggcgcttcaccacagacgctattgctctggccatgagccgggatggctcaagcgggggtgtcatctacc

SEQ ID NO: 2745 - DNA, 167 bp, Homo sapiens
tcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaa

SEQ ID NO: 2746 - DNA, 201 bp, Homo sapiens; identical to SEQ ID NO: 2736

SEQ ID NO: 2747 - DNA, 201 bp, Homo sapiens; identical to SEQ ID NO: 2737

SEQ ID NO: 2748 - DNA, 201 bp, Homo sapiens; identical to SEQ ID NO: 2738

SEQ ID NO: 2749 - DNA, 201 bp, Homo sapiens; identical to SEQ ID NO: 2739

SEQ ID NO: 2750 - DNA, 201 bp, Homo sapiens; identical to SEQ ID NO: 2740

SEQ ID NO: 2751 - DNA, 201 bp, Homo sapiens
cccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaaggccaggcgcggtggctcgtgcctgtaattccagc

SEQ ID NO: 2752 - DNA, 201 bp, Homo sapiens
ccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaaggccaggcgcggtggctcgtgcctgtaattccagca

SEQ ID NO: 2753 - DNA, 165 bp, Homo sapiens
aggccaaggcgggtggttcacctgaggtcaggagttcgtgaccagtctggccaacatggtgaaacctcatctctacttaaaatacaaaaattagctgggcrtggtgcctgtaatcccagctactcgggaggctgaggcagggagaatcgcttgaacccgggaggc

SEQ ID NO: 2754 - DNA, 201 bp, Homo sapiens
gtactgaatgattttgaagtagtacaaacaataaaaattctcattccgcatcatcatgcggtccatgatgatgaggccgcaaggccaggcgcggtggctcrtgcctgtaattccagcactttgggaggccaaggcgggtggttcacctgaggtcaggagttcgtgaccagtctggccaacatggtgaaacctcatctctac

SEQ ID NO: 2755 - DNA, 201 bp, Homo sapiens; identical to SEQ ID NO: 2743

SEQ ID NO: 2756 - DNA, 201 bp, Homo sapiens; identical to SEQ ID NO: 2744

SEQ ID NO: 2757 - DNA, 201 bp, Homo sapiens
tcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaaggccaggcgcggtggctcgtgcctgtaattccag

SEQ ID NO: 2758 - DNA, 201 bp, Homo sapiens
gggtagtccaggagggcgcggtaaggctggggtgtcctggtgagaactggagaggatctacccgggtccctgcctggccagtggggaaacaccggtccccsaggcaccttcacctaaccagagcggggatttccaccgcccctcatgccgccctttggaggaaagtgaaagtgaaaggaggaagaggaggcttcatggctg

SEQ ID NO: 2759 - DNA, 201 bp, Homo sapiens
ctgggagctctgcggaatctgagccagcacccaggaagacaggagctcactctcaccccttctgcctgccaggtctttcagggccctcccttgaggacagygtaggccttttcctgtctgcctttcttctgcttgggctcttcaaggcactgggctgggctggtaagtgtcagccctaccctgaccatgacctgaggttgg

SEQ ID NO: 2760 - DNA, 201 bp, Homo sapiens
gcccgcgggccctggatggggcttggctgatggtcagcatatccagcccagtcctcagcctctccagcctcttgcgaccacagccagagcctcagcaggascctgttctcatcaccatggcaacagtggtactgactgtcctcacccacacccctgcccctcgagtgagactgggacaagatgctctgctggacttgagct

SEQ ID NO: 2761 - DNA, 201 bp, Homo sapiens
cccccaaagtgtccctgatgccagcaacccttgcacgggccgccccaggggaggcacccccggaattgctctgccttgtgtcccacttctacccttctggrggcctggaggtggagtgggaactccggggtggcccagggggccgctctcagaaggccgaggggcagaggtggctctcggccctgcgccaccattccgatg

SEQ ID NO: 2762 - DNA, 201 bp, Homo sapiens
tactgactgtcctcacccacacccctgcccctcgagtgagactgggacaagatgctctgctggacttgagctttgcctacatgccccccacctccgaggcygcctcatctctggctccgggtccccctccctttgggctagagtggcgacgccagcacctgggtaagggacatctgctcctggctgcaactcctgggctga

SEQ ID NO: 2763 - DNA, 201 bp, Homo sapiens
tgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagc

SEQ ID NO: 2764 - DNA, 201 bp, Homo sapiens
agcacacacaggagttggggggcgggggagggcctggggttggggagggctcgaactcggggctgctgggtagtccaggagggcgcggtaaggctggggtrtcctggtgagaactggagaggatctacccgggtccctgcctggccagtggggaaacaccggtcccccaggcaccttcacctaaccagagcggggatttcc

SEQ ID NO: 2765 - DNA, 201 bp, Homo sapiens
cggtcccccaggcaccttcacctaaccagagcggggatttccaccgcccctcatgccgccctttggaggaaagtgaaagtgaaaggaggaagaggaggctwcatggctgaggaggtcgcagcgccatgaagtccctgtctctgctcctcgctgtggctttgggcctggcgaccgccgtctcagcaggacccgcggtgatcg

SEQ ID NO: 2766 - DNA, 201 bp, Homo sapiens
ggtcccccaggcaccttcacctaaccagagcggggatttccaccgcccctcatgccgccctttggaggaaagtgaaagtgaaaggaggaagaggaggcttmatggctgaggaggtcgcagcgccatgaagtccctgtctctgctcctcgctgtggctttgggcctggcgaccgccgtctcagcaggacccgcggtgatcga

SEQ ID NO: 2767 - DNA, 201 bp, Homo sapiens
cagatgccagcagcccaagaaggggccgtggcatttgctgcttgggatgatgatgagccatggggcccatggaccggaaatgggaccttctggctgcctasagttcaaccctttcaggagggcacctatctggccaccatacacctgccatacctgcaaggacaggtcaccctggagcttgctgtgtacaaaccccccaaa

SEQ ID NO: 2768 - DNA, 201 bp, Homo sapiens
tctcagagatctgtagggccgaggttacatttggagaacccgtactctagggccaaatccattcttcttgccctggctcacttgtcccccccaccgccccrcgctggagccactgcctagttcttcagccctagatggtgctcgccagacctcctctcaatgctcatcacacacagggctattcctttcctccaatgaacc

SEQ ID NO: 2769 - DNA, 201 bp, Homo sapiens; identical to SEQ ID NO: 2758

SEQ ID NO: 2770 - DNA, 201 bp, Homo sapiens
cagacgaggtcggcctcgtcattccccgcagaccgccgcgcgtccctcttgtgcggttcaccacagttgtatttaagtgatcgtgtgagtcgtcgttaaaygcctgtctccccgcggatcatgggctcctcgaggacagggactggcctgtctgtccactgctgtaaccccgcgccggcatagggacctaaggcccactgg

SEQ ID NO: 2771 - DNA, 170 bp, Homo sapiens
ccctcttgtgcggttcaccacagttgtatttaagtgatcgtgtgagtcgtcgttaaatgcctgtctccccgcggatcatgggctcctcgaggacagggacyggcctgtctgtccactgctgtaaccccgcgccggcatagggacctaaggcccactggagggcgctcatc

SEQ ID NO: 2772 - DNA, 201 bp, Homo sapiens; identical to SEQ ID NO: 2760

SEQ ID NO: 2773 - DNA, 201 bp, Homo sapiens; identical to SEQ ID NO: 2761

SEQ ID NO: 2774 - DNA, 201 bp, Homo sapiens; identical to SEQ ID NO: 2762

SEQ ID NO: 2775 - DNA, 201 bp, Homo sapiens; identical to SEQ ID NO: 2763

SEQ ID NO: 2776 - DNA, 201 bp, Homo sapiens; identical to SEQ ID NO: 2764

SEQ ID NO: 2777 - DNA, 201 bp, Homo sapiens; identical to SEQ ID NO: 2765

SEQ ID NO: 2778 - DNA, 201 bp, Homo sapiens; identical to SEQ ID NO: 2766

SEQ ID NO: 2779 - DNA, 201 bp, Homo sapiens; identical to SEQ ID NO: 2767

SEQ ID NO: 2780 - DNA, 201 bp, Homo sapiens
tctcagagatctgtagggccgaggttacatttggagaacccgtactctagggccaaatccattcttcttgccctggctcacttgtcccccccaccgccccrcgctggagccactgcctagttcttcagccctagatggtgctcgccagacctcctctcaatgctcatcacacacagggctcagaccgccgcgcgtccctct

SEQ ID NO: 2781 - DNA, 201 bp, Homo sapiens; identical to SEQ ID NO: 2758

SEQ ID NO: 2782 - DNA, 201 bp, Homo sapiens
atgcctgtcgaattcaccatcccagcctgcctgcctcggggcgcagcgctgaggtcaccctggaggtagcaggtctttcagggccctcccttgaggacagygtaggccttttcctgtctgcctttcttctgcttgggctcttcaaggcactgggctgggctgctgtctacctgtccacctgcaaggattcaaagaagaaag

SEQ ID NO: 2783 - DNA, 201 bp, Homo sapiens; identical to SEQ ID NO: 2760

SEQ ID NO: 2784 - DNA, 201 bp, Homo sapiens; identical to SEQ ID NO: 2761

SEQ ID NO: 2785 - DNA, 201 bp, Homo sapiens; identical to SEQ ID NO: 2762

SEQ ID NO: 2786 - DNA, 201 bp, Homo sapiens; identical to SEQ ID NO: 2763

SEQ ID NO: 2787 - DNA, 201 bp, Homo sapiens; identical to SEQ ID NO: 2764

SEQ ID NO: 2788 - DNA, 201 bp, Homo sapiens; identical to SEQ ID NO: 2765

SEQ ID NO: 2789 - DNA, 201 bp, Homo sapiens; identical to SEQ ID NO: 2766

SEQ ID NO: 2790 - DNA, 201 bp, Homo sapiens; identical to SEQ ID NO: 2767

SEQ ID NO: 2791 - DNA, 201 bp, Homo sapiens
caatctctctccactgagtggctggaatgcttttttttttttctttcacttatataagggataatttttcttttttttttttttttgagacggagtctcamtcttccgcccaggctgcagtgcagtggcatgatcttggcttactgcaacctccgcctcctgggttcaagcaattctgtggcttcagcctccggagtagct

SEQ ID NO: 2792 - DNA, 201 bp, Homo sapiens; identical to SEQ ID NO: 2768

SEQ ID NO: 2793 - DNA, 201 bp, Homo sapiens; identical to SEQ ID NO: 2758

SEQ ID NO: 2794 - DNA, 201 bp, Homo sapiens; identical to SEQ ID NO: 2770

SEQ ID NO: 2795 - DNA, 201 bp, Homo sapiens; identical to SEQ ID NO: 2764

SEQ ID NO: 2796 - DNA, 170 bp, Homo sapiens; identical to SEQ ID NO: 2771

SEQ ID NO: 2797 - DNA, 201 bp, Homo sapiens; identical to SEQ ID NO: 2765

SEQ ID NO: 2798 - DNA, 201 bp, Homo sapiens; identical to SEQ ID NO: 2766

SEQ ID NO: 2799 - DNA, 201 bp, Homo sapiens
gcactggattgtggggaccgtaatagggggagggatgatggataagagggtgcctgggcaagtaagtagagatagaaagaggttcctgggagttagagggrtaatgggaggctagaagtttcctggaaatttgaggggctttgacatgggtatttctgtgacgcaccaatggagagacagtgggttccctatttcaggaga

SEQ ID NO: 2800 - DNA, 201 bp, Homo sapiens; identical to SEQ ID NO: 2780

SEQ ID NO: 2801 - DNA, 201 bp, Homo sapiens
cctgccatacctgcaaggacaggtcaccctggagcttgctgtgtacagtgagttgggggacagaggtctccaggggtagagggtgggcactggattgtggkgaccgtaatagggggagggatgatggataagagggtgcctgggcaagtaagtagagatagaaagaggttcctgggagttagaggggtaatgggaggctag

SEQ ID NO: 2802 - DNA, 201 bp, Homo sapiens; identical to SEQ ID NO: 2758

SEQ ID NO: 2803 - DNA, 201 bp, Homo sapiens
ctgggagttagaggggtaatgggaggctagaagtttcctggaaatttgaggggctttgacatgggtatttctgtgacgcaccaatggagagacagtgggtwccctatttcaggagaagaaacctaaccttctttagttctgaggaagccagcaggcaaactgagggtctcttagggaggacagtatggactgatttcccta

SEQ ID NO: 2804 - DNA, 201 bp, Homo sapiens
ttgctgtgtacagtgagttgggggacagaggtctccaggggtagagggtgggcactggattgtggggaccgtaatagggggagggatgatggataagaggrtgcctgggcaagtaagtagagatagaaagaggttcctgggagttagaggggtaatgggaggctagaagtttcctggaaatttgaggggctttgacatggg

SEQ ID NO: 2805 - DNA, 201 bp, Homo sapiens
tatttctgtgacgcaccaatggagagacagtgggttccctatttcaggagaagaaacctaaccttctttagttctgaggaagccagcaggcaaactgaggrtctcttagggaggacagtatggactgatttccctatgctcatttcgtcctctttccccagaaccccccaaagtgtccctgatgccagcaacccttgcacg

SEQ ID NO: 2806 - DNA, 201 bp, Homo sapiens; identical to SEQ ID NO: 2782

SEQ ID NO: 2807 - DNA, 201 bp, Homo sapiens; identical to SEQ ID NO: 2760

SEQ ID NO: 2808 - DNA, 201 bp, Homo sapiens; identical to SEQ ID NO: 2761

SEQ ID NO: 2809 - DNA, 201 bp, Homo sapiens; identical to SEQ ID NO: 2762

SEQ ID NO: 2810 - DNA, 201 bp, Homo sapiens
ctgccatacctgcaaggacaggtcaccctggagcttgctgtgtacagtgagttgggggacagaggtctccaggggtagagggtgggcactggattgtgggkaccgtaatagggggagggatgatggataagagggtgcctgggcaagtaagtagagatagaaagaggttcctgggagttagaggggtaatgggaggctaga

SEQ ID NO: 2811 - DNA, 201 bp, Homo sapiens; identical to SEQ ID NO: 2763

SEQ ID NO: 2812 - DNA, 201 bp, Homo sapiens; identical to SEQ ID NO: 2764

SEQ ID NO: 2813 - DNA, 201 bp, Homo sapiens; identical to SEQ ID NO: 2765

SEQ ID NO: 2814 - DNA, 201 bp, Homo sapiens; identical to SEQ ID NO: 2791

SEQ ID NO: 2815 - DNA, 201 bp, Homo sapiens
cagatgccagcagcccaagaaggggccgtggcatttgctgcttgggatgatgatgagccatggggcccatggaccggaaatgggaccttctggctgcctasagttcaaccctttcaggagggcacctatctggccaccatacacctgccatacctgcaaggacaggtcaccctggagcttgctgtgtacagtgagttgggg

SEQ ID NO: 2816 - DNA, 201 bp, Homo sapiens; identical to SEQ ID NO: 2766

SEQ ID NO: 2817 - DNA, 201 bp, Homo sapiens; identical to SEQ ID NO: 2768

SEQ ID NO: 2818 - DNA, 201 bp, Homo sapiens; identical to SEQ ID NO: 2758

SEQ ID NO: 2819 - DNA, 201 bp, Homo sapiens; identical to SEQ ID NO: 2770

SEQ ID NO: 2820 - DNA, 201 bp, Homo sapiens
ccctcttgtgcggttcaccacagttgtatttaagtgatcgtgtgagtcgtcgttaaatgcctgtctccccgcggatcatgggctcctcgaggacagggacyggcctgtctgtccactgctgtaaccccgcgccggcatagggacctaaggcccactggagggcgctcatcaagtagctgctggatgttgacgaaggaagcg

SEQ ID NO: 2821 - DNA, 201 bp, Homo sapiens; identical to SEQ ID NO: 2782

SEQ ID NO: 2822 - DNA, 201 bp, Homo sapiens; identical to SEQ ID NO: 2760

SEQ ID NO: 2823 - DNA, 201 bp, Homo sapiens; identical to SEQ ID NO: 2761

SEQ ID NO: 2824 - DNA, 158 bp, Homo sapiens
ctaaggcccactggagggcgctcatcaagtagctgctggatgttgacgaaggaagcggcggcgcagctcagggatctccgagtcaggacggtcggccagasccacggggtaacgggtctaatcgtgtaggaataaagctgtattccagtgcttccaaa

SEQ ID NO: 2825 - DNA, 201 bp, Homo sapiens; identical to SEQ ID NO: 2762

SEQ ID NO: 2826 - DNA, 201 bp, Homo sapiens; identical to SEQ ID NO: 2763

SEQ ID NO: 2827 - DNA, 201 bp, Homo sapiens; identical to SEQ ID NO: 2764

SEQ ID NO: 2828 - DNA, 201 bp, Homo sapiens; identical to SEQ ID NO: 2765

SEQ ID NO: 2829 - DNA, 201 bp, Homo sapiens; identical to SEQ ID NO: 2766

SEQ ID NO: 2830 - DNA, 201 bp, Homo sapiens; identical to SEQ ID NO: 2767

SEQ ID NO: 2831 - DNA, 201 bp, Homo sapiens
actggcctgtctgtccactgctgtaaccccgcgccggcatagggacctaaggcccactggagggcgctcatcaagtagctgctggatgttgacgaaggaarcggcggcgcagctcagggatctccgagtcaggacggtcggccagacccacggggtaacgggtctaatcgtgtaggaataaagctgtattccagtgcttcc

SEQ ID NO: 2832 - DNA, 201 bp, Homo sapiens; identical to SEQ ID NO: 2791

SEQ ID NO: 2833 - DNA, 201 bp, Homo sapiens
ttaaaaaggaaaaagatgcagaatctgtggaatgtcctgatgcagattcattgaacattcctgatgtagatgaagaaggctacagtattaaaccagaaacraatcagaatgataccaaagagaaccatttctactcatctagtgattctgactccgaagatgaagaaccaaagaagtatcggatagaaattaagcctatgc

SEQ ID NO: 2834 - DNA, 201 bp, Homo sapiens
ccaaagcttacttcaggcaaactcagtgggattaatgaaatacccaggccattcagcccacctgtaacttccaacaccagcccacctcctgctgcaccatwagcccgggcagaaagttcttcttctatctcatcatctgcttcattgagtgctgccaatactccaacagtaggatttaacaagttaattgtgtatattcta

SEQ ID NO: 2835 - DNA, 201 bp, Homo sapiens
  misc_feature (1)...(201): n = A,T,C or G, or insertion/deletion polymorphism (see Tables 1-2)
ccatttctactcatctagtgattctgactccgaagatgaagaaccaaagaagtatcggatagaaattaagcctatgcatccaaataactcacatcacacantggcttctttggatgaattaaaagtatctatagggaatataacactctccccagcaatatctagacacagtccagtaaatgaatcggaatttgtctaatg

SEQ ID NO: 2836 - DNA, 201 bp, Homo sapiens
ccgcccattgtgtccttgcccaggaccccgagaaccaggcgctggcgaggttttactgctacactgagaggaccattgcgaagcggctcgtcttgcggcgrgatccctcggtgaagaggactctctgtcgaggctgctcttccctcctcgtcccgggcctcacctgcacccagcgccagagacgctgcaggggacagcgct

SEQ ID NO: 2837 - DNA, 201 bp, Homo sapiens
aggcccagctcgggagccaagcagattccaaaccactacaacccttgccaaacacagcccactccatttcagaccgccttcctgaggagaaaatgcagackcagggttccagtaaccagtgatggattcaccccatctcccaaataaagtttacttgttttacattccatgattctgttctgtgggtatttcaactcttaa

SEQ ID NO: 2838 - DNA, 201 bp, Homo sapiens
ccattgcgaagcggctcgtcttgcggcgggatccctcggtgaagaggactctctgtcgaggctgctcttccctcctcgtcccgggcctcacctgcacccascgccagagacgctgcaggggacagcgctggaccgtacagacctgcctaacatgccagcgcagccaacgcttcctcaatgatcccgggcatttactctggg

SEQ ID NO: 2839 - DNA, 173 bp, Homo sapiens
ccactacaacccttgccaaacacagcccactccatttcagaccgccttcctgaggagaaaatgcagactcagggttccagtaaccagtgatggattcaccycatctcccaaataaagtttacttgttttacattccatgattctgttctgtgggtatttcaactcttaattcc

SEQ ID NO: 2840 - DNA, 164 bp, Homo sapiens
cccttgccaaacacagcccactccatttcagaccgccttcctgaggagaaaatgcagactcagggttccagtaaccagtgatggattcaccccatctcccraataaagtttacttgttttacattccatgattctgttctgtgggtatttcaactcttaattcc

SEQ ID NO: 2841 - DNA, 201 bp, Homo sapiens
accgtacagacctgcctaacatgccagcgcagccaacgcttcctcaatgatcccgggcatttactctggggagacaggcctgaggcccagctcgggagccmagcagattccaaaccactacaacccttgccaaacacagcccactccatttcagaccgccttcctgaggagaaaatgcagactcagggttccagtaaccag

SEQ ID NO: 2842 - DNA, 201 bp, Homo sapiens
ggcccagctcgggagccaagcagattccaaaccactacaacccttgccaaacacagcccactccatttcagaccgccttcctgaggagaaaatgcagactmagggttccagtaaccagtgatggattcaccccatctcccaaataaagtttacttgttttacattccatgattctgttctgtgggtatttcaactcttaat

SEQ ID NO: 2843 - DNA, 201 bp, Homo sapiens
agcgctggaccgtacagacctgcctaacatgccagcgcagccaacgcttcctcaatgatcccgggcatttactctggggagacaggcctgaggcccagctygggagccaagcagattccaaaccactacaacccttgccaaacacagcccactccatttcagaccgccttcctgaggagaaaatgcagactcagggttcca

SEQ ID NO: 2844 - DNA, 179 bp, Homo sapiens
caggaaatcgagactcatgactcccagagaggatggcatctagaagtagacgatcaagggtggaatctacagtccatgrgccctgacttcttgccttcgtctcaaatagactctgcagccagccatctatgcagcgccccagtggctttgaaatgcaacagaaaccatcacccccggac

SEQ ID NO: 2845 - DNA, 201 bp, Homo sapiens
ctaggaccttggctccaactctattgtactcgtctcctccctcccattctccttttggtctcagctccttgatctaagcctcccagagagacccctagaaygtttccctcaaggacctttctgcctggaagtctgttagcctttcagaagtaacatgtccaaaataaaatttgattcctcccaggttgttccctgcctggt

SEQ ID NO: 2846 - DNA, 201 bp, Homo sapiens
  misc_feature (1)...(201): n = A,T,C or G, or insertion/deletion polymorphism (see Tables 1-2)
ccagctccttaacacagatcccagctccgaggaaactcgtcccccccacgttaatcctgaccgactttgccacatggagccagcaaaccatttctggcatncaggggacctccaagcaatgatatccaaggaattccatctggcagccacccaggatgactgcagaaaaggaaggacacaggaggatatcctggttccctc

SEQ ID NO: 2847 - DNA, 201 bp, Homo sapiens
ccctgacttcttgccttcgtctcaaatagactctgcagccagccatctatgcagcgccccagtggctttgaaatgcaacagaaaccatcacccccggaccrtgggctccatgccagtgggcaaagcacagcctgggaagaattggtttgcagccaggcagtcctccatccagtcttgactttggcacttgtgatatgactt

SEQ ID NO: 2848 - DNA, 176 bp, Homo sapiens
caggaaatcgagactcatgactcccagagaggatggcatctagaagtagacgatcaagggtggaatctacagtccrtgggccctgacttcttgccttcgtctcaaatagactctgcagccagccatctatgcagcgccccagtggctttgaaatgcaacagaaaccatcacccccg

SEQ ID NO: 2849 - DNA, 201 bp, Homo sapiens
tatgacttgcacagaccaaaaaagtcactctcaaagagctctcggcacacagaccccagctttacaaggaccccagctccttaacacagatcccagctccraggaaactcgtcccccccacgttaatcctgaccgactttgccacatggagccagcaaaccatttctggcatgcaggggacctccaagcaatgatatccaa

SEQ ID NO: 2850 - DNA, 201 bp, Homo sapiens
gtcctgccaatggctccggaagaagctgccaggctccagcaacctcagccccttcctcctccctcaggaatccacctatccgcctctaggaccttggctcyaactctattgtactcgtctcctccctcccattctccttttggtctcagctccttgatctaagcctcccagagagacccctagaatgtttccctcaaggac

SEQ ID NO: 2851 - DNA, 201 bp, Homo sapiens; identical to SEQ ID NO: 2849

SEQ ID NO: 2852 - DNA, 201 bp, Homo sapiens
tccatccagtcttgactttggcacttgtgatatgacttgcacagaccaaaaaagtcactctcaaagagctctcggcacacagaccccagctttacaaggamcccagctccttaacacagatcccagctccaaggaaactcgtcccccccacgttaatcctgaccgactttgccacatggagccagcaaaccatttctggca

SEQ ID NO: 2853 - DNA, 201 bp, Homo sapiens
tccaaggaaactcgtcccccccacgttaatcctgaccgactttgccacatggagccagcaaaccatttctggcatgcaggggacctccaagcaatgatatscaaggaattccatctggcagccacccaggatgactgcagaaaaggaaggacacaggaggatatcctggttccctcttcccacccagagctgtttgcatca

SEQ ID NO: 2854 - DNA, 201 bp, Homo sapiens; identical to SEQ ID NO: 2845

SEQ ID NO: 2855 - DNA, 201 bp, Homo sapiens
  misc_feature (1)...(201): n = A,T,C or G, or insertion/deletion polymorphism (see Tables 1-2)
ccagctccttaacacagatcccagctccaaggaaactcgtcccccccacgttaatcctgaccgactttgccacatggagccagcaaaccatttctggcatncaggggacctccaagcaatgatatccaaggaattccatctggcagccacccaggatgactgcagaaaaggaaggacacaggaggatatcctggttccctc

SEQ ID NO: 2856 - DNA, 201 bp, Homo sapiens
caggaaatcgagactcatgactcccagagaggatggcatctagaagtagacgatcaagggtggaatctacagtccatgggccctgacttcttgccttcgtrtcaaatagactctgcagccagccatctatgcagcgccccagtggctttgaaatgcaacagaaaccatcacccccggaccgtgggctccatgccagtgggc

SEQ ID NO: 2857 - DNA, 201 bp, Homo sapiens; identical to SEQ ID NO: 2847

SEQ ID NO: 2858 - DNA, 201 bp, Homo sapiens; identical to SEQ ID NO: 2856

SEQ ID NO: 2859 - DNA, 106 bp, Homo sapiens
tgggctgctgtcttcatccctggggtggcaatgcctgcctgcatcttgacgggcctcctgtcggctgctggaggagctgggagctctgtcaggtaaagagraaaaa

SEQ ID NO: 2860 - DNA, 174 bp, Homo sapiens
tctcatccttgcagcctttagcttttgcaggatgagaccgggaggctcctgtggtcttggcctttgcctgggctgctgtcttcatccctggggtggcaatrcctgcctgcatcttgacgggcctcctgtcggctgctggaggagctgggagctctgtcaggtaaagagaaaaaa

SEQ ID NO: 2861 - DNA, 201 bp, Homo sapiens
aacccccaccccagtcaccgtcctgtcggttgcagagcactgcgtccgtgtgatgaaccacccccagtcaccctcctgccggtcgcagagcattgtgttcktgtggaggacacgcgaggactcttggaagtgctttttggcggggtagtgcagtgtgttccgagcggacgggcgtcagtttacgtgtgcgtttctcatcct

SEQ ID NO: 2862 - DNA, 201 bp, Homo sapiens
cccagtcaccctcctgccggtcgcagagcattgtgttcttgtggaggacacgcgaggactcttggaagtgctttttggcggggtagtgcagtgtgttccgrgcggacgggcgtcagtttacgtgtgcgtttctcatccttgcagcctttagcttttgcaggatgagaccgggaggctcctgtggtcttggcctttgcctgg

SEQ ID NO: 2863 - DNA, 201 bp, Homo sapiens
cgccctgcaaggcccgaagacacaacacagcatccacacggtgacctgtaaatcacctcggcagaaagaagacaggtccccaaagccaccccaggctcccmagcaccctgaggagcatggtcgccaatcccacagctcctcctcctttgccagtggcaccctccaggacacgtggaggttgctagacctgggatccagccc

SEQ ID NO: 2864 - DNA, 201 bp, Homo sapiens
gacaggtccccaaagccaccccaggctcccaagcaccctgaggagcatggtcgccaatcccacagctcctcctcctttgccagtggcaccctccaggacaygtggaggttgctagacctgggatccagcccttctggtgtcacctcccagggtgactcaactccagagctcccagctcctccagcagccgacaggaggccc

SEQ ID NO: 2865 - DNA, 201 bp, Homo sapiens
gcagccccattttacatctcaggacgccaagagtgccgaggatgaggctccttccagacacttgggaaagcaccagccccgctcagcacaggtgggcagcrgacttgacgccctgcaaggcccgaagacacaacacagcatccacacggtgacctgtaaatcacctcggcagaaagaagacaggtccccaaagccacccca

SEQ ID NO: 2866 - DNA, 201 bp, Homo sapiens
tgggatccagcccttctggtgtcacctcccagggtgactcaactccagagctcccagctcctccagcagccgacaggaggcccgtcaagatgcaggcaggyattgccaccccagggatgaagacagcagcccaggcaaaggccaagaccacaggagcctcccggtctcatcctgcaaaagctaaaggctgccaggggcccc

SEQ ID NO: 2867 - DNA, 201 bp, Homo sapiens
ccattttacatctcaggacgccaagagtgccgaggatgaggctccttccagacacttgggaaagcaccagccccgctcagcacaggtgggcagcagacttracgccctgcaaggcccgaagacacaacacagcatccacacggtgacctgtaaatcacctcggcagaaagaagacaggtccccaaagccaccccaggctcc

SEQ ID NO: 2868 - DNA, 132 bp, Homo sapiens
aagatccgtaactacaacattatggactgacttcctccccccaccccgccccactaaggggtgctcggggcctccgcatggtgcctgtgctttcacctacrtgttgtgggggggtgtgggcacagcgtgcag

SEQ ID NO: 2869 - DNA, 201 bp, Homo sapiens
ttttacatctcaggacgccaagagtgccgaggatgaggctccttccagacacttgggaaagcaccagccccgctcagcacaggtgggcagcagacttgacrccctgcaaggcccgaagacacaacacagcatccacacggtgacctgtaaatcacctcggcagaaagaagacaggtccccaaagccaccccaggctcccaa

SEQ ID NO: 2870 - DNA, 201 bp, Homo sapiens
ggcaggcattgccaccccagggatgaagacagcagcccaggcaaaggccaagaccacaggagcctcccggtctcatcctgcaaaagctaaaggctgccagrggccccccaagatccgtaactacaacattatggactgacttcctccccccaccccgccccactaaggggtgctcggggcctccgcatggtgcctgtgctt

SEQ ID NO: 2871 - DNA, 201 bp, Homo sapiens; identical to SEQ ID NO: 2863

SEQ ID NO: 2872 - DNA, 201 bp, Homo sapiens
gacaggtccccaaagccaccccaggctcccaagcaccctgaggagcatggtcgccaatcccacagctcctcctcctttgccagtggcaccctccaggacaygtggaggttgctagacctgggatccagcccttctggtgtcacctcccagggtgactcaactccagaacttcattctgtcctaaaggaagcagtcgcagct

SEQ ID NO: 2873 - DNA, 201 bp, Homo sapiens; identical to SEQ ID NO: 2865

SEQ ID NO: 2874 - DNA, 201 bp, Homo sapiens
cgccggccacagttcttcagtgaaacgcttcactctctggtcatagagagctcccagctcctccagcagccgacaggaggcccgtcaagatgcaggcaggyattgccaccccagggatgaagacagcagcccaggcaaaggccaagaccacaggagcctcccggtctcatcctgcaaaagctaaaggctgccaggggcccc

SEQ ID NO: 2875 - DNA, 201 bp, Homo sapiens; identical to SEQ ID NO: 2867

SEQ ID NO: 2876 - DNA, 140 bp, Homo sapiens
aagatccgtaactacaacattatggactgacttcctccccccaccccgccccactaaggggtgctcggggcctccgcatggtgcctgtgctttcacctacrtgttgtgggggggtgtgggcacagcgtgcagggtggagg

SEQ ID NO: 2877 - DNA, 201 bp, Homo sapiens; identical to SEQ ID NO: 2869

SEQ ID NO: 2878 - DNA, 201 bp, Homo sapiens; identical to SEQ ID NO: 2870

SEQ ID NO: 2879 - DNA, 201 bp, Homo sapiens
aaaggaagcagtcgcagcttaaagagtgtgagcacgcgcccactccccacagacacacccggcctgccccgccccacgctgcccctgccctggagaaagcraggctccttcctttcctggagacgccggccacagttcttcagtgaaacgcttcactctctggtcatagagagctcccagctcctccagcagccgacagga

SEQ ID NO: 2880 - DNA, 201 bp, Homo sapiens
taaaggaagcagtcgcagcttaaagagtgtgagcacgcgcccactccccacagacacacccggcctgccccgccccacgctgcccctgccctggagaaagygaggctccttcctttcctggagacgccggccacagttcttcagtgaaacgcttcactctctggtcatagagagctcccagctcctccagcagccgacagg

SEQ ID NO: 2881 - DNA, 201 bp, Homo sapiens; identical to SEQ ID NO: 2865

SEQ ID NO: 2882 - DNA, 201 bp, Homo sapiens; identical to SEQ ID NO: 2867

SEQ ID NO: 2883 - DNA, 201 bp, Homo sapiens
ttttacatctcaggacgccaagagtgccgaggatgaggctccttccagacacttgggaaagcaccagccccgctcagcacaggtgggcagcagacttgacrccctgcaaggcccgaagacacaacacagcatccacacggtgacctgtaaatcacctcggcagaaagaagacaggtccccaaagccaccccaggctcccca

SEQ ID NO: 2884 - DNA, 201 bp, Homo sapiens
cgccctgcaaggcccgaagacacaacacagcatccacacggtgacctgtaaatcacctcggcagaaagaagacaggtccccaaagccaccccaggctcccmagcaccctgaggagcatggtcgccaatcccacagctcctcctcctttgccagtggcaccctccaggacatgtggaggttgctagacctgggatccagccc

SEQ ID NO: 2885 - DNA, 201 bp, Homo sapiens
gacaggtccccaaagccaccccaggctccccagcaccctgaggagcatggtcgccaatcccacagctcctcctcctttgccagtggcaccctccaggacaygtggaggttgctagacctgggatccagcccttctggtgtcacctcccagggtgactcaactccagaaatggggtctcactatgtcacccaggctggtctc

SEQ ID NO: 2886 - DNA, 201 bp, Homo sapiens
cccagaagccacaacttatcagtccccagggggaaagactctcacaaggctggatcaggtgcaacaccaccataaggaagagtggattcggtggcatcackatgctcttcacaggatacttcgtcctgtgttgtagctggagtttcagacgtctgaaaaaattgtgccgacccctgccctggaagagcacagtacctccat

SEQ ID NO: 2887 - DNA, 201 bp, Homo sapiens
agaaagcagaagcccagaatcataattgtgtccctgatgtaaaggcattaatggagagtcccgagggacagttatctctggagcccaaatctgatagtcasttccaagcatcacacactgggtgccagagccctttatgttcagcccagcgtcacactcctcagagccccttcaccaatcatgctgcagctgctggcagga

SEQ ID NO: 2888 - DNA, 201 bp, Homo sapiens
atgtctgcaacagaaaagcaggaacggactgtcatgagccatggctgtgagaacttcaacaccagggattcagtcacaggaaaggagtctcaaggggaaaraccacatttaagtttgttcattccgagggagacgacttaccagtttcattctgtatcgcagtcaagtagtcaaagtcttgcctctctagctacaacattt

SEQ ID NO: 2889 - DNA, 201 bp, Homo sapiens
ctggttaccttggactaggggtgttgccagggaagcctcagtgttggaatgcaatgacccagaagccacaacttatcagtccccagggggaaagactctcrcaaggctggatcaggtgcaacaccaccataaggaagagtggattcggtggcatcacgatgctcttcacaggatacttcgtcctgtgttgtagctggagtt

SEQ ID NO: 2890 - DNA, 201 bp, Homo sapiens
atcacacactgggtgccagagccctttatgttcagcccagcgtcacactcctcagagccccttcaccaatcatgctgcagctgctggcaggaagactcttmgcagctgcatggggctggagtggtttccagagctctatcctggttaccttggactaggggtgttgccagggaagcctcagtgttggaatgcaatgaccca

SEQ ID NO: 2891 - DNA, 201 bp, Homo sapiens
acttgccatactgtaagatgataggaccaaccatacctactgatcaaaaagtttatcagtccaagccagctacactcccacgtgctaaaaagatgaaaggrccaatcaaagatttaattaaagctaaagggaaagagttagagacagagaatgaagaaagaaattctaagttggtggtggacaaaccagaacagacagtga

SEQ ID NO: 2892 - DNA, 201 bp, Homo sapiens
aagatgaaaggaccaatcaaagatttaattaaagctaaagggaaagagttagagacagagaatgaagaaagaaattctaagttggtggtggacaaaccagracagacagtgaagacctttccactgccagctgttggtttggaaagagcagctactacaaaggcagataaagacatcaagaatccaatccaaccatccttc

SEQ ID NO: 2893 - DNA, 201 bp, Homo sapiens
taaaatccaagtcatggagaaacaagagaaaggacttaccctgggagtagagacgtgtgggagcaaaggaaatgcagagaaaagtatgtctgcaacagaamagcaggaacggactgtcatgagccatggctgtgagaacttcaacaccagggattcagtcacaggaaaggagtctcaaggggaaagaccacatttaagttt

SEQ ID NO: 2894 - DNA, 201 bp, Homo sapiens
gcaggaacggactgtcatgagccatggctgtgagaacttcaacaccagggattcagtcacaggaaaggagtctcaaggggaaagaccacatttaagtttgytcattccgagggagacgacttaccagtttcattctgtatcgcagtcaagtagtcaaagtcttgcctctctagctacaacatttcttcaagaaaagaaagc

SEQ ID NO: 2895 - DNA, 201 bp, Homo sapiens
cccacgtgctaaaaagatgaaaggaccaatcaaagatttaattaaagctaaagggaaagagttagagacagagaatgaagaaagaaattctaagttggtgrtggacaaaccagaacagacagtgaagacctttccactgccagctgttggtttggaaagagcagctactacaaaggcagataaagacatcaagaatccaat

SEQ ID NO: 2896 - DNA, 201 bp, Homo sapiens
acaccagggattcagtcacaggaaaggagtctcaaggggaaagaccacatttaagtttgttcattccgagggagacgacttaccagtttcattctgtatcrcagtcaagtagtcaaagtcttgcctctctagctacaacatttcttcaagaaaagaaagcagaagcccagaatcataattgtgtccctgatgtaaaggcat

SEQ ID NO: 2897 - DNA, 201 bp, Homo sapiens
ttggagtgccccgctaggtaagaagcaatgcttagatcttgcttccaggcagcagcttgaattcccgaatcttcctgcaaggtgcatacaaatgcagcgtkagaatccatacacgtaatccatattcaccttcccatccatcccgcagaagaggcatggtgacacccaggctactgtccatgcttgagaggacgtatttga

SEQ ID NO: 2898 - DNA, 201 bp, Homo sapiens
tataagttttgtctcttaaaatcatgctgcagaaggagggggtaaaagtcgtgttctgccctgtctgtggcattggagtgccccgctaggtaagaagcaaygcttagatcttgcttccaggcagcagcttgaattcccgaatcttcctgcaaggtgcatacaaatgcagcgtgagaatccatacacgtaatccatattcac

SEQ ID NO: 2899 - DNA, 201 bp, Homo sapiens
tctacctaatgatgtacaaactacctctggtgatctcaaattggacaaaattgatccccaaagacaggaacttctagtaaaattactagatgtgcctactrgtgattgtcatatttctccaaagaatgtcagtgatggggttaaaagggtaagaacattattaagcaatgagagagattccaaaggcagggatcacctctc

SEQ ID NO: 2900 - DNA, 201 bp, Homo sapiens
ctgccacctgggttgggaaaataattgaagatgttttctcaagtccttcaagaatctcttcttaatgttcagaatagtttaagagcgttgttgaggtaaastgatagctgattattttctgagatttagatctaaacaaactcagcatgacgaggaagcacacttcacagctccagggtgcaatactgatgtaaagttgcc

SEQ ID NO: 2901 - DNA, 201 bp, Homo sapiens
gacttaccagtttcattctgtatcgcagtcaagtagtcaaagtcttgcctctctagctacaacatttcttcaagaaaagaaagcagaagcccagaatcatmattgtgtccctgatgtaaaggcattaatggagagtcccgagggacagttatctctggagcccaaatctgatagtcagttccaagcatcacacactgggtg

SEQ ID NO: 2902 - DNA, 201 bp, Homo sapiens
ttaccagtttcattctgtatcgcagtcaagtagtcaaagtcttgcctctctagctacaacatttcttcaagaaaagaaagcagaagcccagaatcataatygtgtccctgatgtaaaggcattaatggagagtcccgagggacagttatctctggagcccaaatctgatagtcagttccaagcatcacacactgggtgcca

SEQ ID NO: 2903 - DNA, 201 bp, Homo sapiens
cagataaagacatcaagaatccaatccaaccatccttcaaaatgttaaaaaatactaaaccaatgactactttccaagaagaaaccaaggctcagttttaygcatcagagaaaacctctcctaaaagagaacttgccaaagatttgcctaaatcaggagaaagtcgatgtaatccttcagaagctggagcgtctttactgg

SEQ ID NO: 2904 - DNA, 201 bp, Homo sapiens
gtaagaagccatttaaacgattaaaatcccacttgccatactgtaagatgataggaccaaccatacctactgatcaaaaagtttatcagtccaagccagcyacactcccacgtgctaaaaagatgaaaggaccaatcaaagatttaattaaagctaaagggaaagagttagagacagagaatgaagaaagaaattctaagt

SEQ ID NO: 2905 - DNA, 201 bp, Homo sapiens
gagcacagtacctccatgcattggtgtggcgaagacgactggggattgccgctctaaaacatgtttggattaggaagcacgtttaagtaggagaagccttygtgacttctctctagtgccttcgtgccctgtgttgcccactgaattgccctgtaacacctaagtgtagtggtagcattaagggatagcttttcagccctc

SEQ ID NO: 2906 - DNA, 201 bp, Homo sapiens
caacctccaacttctctctaatgaggctcttgggagctgtacaaaaaggctggatcaggtgcaacaccaccataaggaagagtggattcggtggcatcackatgctcttcacaggatacttcgtcctgtgttgtagctggagtttcagacgtctgaagctgcagcggtggcgtaagtagtgttgacctggacatcacttaa

SEQ ID NO: 2907 - DNA, 201 bp, Homo sapiens; identical to SEQ ID NO: 2887

SEQ ID NO: 2908 - DNA, 201 bp, Homo sapiens; identical to SEQ ID NO: 2888

SEQ ID NO: 2909 - DNA, 201 bp, Homo sapiens
ctggttaccttggactaggggtgttgccagggaagcctcagtgttggaatgcaatgacccagaagccacaacttatcagtccccagggggaaagactctcrcaagtttctttgttggaacgaagctcaactcatataaggagtttggaaccccctgccggacttacaacctccaacttctctctaatgaggctcttgggag

SEQ ID NO: 2910 - DNA, 201 bp, Homo sapiens; identical to SEQ ID NO: 2890

SEQ ID NO: 2911 - DNA, 201 bp, Homo sapiens; identical to SEQ ID NO: 2891

SEQ ID NO: 2912 - DNA, 201 bp, Homo sapiens; identical to SEQ ID NO: 2892

SEQ ID NO: 2913 - DNA, 201 bp, Homo sapiens; identical to SEQ ID NO: 2893

SEQ ID NO: 2914 - DNA, 201 bp, Homo sapiens
gacccagaagccacaacttatcagtccccagggggaaagactctcacaagtttctttgttggaacgaagctcaactcatataaggagtttggaaccccctrccggacttacaacctccaacttctctctaatgaggctcttgggagctgtacaaaaaggctggatcaggtgcaacaccaccataaggaagagtggattcgg

SEQ ID NO: 2915 - DNA, 201 bp, Homo sapiens; identical to SEQ ID NO: 2894

SEQ ID NO: 2916 - DNA, 201 bp, Homo sapiens; identical to SEQ ID NO: 2895

SEQ ID NO: 2917 - DNA, 201 bp, Homo sapiens; identical to SEQ ID NO: 2896

SEQ ID NO: 2918 - DNA, 201 bp, Homo sapiens; identical to SEQ ID NO: 2899

SEQ ID NO: 2919 - DNA, 201 bp, Homo sapiens; identical to SEQ ID NO: 2902

SEQ ID NO: 2920 - DNA, 201 bp, Homo sapiens; identical to SEQ ID NO: 2901

SEQ ID NO: 2921 - DNA, 201 bp, Homo sapiens; identical to SEQ ID NO: 2903

SEQ ID NO: 2922 - DNA, 201 bp, Homo sapiens; identical to SEQ ID NO: 2904

SEQ ID NO: 2923 - DNA, 201 bp, Homo sapiens
caacctccaacttctctctaatgaggctcttgggagctgtacaaaaaggctggatcaggtgcaacaccaccataaggaagagtggattcggtggcatcackatgctcttcacaggatacttcgtcctgtgttgtagctggagtttcagacgtctgaaaaaattgtgccgacccctgccctggaagagcacagtacctccat

SEQ ID NO: 2924 - DNA, 201 bp, Homo sapiens; identical to SEQ ID NO: 2887

SEQ ID NO: 2925 - DNA, 201 bp, Homo sapiens; identical to SEQ ID NO: 2888

SEQ ID NO: 2926 - DNA, 201 bp, Homo sapiens; identical to SEQ ID NO: 2909

SEQ ID NO: 2927 - DNA, 201 bp, Homo sapiens; identical to SEQ ID NO: 2890

SEQ ID NO: 2928 - DNA, 201 bp, Homo sapiens; identical to SEQ ID NO: 2891

SEQ ID NO: 2929 - DNA, 201 bp, Homo sapiens; identical to SEQ ID NO: 2892

SEQ ID NO: 2930 - DNA, 201 bp, Homo sapiens; identical to SEQ ID NO: 2893

SEQ ID NO: 2931 - DNA, 201 bp, Homo sapiens; identical to SEQ ID NO: 2914

SEQ ID NO: 2932 - DNA, 201 bp, Homo sapiens; identical to SEQ ID NO: 2894

SEQ ID NO: 2933 - DNA, 201 bp, Homo sapiens; identical to SEQ ID NO: 2895

SEQ ID NO: 2934 - DNA, 201 bp, Homo sapiens; identical to SEQ ID NO: 2896

SEQ ID NO: 2935 - DNA, 201 bp, Homo sapiens; identical to SEQ ID NO: 2897

SEQ ID NO: 2936 - DNA, 201 bp, Homo sapiens; identical to SEQ ID NO: 2898

SEQ ID NO: 2937 - DNA, 201 bp, Homo sapiens; identical to SEQ ID NO: 2899

SEQ ID NO: 2938 - DNA, 201 bp, Homo sapiens; identical to SEQ ID NO: 2900

SEQ ID NO: 2939 - DNA, 201 bp, Homo sapiens; identical to SEQ ID NO: 2901

SEQ ID NO: 2940 - DNA, 201 bp, Homo sapiens; identical to SEQ ID NO: 2902

SEQ ID NO: 2941 - DNA, 201 bp, Homo sapiens; identical to SEQ ID NO: 2903

SEQ ID NO: 2942 - DNA, 201 bp, Homo sapiens; identical to SEQ ID NO: 2904

SEQ ID NO: 2943 - DNA, 201 bp, Homo sapiens; identical to SEQ ID NO: 2905

SEQ ID NO: 2944 - DNA, 120 bp, Homo sapiens
  misc_feature (1)...(120): n = A,T,C or G, or insertion/deletion polymorphism (see Tables 1-2)
gacctcaccctgtcgcgggttcaatttcagaagcttcagcaactgcgccttacacagtaccatggaggatccttaccaaatgtgagccagctgcggagcantgcgtcagagtttcaggta

SEQ ID NO: 2945 - DNA, 201 bp, Homo sapiens
ctgggacaaacagaactcattcttcttttgatgtgttttattttagcactgtctcgatcaagtattggtagtataaaatgtttacaaacaactgaagaacytccttccagaactgcaggagccatgatgcaattcacagcccctattcccggagctacaggacctatcaagctctctcaaaaaaccattgtgcaaactcca

SEQ ID NO: 2946 - DNA, 201 bp, Homo sapiens
agggcctccctgacacccaagttcatattgctcagaaacagtgaacttgagtttttcgttttaccttgatctctctctgacaaagaaatccagatgatgcragacctgatgaagacaatacatggaaaatgacagtcttggaaataactttggctgtcatcctgactctactgggacttgccatcctggctattttgttaa

SEQ ID NO: 2947 - DNA, 145 bp, Homo sapiens
gccacactcccatcatttgcttaggtctgatcaatctgctccacrcaatttctcagtgatcctctgcatctctgcctacaagggcctccctgacacccaagttcatattgctcagaaacagtgaacttgagtttttcgttttacc

SEQ ID NO: 2948 - DNA, 201 bp, Homo sapiens
agtcttggaaataactttggctgtcatcctgactctactgggacttgccatcctggctattttgttaacaagatgggcacgacgtaagcaaagtgaaatgyatatctccagatacagttcagaacaaagtgctagacttctggactatgaggatggtagaggatcccgacatgcatattcaacacaaagtggtaaattatt

SEQ ID NO: 2949 - DNA, 201 bp, Homo sapiens
aacgaagagtgggttggttgtactgaaaggacaggaagcccaggtagagaagagtgagatgggtgtgccaagaagacaggaatcccaagtaaagaagagtsagtctggtgtctcaaagggacaggaagcccaggtaaagaagagggagtcagttgtactgaaaggacaggaagcccaggtagagaagagtgagttgaaggt

SEQ ID NO: 2950 - DNA, 201 bp, Homo sapiens
gaagagggagtcagttgtactgaaaggacaggaagcccaggtagagaagagtgagttgaaggtaccaaaaggacaagaaggccaagtagagaagactgagrcagatgtgccaaaggaacaagaggtccaagaaaagaagagtgaggcaggtgtactgaaaggaccagaatcccaagtaaagaacactgaggtgagtgtacc

SEQ ID NO: 2951 - DNA, 201 bp, Homo sapiens
ccaggtagagaagagtgagatgggtgtgccaagaagacaggaatcccaagtaaagaagagtcagtctggtgtctcaaagggacaggaagcccaggtaaagmagagggagtcagttgtactgaaaggacaggaagcccaggtagagaagagtgagttgaaggtaccaaaaggacaagaaggccaagtagagaagactgaggc

SEQ ID NO: 2952 - DNA, 201 bp, Homo sapiens
aaccgcaagaatacctcaagttcacactatggacagttctggaaaaatcatatgctcagttatattaacaggttacatggatgaagaacttgcaaaaaaaycttgttccaaaatccagattctaaaatgtggaggcactgcaaggtctcagaatagccgagaagaaaacaaggaagcactaaagaatgacatcatatttac

SEQ ID NO: 2953 - DNA, 201 bp, Homo sapiens
attctaaaatgtggaggcactgcaaggtctcagaatagccgagaagaaaacaaggaagcactaaagaatgacatcatatttacgaattctgtagaatcctkgaaatcagcacacataaaggagccagaaagagaaggaaaaggcactgatttagagaaagacaaaataggaatggaggtcaaggtagacagtgacgctgga

SEQ ID NO: 2954 - DNA, 201 bp, Homo sapiens
tgatttagagaaagacaaaataggaatggaggtcaaggtagacagtgacgctggaataccaaaaagacaggaaacccaactaaaaatcagtgagatgagtrtaccacaaggacagggagcccaaataaagaaaagtgtgtcagatgtaccaagaggacaggagtcccaagtaaagaagagtgagtcaggtgtcccaaaagg

SEQ ID NO: 2955 - DNA, 201 bp, Homo sapiens
cttccttccagaactgcaggagccatgatgcaattcacagcccctattcccggagctacaggacctatcaagctctctcaaaaaaccattgtgcaaactcyaggacctattggtaagctgcctctggtccaccttcagcaccccgcggtccacccatggcacccataataatttcacagagaaccgcaagaatacctcaag

SEQ ID NO: 2956 - DNA, 201 bp, Homo sapiens
aaggtctcagaatagccgagaagaaaacaaggaagcactaaagaatgacatcatatttacgaattctgtagaatccttgaaatcagcacacataaaggagycagaaagagaaggaaaaggcactgatttagagaaagacaaaataggaatggaggtcaaggtagacagtgacgctggaataccaaaaagacaggaaaccca

SEQ ID NO: 2957 - DNA, 201 bp, Homo sapiens
ttttcaccatcaaccaactctctagcactgtctcgatcaagtattgctttacctcaaggatccatgagtagtataaaatgtttacaaacaactgaagaacytccttccagaactgcaggagccatgagtaaccggagctacaggacctatcaagctctctcaaaaaaccattgtgcaaactccaggacctattggtaagct

SEQ ID NO: 2958 - DNA, 201 bp, Homo sapiens; identical to SEQ ID NO: 2946

SEQ ID NO: 2959 - DNA, 145 bp, Homo sapiens; identical to SEQ ID NO: 2947

SEQ ID NO: 2960 - DNA, 201 bp, Homo sapiens
agtcttggaaataactttggctgtcatcctgactctactgggacttgccatcctggctattttgttaacaagatgggcacgacgtaagcaaagtgaaatgyatatctccagatacagttcagaacaaagtgctagacttctggactatgaggatggtagaggatcccgacatgcatattcaacacaaagtgacacttcata

SEQ ID NO: 2961 - DNA, 201 bp, Homo sapiens; identical to SEQ ID NO: 2949

SEQ ID NO: 2962 - DNA, 201 bp, Homo sapiens; identical to SEQ ID NO: 2950

SEQ ID NO: 2963 - DNA, 201 bp, Homo sapiens; identical to SEQ ID NO: 2951

SEQ ID NO: 2964 - DNA, 201 bp, Homo sapiens
acctataagaatacctcaagttcacactatggacagttctggaaaaatcatatgctcagttatattaacaggttacatggatgaagaacttgcaaaaaaaycttgttccaaaatccagattctaaaatgtggaggcactgcaaggtctcagaatagccgagaagaaaacaaggaagcactaaagaatgacatcatatttac

SEQ ID NO: 2965 - DNA, 201 bp, Homo sapiens; identical to SEQ ID NO: 2953

SEQ ID NO: 2966 - DNA, 201 bp, Homo sapiens; identical to SEQ ID NO: 2954

SEQ ID NO: 2967 - DNA, 201 bp, Homo sapiens
tacaaacaactgaagaacttccttccagaactgcaggagccatgagtaaccggagctacaggacctatcaagctctctcaaaaaaccattgtgcaaactcyaggacctattggtaagctgccttcagatcgcatcctcacacaatcactggtccaccttcagcaccccgcggtccacccatggcacccataataatttcac

SEQ ID NO: 2968 - DNA, 201 bp, Homo sapiens
tatatctccagatacagttcagaacaaagtgctagacttctggactatgaggatggtagaggatcccgacatgcatattcaacacaaagtgacacttcatrtgataaccgaggtaagtatatgtagagatttttcaccatcaaccaactctctagcactgtctcgatcaagtattgctttacctcaaggatccatgagtag

SEQ ID NO: 2969 - DNA, 201 bp, Homo sapiens; identical to SEQ ID NO: 2956

SEQ ID NO: 2970 - DNA, 201 bp, Homo sapiens
agggcctccctgacacccaagttcatattgctcagaaacagtgaacttgagtttttcgttttatcttgatctctctctgacaaagaaatccagatgatgcragacctgatgaagacaatacatggaaaatgacagtcttggaaataactttggctgtcatcctgactctactgggacttgccatcctggctattttgttaa

SEQ ID NO: 2971 - DNA, 201 bp, Homo sapiens; identical to SEQ ID NO: 2954

SEQ ID NO: 2972 - DNA, 201 bp, Homo sapiens
  misc_feature (1)...(201): n = A,T,C or G, or insertion/deletion polymorphism (see Tables 1-2)
cacaatttctcagtgatcctctgcatctctgcctacaagggcctccctgacacccaagttcatattgctcagaaacagtgaacttgagtttttcgttttancttgatctctctctgacaaagaaatccagatgatgcgagacctgatgaagacaatacatggaaaatgacagtcttggaaataactttggctgtcatcctg

SEQ ID NO: 2973 - DNA, 201 bp, Homo sapiens
agtcttggaaataactttggctgtcatcctgactctactgggacttgccatcctggctattttgttaacaagatgggcacgacgtaagcaaagtgaaatgyatatctccagatacagttcagaacaaagtgctagacttctggactatgaggatggtagaggatcccgacatgcatattcaacacaaagtgacacttcatg

SEQ ID NO: 2974 - DNA, 201 bp, Homo sapiens; identical to SEQ ID NO: 2945

SEQ ID NO: 2975 - DNA, 201 bp, Homo sapiens; identical to SEQ ID NO: 2950

SEQ ID NO: 2976 - DNA, 201 bp, Homo sapiens; identical to SEQ ID NO: 2949

SEQ ID NO: 2977 - DNA, 201 bp, Homo sapiens; identical to SEQ ID NO: 2953

SEQ ID NO: 2978 - DNA, 201 bp, Homo sapiens; identical to SEQ ID NO: 2956

SEQ ID NO: 2979 - DNA, 201 bp, Homo sapiens
tataaaatccctttcatcttcatatcacagtttctgctcttcagaagtttcaccctttttaatctctcagccacaaacctcagtttccaaatatttgtttyataagttaagacgtatatgattccgtcaagaaagactggatactttctgaagtaaaacattttaattaaaaaaaaaaaaaaaaaaaaaaaaaaaaaaaaa

SEQ ID NO: 2980 - DNA, 201 bp, Homo sapiens; identical to SEQ ID NO: 2951

SEQ ID NO: 2981 - DNA, 201 bp, Homo sapiens
acctgacactgcccaaaaaggtgcctatgctcacgtggccctccctcctggttgaggctgatgaacagctttgcataccaccgctgaactcccaaacctgyctcctgggctcagaggagaatttagcccctttggcaggagagaaagcagtgcctcccgggaatgacccagtctctccagccatggtccggagcagaaacc

SEQ ID NO: 2982 - DNA, 201 bp, Homo sapiens
tggcagcagatgctgcaaccttggtggatggtaaagagcccgagtcgatggtgaacctggcgtttgtcaagaatgactcgtatgagaagggcccggattcmgtggtggtgcacgtgtacgtgaaggagatctgcagggacacctcaagagtacttttccgtgagcaggacttcacgctcatcttccagaccagggatggaa

SEQ ID NO: 2983 - DNA, 201 bp, Homo sapiens
agttcctggtgagcgtcagcaaggagaactccactgcgagcgaagtattggactccctctctcagagtgttcatgtgaagcctgagaacctgcgtttggcrgaggtaattaagaatcgttttcatcgtgtgttcctaccctcccactcactggacactgtgtccccatctgatacgctcctctgctttgagctgctatcct

SEQ ID NO: 2984 - DNA, 201 bp, Homo sapiens
gctggccagtgggcccattgaggttggctccttgccagctggcgagagggtgtcccgacccgaagctgctgtgcctgggtaccagcatccaagtgaagctwtgaatgcccacacaccccagttcttcatctataaaattgattcatccaaccgagagcagcggctagaggacaaaggagacaccccactggagctgggtga

SEQ ID NO: 2985 - DNA, 201 bp, Homo sapiens
ggtaattaagaatcgttttcatcgtgtgttcctaccctcccactcactggacactgtgtccccatctgatacgctcctctgctttgagctgctatcctcaragttggctaaggagcgggtagtggtgctagaggtgcaacaggtgcccagcgtccccatctccaagtgtgcagcctgccagcggaagcaacagtcggagga

SEQ ID NO: 2986 - DNA, 201 bp, Homo sapiens
gaaccggaacggagagcgggttgccagggcccgaagagggctggctgcggcggtctcgctcggctgtccgttccttgctggagaatttggccacaaagagytgccaagatagctgggccaggaagaaagcgccgcagccctgacccagacgctgttgccgaccccggggcactctggctgtcgaccaagcggctcaagatg

SEQ ID NO: 2987 - DNA, 201 bp, Homo sapiens
cattcagccacctgagctccagctggtgacccctatggctgagggggacacagggcttccccgggtgtgggcagcccctgaccggggtcctgtgcccagcrccagtggaatttcttctgagatgctggccagtgggcccattgaggttggctccttgccagctggcgagagggtgtcccgacccgaagctgctgtgcctgg

SEQ ID NO: 2988 - DNA, 201 bp, Homo sapiens
tgaagcgctgtacccggtgctaccgtgtgggctactgcaaccagctctgccagaaaacccactggcctgaccacaagggcctctgccgacctgagaacatyggctaccccttcctggtcagtgtacctgcctcacgcctcacttatgcccgcctcgctcagttgctagagggctatgcccggtactctgtgagtgtattcc

SEQ ID NO: 2989 - DNA, 201 bp, Homo sapiens
tggcggggccagtgccacaggcccaaggagagggcccccaggactggaggacaccactagtaagaagaagcagaaggatcgagcaaaccaggagagcaagsatggagatcctaggaaagagacagggtctcgatatgttgcccaggctggtcttgaacctctggcctcaggtgatccttctgcctcagcctcccatgcagc

SEQ ID NO: 2990 - DNA, 201 bp, Homo sapiens; identical to SEQ ID NO: 2981

SEQ ID NO: 2991 - DNA, 201 bp, Homo sapiens
tggcagtggcagcagatgctgcaaccttggtggatgagcccgagtcgatggtgaacctggcgtttgtcaagaatgactcgtatgagaagggcccggattcmgtggtggtgcacgtgtacgtgaaggagatctgcagggacacctcaagagtacttttccgtgagcaggacttcacgctcatcttccagaccagggatggaa

SEQ ID NO: 2992 - DNA, 201 bp, Homo sapiens; identical to SEQ ID NO: 2983

SEQ ID NO: 2993 - DNA, 201 bp, Homo sapiens; identical to SEQ ID NO: 2984

SEQ ID NO: 2994 - DNA, 201 bp, Homo sapiens
ggtaattaagaatcgttttcatcgtgtgttcctaccctcccactcactggacactgtgtccccatctgatacgctcctctgctttgagctgctatcctcaragttggctaaggagcgggtagtggtgctagaggtgcaacagcgcccccaggtgcccagcgtccccatctccaagtgtgcagcctgccagcggaagcaaca

SEQ ID NO: 2995 - DNA, 201 bp, Homo sapiens; identical to SEQ ID NO: 2986

SEQ ID NO: 2996 - DNA, 201 bp, Homo sapiens; identical to SEQ ID NO: 2987

SEQ ID NO: 2997 - DNA, 201 bp, Homo sapiens; identical to SEQ ID NO: 2988

SEQ ID NO: 2998 - DNA, 201 bp, Homo sapiens; identical to SEQ ID NO: 2989

SEQ ID NO: 2999 - DNA, 201 bp, Homo sapiens
gaggaccaagaccaaccatggccaagttaatggaaaagggcattgaagtgatgttttctccccacccttgccctacttggactcttgattggaatgttctscctgcagcagtcagcccaaaggaaggtaaaatgtccagtgatcgagctttgaggaagcagcaacagttgaacaaccttgtctatgtggtaacaaatcagg

SEQ ID NO: 3000 - DNA, 201 bp, Homo sapiens
ctgaccagcccccaactatacctgtagaaatactacagctagagaaaaagcttagtgagcctgttagagtgcataatgatgataaactccgcaggcagaarctcaagcaacagaaggctgatggagttgggcctccccttactaagggaaaggcaaagagcaaggtccacacacaggaaacatctgaagggttggattctt

SEQ ID NO: 3001 - DNA, 201 bp, Homo sapiens
agcaggacttgctgttgtattgagacacataatccagaaatcctatgaagcagaccccttaaagaaggaacttttggaacttctgggctttaaaaagactwgcttgaaagcctgtgctgaagttagtcagtggaccaggctatgtgaactcaccatccctttggctattgagaattttctcagagaatcttctgaccagcc

SEQ ID NO: 3002 - DNA, 201 bp, Homo sapiens
ttttcagggccatgttggaattgtccttgctcacatgctgccatcatgtcaggtaaagccagaataagagataaaaggaaatattttaaaattatacagtkcagctagccaaatttggtttatcccgctcttggagtttctagtcactcacccaagtcaaatatgtggcacaggcattgtcttttctttgaaataaacttt

SEQ ID NO: 3003 - DNA, 201 bp, Homo sapiens; identical to SEQ ID NO: 2999

SEQ ID NO: 3004 - DNA, 201 bp, Homo sapiens
aggttacattaatagaaaacaaggaattatcattaattcgtgctaagaagagaagtgatgaactgggtttaagcaacatttggttcattcaagcaaatatrgaatattttactgggatgtttaatattggagtagcattgcatgcttgtggagtggcaacagacatggtgattgagcactgtatcaaaacacgggcttcct

SEQ ID NO: 3005 - DNA, 201 bp, Homo sapiens; identical to SEQ ID NO: 3000

SEQ ID NO: 3006 - DNA, 201 bp, Homo sapiens
tgcagaccagacagctgtccagctcccaccccaacgaaggctcataggaaaacagtgcatgtgcttggtggatctggatcgagcaagagctgcagaagaaygtggatactccgttcaagtgatatccatggagccagagagctgctctcccaaaaataacatgattgtgggagtccccatttaaaatgagatattcacatt

SEQ ID NO: 3007 - DNA, 201 bp, Homo sapiens; identical to SEQ ID NO: 3001

SEQ ID NO: 3008 - DNA, 201 bp, Homo sapiens
ccttcgtcacatgcccttgctgttatggtttcattcagaacacctcaaagttcaattttccaaaaagatcacaaggtcaggagttcgaaaccagcctggcyaacatggaacacatgattctgtgcagatttgcagaccagacagctgtccagctcccaccccaacgaaggctcataggaaaacagtgcatgtgcttggtgg

SEQ ID NO: 3009 - DNA, 201 bp, Homo sapiens
tggccacagcagagtgcctcctactggctgccatggcctatgaccgtgtggttgctatcagcaatcccctgcgttattcagtggttatgaatggcccagtrtgtgtctgcttggttgctacctcatgggggacatcacttgtgctcactgccatgctcatcctatccctgaggcttcacttctgtggggctaatgtcatca

SEQ ID NO: 3010 - DNA, 201 bp, Homo sapiens
ggacatcacttgtgctcactgccatgctcatcctatccctgaggcttcacttctgtggggctaatgtcatcaaccattttgcctgtgagattctctccctsattaagctgacctgttctgataccagcctcaatgaatttatgatcctcatcaccagtatcttcaccctgctgctaccatttgggtttgttctcctctcct

SEQ ID NO: 3011 - DNA, 201 bp, Homo sapiens
aggctcaaggcctttaccacatgtggctctcacctgaccgtggtgacaatcttctatgggtcagccatctccatgtatatgaaaactcagtccaagtcctmccctgaccaggacaagtttatctcagtgttttatggagctttgacacccatgttgaaccccctgatatatagcctgagaaaaaaagatgttaaacgggca

SEQ ID NO: 3012 - DNA, 201 bp, Homo sapiens
ttcttattcactttgaccccaacctccacactccaatctacttcttccttagtaacctgtctttcttagacctttgttatggaacagcttccatgccccargctttggtgcattgtttctctacccatccctacctctcttatccccgatgtttggctcaaacgagtgtctccttggctttggccacagcagagtgcctcc

SEQ ID NO: 3013 - DNA, 201 bp, Homo sapiens
ggcccctcaggggcaaggacggcagggattggaacgagggctctggaaggactgttcagccctatgcctaagacccctatgctggggacactacaggcacrcagaggaatagcagggccaccctcagagctcacacatccacgaacaaatgaaggctgaggaggtttctaaacctaaagtccatgagtgtgcacttcaatc

SEQ ID NO: 3014 - DNA, 201 bp, Homo sapiens
tcaagatgatcaggaacaccaggacgagggccgtctcacctcactcggaccacatggagacctcccttcaaaatgggagccatgtcctgccccaccaagcsctgtctgaagtggagcttccccgcctgtgctccctccacagtcccggaaagcccagcggcaaaggcagctttgtcccagctctgccaccctcctgctcac

SEQ ID NO: 3015 - DNA, 201 bp, Homo sapiens
ccctcaggggcaaggacggcagggattggaacgagggctctggaaggactgttcagccctatgcctaagacccctatgctggggacactacaggcacacasaggaatagcagggccaccctcagagctcacacatccacgaacaaatgaaggctgaggaggtttctaaacctaaagtccatgagtgtgcacttcaatccag

SEQ ID NO: 3016 - DNA, 201 bp, Homo sapiens
tgaccagccgaggagtttgtgtctgcatcagtactgcttttgaggggaacctattggattcctattttgtggaccttgtcatacagaaaccactccggatwcatcaccattcagtcccagtcttcattcccctggaagagatagctgcaaaatatttacagaccaacatccagcacttcctgttcagtctctgcgagtacc

SEQ ID NO: 3017 - DNA, 201 bp, Homo sapiens
ttggttttgaagacgtggatggcgggaattctcgcttctggcctgggtgttttagctcacttggaaaggctagagacccaagtgagcagatcccgtaaacrgtctgaagagctgcagagcgtgcaggcccaggaaggtgctcttggaaccaagattcataaactaaggcgtctgcgagatgagctgagggctgtggtgcgg

SEQ ID NO: 3018 - DNA, 201 bp, Homo sapiens
acttcatgggaggagcaacgagcatctcatgaaactctgttctgtacgaagcccttgcatcaagtgtttgcctcatttacaagaaaaggagaaaagttggwtatgagtctggtctcctaatagattgttttcactgcactgggagcacatcagagaaataaatcccccctcccctgccaggtgaaaggaaatattgcactt

SEQ ID NO: 3019 - DNA, 201 bp, Homo sapiens
aggcgtctgcgagatgagctgagggctgtggtgcggcaccggcgagccagcgtgaaagcatgtattgccaatgtagaacccaaccaaacagtggagatcartgagcaagaagcattggaagagaaattggaaaatgtgaaagccattctgcaggcatatcattttacaggcctcagtggtaaactgaccagccgaggagtt

SEQ ID NO: 3020 - DNA, 201 bp, Homo sapiens; identical to SEQ ID NO: 3013

SEQ ID NO: 3021 - DNA, 201 bp, Homo sapiens; identical to SEQ ID NO: 3014

SEQ ID NO: 3022 - DNA, 201 bp, Homo sapiens; identical to SEQ ID NO: 3015

SEQ ID NO: 3023 - DNA, 201 bp, Homo sapiens; identical to SEQ ID NO: 3016

SEQ ID NO: 3024 - DNA, 201 bp, Homo sapiens
atggagcaggcgaaccctttacgtccagatggcgagtccaaaggaggtgttttagctcacttggaaaggctagagacccaagtgagcagatcccgtaaacrgtctgaagagctgcagagcgtgcaggcccaggaaggtgctcttggaaccaagattcataaactaaggcgtctgcgagatgagctgagggctgtggtgcgg

SEQ ID NO: 3025 - DNA, 201 bp, Homo sapiens; identical to SEQ ID NO: 3018

SEQ ID NO: 3026 - DNA, 201 bp, Homo sapiens; identical to SEQ ID NO: 3019

SEQ ID NO: 3027 - DNA, 201 bp, Homo sapiens; identical to SEQ ID NO: 3013

SEQ ID NO: 3028 - DNA, 201 bp, Homo sapiens; identical to SEQ ID NO: 3014

SEQ ID NO: 3029 - DNA, 201 bp, Homo sapiens; identical to SEQ ID NO: 3015

SEQ ID NO: 3030 - DNA, 201 bp, Homo sapiens; identical to SEQ ID NO: 3016

SEQ ID NO: 3031 - DNA, 201 bp, Homo sapiens; identical to SEQ ID NO: 3024

SEQ ID NO: 3032 - DNA, 201 bp, Homo sapiens; identical to SEQ ID NO: 3018

SEQ ID NO: 3033 - DNA, 201 bp, Homo sapiens; identical to SEQ ID NO: 3019

SEQ ID NO: 3034 - DNA, 201 bp, Homo sapiens
gggagcaataggctataccatatagcctgtttgtgtagtaggctttatcttctagggttgtgtaagtactctctattttgttagcacaaatgacaaagtcrcctaacaatgcatttcgcaggatgtatccctgtcgttaagtgatgcagactgtttgtggaaatcaaacatcatacttctgaacatccaataggtcaaaga

SEQ ID NO: 3035 - DNA, 201 bp, Homo sapiens
gtgccatgaaagataccagcagctttcaccactgaggtagccaacagccaatgccaccttgtgtccttgggtgagggagatattgctgcactccctgactmccaagaaagagctgctcttgtaccaccctgggacaaggcaaccactcttgccaaccttgggcttaccctaaccgcaagtggtggttgctctagaccctgg

SEQ ID NO: 3036 - DNA, 201 bp, Homo sapiens
ccccatctccagcctcagacaccagagccaatccacagcaggcgcctccacaccccttgctgtaactctgcttctgcccaggctctagacactaaattcayggctgcccaacaagctcccatgcctcatacaccattaccaaagaggcagtgggaggccctgcaccatgaaaacaagggcctctgctgtctcagacccagg

SEQ ID NO: 3037 - DNA, 201 bp, Homo sapiens
caggctctagacactaaattcacggctgcccaacaagctcccatgcctcatacaccattaccaaagaggcagtgggaggccctgcaccatgaaaacaaggrcctctgctgtctcagacccaggaggcctgaaactccgtgacagcctggttctagacatgggcttcctggccactccctgggcaccatgcatcaggcagtg

SEQ ID NO: 3038 - DNA, 201 bp, Homo sapiens
ctgcaagaaagccggacatttcctcaactaagaaactgcagcaacacggtgggacaaaaaatggataataacctcctagaaaggatcactgtggagatcarcataactgagacttctggagacagctgcaaacaaggaagggcaagagctatttattggccatgcagtggttgccagcacatccccaaagactggctctgt

SEQ ID NO: 3039 - DNA, 201 bp, Homo sapiens
cacatcatcccacccagtgcacaaatagtcttaacacatttaagaaagttgaaatcatctagtatcttttccaaccacaatggtatgaaactagaaatcarcaggaggaaaactagaaagttcacaaatatagtcatgtgtagtataataacatttccgtcagggactaactgcatatactactgtggtcccattagatag

SEQ ID NO: 3040 - DNA, 201 bp, Homo sapiens
aggagataactccagttggtctaacttagccaattcttccaaataggccttaagctgcaagaaagccggacatttcctcaactaagaaactgcagcaacayggtgggacaaaaaatggataataacctcctagaaaggatcactgtggagatcagcataactgagacttctggagacagctgcaaacaaggaagggcaaga

SEQ ID NO: 3041 - DNA, 201 bp, Homo sapiens
gatattgctgcactccctgactcccaagaaagagctgctcttgtaccaccctgggacaaggcaaccactcttgccaaccttgggcttaccctaaccgcaartggtggttgctctagaccctggctcctatgcagcctccccatctccagcctcagacaccagagccaatccacagcaggcgcctccacaccccttgctgta

SEQ ID NO: 3042 - DNA, 201 bp, Homo sapiens
ctagtatcttttccaaccacaatggtatgaaactagaaatcaacaggaggaaaactagaaagttcacaaatatagtcatgtgtagtataataacatttccrtcagggactaactgcatatactactgtggtcccattagatagtaatctagctcaaaaagtcctgtttcctagtggcatggcagcagcctaatgactcagc

SEQ ID NO: 3043 - DNA, 201 bp, Homo sapiens
caccaagaccaccgttcccgcaggcctggggtgagtgacctgactgagactagcgggcagagccaagcagggctaaactccaacccagggcccggtgttgracaaagtagctttttctttgctcgtttgtctgtgtattaagaagagactaaaatagccaaacgacgctggtcgcatgcgctggctgtggtctgtctgctg

SEQ ID NO: 3044 - DNA, 201 bp, Homo sapiens
tctgggcggccgagcgtccctgaccccgcagaagctgtggctgggaaccgcaaagccaggaagtctgacccaggccctgaactcacccctcacctgggagmatgcgtggaccggcgtccccggcggcactcctgactgtctgacagacaccttcagagtgaagaggccacatctcaggcgctctgccagcaacggtcatgt

SEQ ID NO: 3045 - DNA, 201 bp, Homo sapiens
ccctgctctgatgggagaagagacgccgcggccagagtcctgcaggcccagtggaaggtgtacaagcacaagaaaaaaaaggctgttctggatgaggcggytgtggtgcttcaggcagctttcaggggacatctcacgcggacaaagctcttagcaagcaaagcacatggctcagagccacccagcgtgccaggcctccca

SEQ ID NO: 3046 - DNA, 201 bp, Homo sapiens
cgaagtagagagtgagtccccaagaaagggactcctgccccagcgtcaagtgccaaagcaggccccatctaccacttcagggtcgacgttggtggcaggtrttgttcacggtgtactgattgtcactgcaacacctccacatcaccttgaacttcaagaacagcagcaaagctgtatctgctatcagaggctgttaggtag

SEQ ID NO: 3047 - DNA, 201 bp, Homo sapiens
caagaccaccgttcccgcaggcctggggtgagtgacctgactgagactagcgggcagagccaagcagggctaaactccaacccagggcccggtgttggacraagtagctttttctttgctcgtttgtctgtgtattaagaagagactaaaatagccaaacgacgctggtcgcatgcgctggctgtggtctgtctgctgaat

SEQ ID NO: 3048 - DNA, 201 bp, Homo sapiens
  misc_feature (1)...(201): n = A,T,C or G, or insertion/deletion polymorphism (see Tables 1-2)
gagcgtccctgaccccgcagaagctgtggctgggaaccgcaaagccaggaagtctgacccaggccctgaactcacccctcacctgggagcatgcgtggacnggcgtccccggcggcactcctgactgtctgacagacaccttcagagtgaagaggccacatctcaggcgctctgccagcaacggtcatgtccctgggactc

SEQ ID NO: 3049 - DNA, 201 bp, Homo sapiens
tagccatgggaggggtgagctgtgagtggggctgagccatgggagcagcaagctggtggagtgggctgggcggagctgtgggggctgctggcagggcctargaaagtagacaactcccgggggagacgaagtagagagtgagtccccaagaaagggactcctgccccagcgtcaagtgccaaagcaggccccatctaccac

SEQ ID NO: 3050 - DNA, 201 bp, Homo sapiens
ccggctgctgaggcgcattgtggagctggagaagaaactaagtgtgatggagagctcaaaatcacacgccgcagagccagtcagatcacacccgccagccygccttgcatccagctctgcgctgcacagacagccacgaggggaccgcaacaaggaccacgagcgtctccgaggggctgtgagagacctgaaggaagagcg

SEQ ID NO: 3051 - DNA, 201 bp, Homo sapiens
ttctctggggagggccagcggctcgcatccccctcatctccagctgcagctcggatggtggattttcagtgccaacagacacatctgccgtgaactcgcakatgccagggagccctgtagtgacacgttctctgacagcaccttgccgcctgcccacgaccttgaccgtgaggagctgctatccgcaaccagcgccgacac

SEQ ID NO: 3052 - DNA, 201 bp, Homo sapiens
ggagacagtaccaagcggagaggcctccttgcccacggccccagggcctgggggccaggggttctggccctgcggggacttaggcaggaggggaagagaamcccatggagccatgggaggggtgagctgtgggcggggcctagtcatgggaggggtgagctgtgggcggggcgagctgtgggtggggcctagccatgggag

SEQ ID NO: 3053 - DNA, 201 bp, Homo sapiens
aaagcaacagaaatgacgtctggaagctgaaatgtgaaactgtcaagatggcttaggagaggaaggagtggacccgctggtctttggcattttgtatttaraattattctaactttatacataatgtataggccgatcttttggaagggataaggttttcattcttgtgcaactcattattctcattattggccttttaaa

SEQ ID NO: 3054 - DNA, 201 bp, Homo sapiens
cccctgccttcaccccacccgcccgggtccactccctggggcgctgtcccaagccatccctgcttgccagctcaaagcttcaggtcctaggagccagtccrcctcgaaagccctgagaaagtgagacacctgcacattcgctgggggagaccctccgttctcttgtggcagctgctcccacttgttaaaccaagctgtttc

SEQ ID NO: 3055 - DNA, 201 bp, Homo sapiens
  misc_feature (1)...(201): n = A,T,C or G, or insertion/deletion polymorphism (see Tables 1-2)
ctgccgaggacataggaaccacgactggaaagataatttatcgtgttaggagaagaacgatgatacctacttaacacctcagcatctgcgtcgtgtctctntgtgcttttgtttgtggaaggagacccaaatgcctttactttattctctggggagggccagcggctcgcatccccctcatctccagctgcagctcggatg

SEQ ID NO: 3056 - DNA, 201 bp, Homo sapiens
  misc_feature (1)...(201): n = A,T,C or G, or insertion/deletion polymorphism (see Tables 1-2)
ggggatgacgtcaactccgatgattccgacgatattgtcattgcaccgtctctgcccacgaagaactttccagtttaggtccccgtcactgtctccacgcngtgatggcagcgctgccgaggacataggaaccacgactggaaagataatttatcgtgttaggagaagaacgatgatacctacttaacacctcagcatctg

SEQ ID NO: 3057 - DNA, 201 bp, Homo sapiens
ttaaaataacacactctttctctatcccatgccctttaaacaagcagccacaggagatgtcagtctccagggcctggccccactgtgttgacagcagtcaygtctgttgagctgacactgctgaggctgaagctggccccgtgcaggtggctggtgagccacaggtgcagtacccggaggtgtgctctcccctagaggcct

SEQ ID NO: 3058 - DNA, 201 bp, Homo sapiens
cgtggaccggcgtccccggcggcactcctgactgtctgacagacaccttcagagtgaagaggccacatctcaggcgctctgccagcaacggtcatgtcccygggactcctgtctacagagaaaaagaagatatgtatgacgagattattgagttaaagaagtcattgcacgtgcagaagagcgacgtggacctgatgagaa

SEQ ID NO: 3059 - DNA, 201 bp, Homo sapiens
  misc_feature (1)...(201): n = A,T,C or G, or insertion/deletion polymorphism (see Tables 1-2)
ttctaccaggaggagatcggcttcagccacacacggggacgcctcctccccacccttcctcgcagctcttcctgacccctctccctcagggccacaggccntggcacctctacctggggatgacgtcaactccgatgattccgacgatattgtcattgcaccgtctctgcccacgaagaactttccagtttaggtccccgt

SEQ ID NO: 3060 - DNA, 201 bp, Homo sapiens
  misc_feature (1)...(201): n = A,T,C or G, or insertion/deletion polymorphism (see Tables 1-2)
aaagaaccaccaccgcagcttctaccaggaggagatcggcttcagccacacacggggacgcctcctccccacccttcctcgcagctcttcctgacccctcnccctcagggccacaggccttggcacctctacctggggatgacgtcaactccgatgattccgacgatattgtcattgcaccgtctctgcccacgaagaact

SEQ ID NO: 3061 - DNA, 201 bp, Homo sapiens
acaagcagccacaggagatgtcagtctccagggcctggccccactgtgttgacagcagtcacgtctgttgagctgacactgctgaggctgaagctggcccygtgcaggtggctggtgagccacaggtgcagtacccggaggtgtgctctcccctagaggcctgtccccaactcctcccctagaggcctattcccgctgctc

SEQ ID NO: 3062 - DNA, 201 bp, Homo sapiens
gaggaggccatcgtcatcatccagtccgctctgcgggcacacctggcccgggccaggcacagtgctaccggtaaaagaaccaccaccgcagcttctaccargaggagatcggcttcagccacacacggggacgcctcctccccacccttcctcgcagctcttcctgacccctctccctcagggccacaggccttggcacct

SEQ ID NO: 3063 - DNA, 201 bp, Homo sapiens
tggctgtggtctgtctgctgaatgtctatttttgtctcctgacgagacgtgaggaccatgcccttgatccctccgatggaccagaaacccccttccttgcaaaaaaaaggcaattgaattaggaaaagatagcccaacctagctcagatccaccaagataagcacagcaaagcttggctgcatttttgaggaataaaaacc

SEQ ID NO: 3064 - DNA, 201 bp, Homo sapiens
  misc_feature (1)...(201): n = A,T,C or G, or insertion/deletion polymorphism (see Tables 1-2)
tgtctcctgacgagacgtgaggaccatgcccttgatccctccgatggaccagaaacccccttccttgcaaaaaaaaggcaattgaattaggaaaagatagnccaacctagctcagatccaccaagataagcacagcaaagcttggctgcatttttgaggaataaaaacctgcagaaagcaccgataaccttcaagatctga

SEQ ID NO: 3065 - DNA, 201 bp, Homo sapiens
ccccgcagaagctgtggctgggaaccgcaaagccaggaagtctgacccaggccctgaactcacccctcacctgggagcatgcgtggaccggcgtccccggyggcactcctgactgtctgacagacaccttcagagtgaagaggccacatctcaggcgctctgccagcaacggtcatgtccctgggactcctgtctacagag

SEQ ID NO: 3066 - DNA, 201 bp, Homo sapiens
gacccctctccctcagggccacaggccttggcacctctacctggggatgacgtcaactccgatgattccgacgatattgtcattgcaccgtctctgcccaygaagaactttccagtttaggtccccgtcactgtctccacgccgtgatggcagcgctgccgaggacataggaaccacgactggaaagataatttatcgtgt

SEQ ID NO: 3067 - DNA, 201 bp, Homo sapiens
tggatgaggcggctgtggtgcttcaggcagctttcaggggacatctcacgcggacaaagctcttagcaagcaaagcacatggctcagagccacccagcgtkccaggcctcccagaccagagctctcctgtgccccgcgttccgagccccatcgcccaggccacgggcagccctgtgcaggaggaggccatcgtcatcatcc

SEQ ID NO: 3068 - DNA, 201 bp, Homo sapiens
cctccacccacatcgccaaagtcaccttatctctctaagccgagaaaagtggcctcctggaggtccctcaggacggcagggagcatgcctctgggcggccragcgtccctgaccccgcagaagctgtggctgggaaccgcaaagccaggaagtctgacccaggccctgaactcacccctcacctgggagcatgcgtggacc

SEQ ID NO: 3069 - DNA, 201 bp, Homo sapiens
tcctgggcaccggggagccggccttggacacgaaagcaaaaaggaaagctttccacaaacctccacccacatcgccaaagtcaccttatctctctaagccragaaaagtggcctcctggaggtccctcaggacggcagggagcatgcctctgggcggccgagcgtccctgaccccgcagaagctgtggctgggaaccgcaa

SEQ ID NO: 3070 - DNA, 201 bp, Homo sapiens
gcctgcccacgaccttgaccgtgaggagctgctatccgcaaccagcgccgacaccatgccccctcttcctggtgacaccctcaacaaccaggatttgctcsatctcagcccagcaggccaggcagacacaccccgctgtgccttaggaaggtgtgagaccggcttcccccatccccacagcaaaacacggcctgtcccaag

SEQ ID NO: 3071 - DNA, 201 bp, Homo sapiens
cgtggtggggcgtgttgcatctggtgtctgggacagtccccgtcaccccatgtgtgcggcctctgcactcccaagctccatggctgggctgggctgggctsggctgggctgggctgggccgggcgtgcggagcctgtggagccagcagctgcagaggcctaggagggagttcctgggggaagcgcacagtgtccagtgccc

SEQ ID NO: 3072 - DNA, 201 bp, Homo sapiens
gtggggcgtgttgcatctggtgtctgggacagtccccgtcaccccatgtgtgcggcctctgcactcccaagctccatggctgggctgggctgggctgggcygggctgggctgggccgggcgtgcggagcctgtggagccagcagctgcagaggcctaggagggagttcctgggggaagcgcacagtgtccagtgcccatct

SEQ ID NO: 3073 - DNA, 201 bp, Homo sapiens
atcgtctccagaccctcttggcaagttctgaaaccaccggaaagaagcccctgggggagaagaagacgggcgccaaaaggcagaagaagatgggcagtgcyctcctgagcttgtcccggagtgtccaggagctcacggaagagaaccagagcctgaaggaggacctggaccgcgtgctgagcacctccccaaccatctcca

SEQ ID NO: 3074 - DNA, 201 bp, Homo sapiens
  misc_feature (1)...(201): n = A,T,C or G, or insertion/deletion polymorphism (see Tables 1-2)
cttagcaagcaaagcacatggctcagagccacccagcgtgccaggcctcccagaccagagctctcctgtgccccgcgttccgagccccatcgcccaggccncgggcagccctgtgcaggaggaggccatcgtcatcatccagtccgctctgcgggcacacctggcccgggccaggcacagtgctaccggtaaaagaaccac

SEQ ID NO: 3075 - DNA, 201 bp, Homo sapiens
gcgtgttgcatctggtgtctgggacagtccccgtcaccccatgtgtgcggcctctgcactcccaagctccatggctgggctgggctgggctgggctgggcygggctgggccgggcgtgcggagcctgtggagccagcagctgcagaggcctaggagggagttcctgggggaagcgcacagtgtccagtgcccatctcttgc

SEQ ID NO: 3076 - DNA, 201 bp, Homo sapiens
aggggacatctcacgcggacaaagctcttagcaagcaaagcacatggctcagagccacccagcgtgccaggcctcccagaccagagctctcctgtgccccrcgttccgagccccatcgcccaggccacgggcagccctgtgcaggaggaggccatcgtcatcatccagtccgctctgcgggcacacctggcccgggccagg

SEQ ID NO: 3077 - DNA, 201 bp, Homo sapiens
tctggtgtctgggacagtccccgtcaccccatgtgtgcggcctctgcactcccaagctccatggctgggctgggctgggctgggctgggctgggctgggcygggcgtgcggagcctgtggagccagcagctgcagaggcctaggagggagttcctgggggaagcgcacagtgtccagtgcccatctcttgcttgtgtgtga

SEQ ID NO: 3078 - DNA, 201 bp, Homo sapiens
  misc_feature (1)...(201): n = A,T,C or G, or insertion/deletion polymorphism (see Tables 1-2)
acagcttctcccaaggcttccgtccacggggacaggcttaacccctgggcgccttttctgcagcatggcggccttctgagtcacctaagctgagcctgggncattctctgtggcggtcagaaggccgatggccccaacacagtggcttgtgaaagggagagaggaggctctgcatgtccacctgctctatgggaggaggac

SEQ ID NO: 3079 - DNA, 201 bp, Homo sapiens
  misc_feature (1)...(201): n = A,T,C or G, or insertion/deletion polymorphism (see Tables 1-2)
cctagaggcctgtccccaactcctcccctagaggcctattcccgctgctcacagacctcagcagaggcaccagctggagggctccagggacatccttgganatacaggaggctttcctggcacagggcacagctcttaggaggcctttgtaggacgctgtctccccagcgtgtcctgctcatccaggatggggagaaagag

SEQ ID NO: 3080 - DNA, 201 bp, Homo sapiens
tggaggccaatgttccatacataaaccgccatgtcctctggtgcagctgggctgctcttttaaaagccagcatccatcttgaagctcgctgggtaaatggyaatgcattctcaagccagtgtcttcagctgatgcccagtgtccagtgctggtcaccagtcccctttgctgggtacagcctgcctggctgttctgtggtcc

SEQ ID NO: 3081 - DNA, 201 bp, Homo sapiens
atctcacgcggacaaagctcttagcaagcaaagcacatggctcagagccacccagcgtgccaggcctcccagaccagagctctcctgtgccccgcgttccragccccatcgcccaggccacgggcagccctgtgcaggaggaggccatcgtcatcatccagtccgctctgcgggcacacctggcccgggccaggcacagtg

SEQ ID NO: 3082 - DNA, 201 bp, Homo sapiens
gagaagaccaccaagaccaccgttcccgcaggcctggggtgagtgacctgactgagactagcgggcagagccaagcagggctaaactccaacccagggccyggtgttggacaaagtagctttttctttgctcgtttgtctgtgtattaagaagagactaaaatagccaaacgacgctggtcgcatgcgctggctgtggtct

SEQ ID NO: 3083 - DNA, 201 bp, Homo sapiens; identical to SEQ ID NO: 3043

SEQ ID NO: 3084 - DNA, 201 bp, Homo sapiens; identical to SEQ ID NO: 3046

SEQ ID NO: 3085 - DNA, 201 bp, Homo sapiens; identical to SEQ ID NO: 3047

SEQ ID NO: 3086 - DNA, 200 bp, Homo sapiens
acccctctccctcagggccacaggccttggcacctctacctggggatgacgtcaactccgatgattccgacgatattgtcattgcaccgtctctgcccaygaagaactttccagtttaggtccccgtcactgtctccacgccgtgatggcagcgctgccgaggacataggaaccacgactggaaagataatttatcgtgt

SEQ ID NO: 3087 - DNA, 201 bp, Homo sapiens; identical to SEQ ID NO: 3049

SEQ ID NO: 3088 - DNA, 201 bp, Homo sapiens; identical to SEQ ID NO: 3051

SEQ ID NO: 3089 - DNA, 201 bp, Homo sapiens; identical to SEQ ID NO: 3052

SEQ ID NO: 3090 - DNA, 201 bp, Homo sapiens; identical to SEQ ID NO: 3053

SEQ ID NO: 3091 - DNA, 201 bp, Homo sapiens; identical to SEQ ID NO: 3054

SEQ ID NO: 3092 - DNA, 201 bp, Homo sapiens; identical to SEQ ID NO: 3055
  misc_feature (1)...(201): n = A,T,C or G, or insertion/deletion polymorphism (see Tables 1-2)

SEQ ID NO: 3093 - DNA, 201 bp, Homo sapiens; identical to SEQ ID NO: 3056
  misc_feature (1)...(201): n = A,T,C or G, or insertion/deletion polymorphism (see Tables 1-2)

SEQ ID NO: 3094 - DNA, 201 bp, Homo sapiens; identical to SEQ ID NO: 3057

SEQ ID NO: 3095 - DNA, 201 bp, Homo sapiens; identical to SEQ ID NO: 3071

SEQ ID NO: 3096 - DNA, 127 bp, Homo sapiens
  misc_feature (1)...(127): n = A,T,C or G, or insertion/deletion polymorphism (see Tables 1-2)
acccctctccctcagggccacaggccntggcacctctacctggggatgacgtcaactccgatgattccgacgatattgtcattgcaccgtctctgcccacgaagaactttccagtttaggtccccgt

SEQ ID NO: 3097 - DNA, 201 bp, Homo sapiens; identical to SEQ ID NO: 3070

SEQ ID NO: 3098 - DNA, 201 bp, Homo sapiens; identical to SEQ ID NO: 3072

SEQ ID NO: 3099 - DNA, 108 bp, Homo sapiens
  misc_feature (1)...(108): n = A,T,C or G, or insertion/deletion polymorphism (see Tables 1-2)
acccctcnccctcagggccacaggccttggcacctctacctggggatgacgtcaactccgatgattccgacgatattgtcattgcaccgtctctgcccacgaagaact

SEQ ID NO: 3100 - DNA, 201 bp, Homo sapiens; identical to SEQ ID NO: 3061

SEQ ID NO: 3101 - DNA, 201 bp, Homo sapiens; identical to SEQ ID NO: 3075

SEQ ID NO: 3102 - DNA, 201 bp, Homo sapiens; identical to SEQ ID NO: 3077

SEQ ID NO: 3103 - DNA, 201 bp, Homo sapiens; identical to SEQ ID NO: 3063

SEQ ID NO: 3104 - DNA, 201 bp, Homo sapiens; identical to SEQ ID NO: 3078
  misc_feature (1)...(201): n = A,T,C or G, or insertion/deletion polymorphism (see Tables 1-2)

SEQ ID NO: 3105 - DNA, 201 bp, Homo sapiens; identical to SEQ ID NO: 3064
  misc_feature (1)...(201): n = A,T,C or G, or insertion/deletion polymorphism (see Tables 1-2)

SEQ ID NO: 3106 - DNA, 201 bp, Homo sapiens; identical to SEQ ID NO: 3079
  misc_feature (1)...(201): n = A,T,C or G, or insertion/deletion polymorphism (see Tables 1-2)

SEQ ID NO: 3107 - DNA, 201 bp, Homo sapiens; identical to SEQ ID NO: 3080

SEQ ID NO: 3108 - DNA, 201 bp, Homo sapiens; identical to SEQ ID NO: 3082

SEQ ID NO: 3109 - DNA, 201 bp, Homo sapiens; identical to SEQ ID NO: 3043

SEQ ID NO: 3110 - DNA, 201 bp, Homo sapiens; identical to SEQ ID NO: 3044

SEQ ID NO: 3111 - DNA, 201 bp, Homo sapiens; identical to SEQ ID NO: 3045

SEQ ID NO: 3112 - DNA, 201 bp, Homo sapiens; identical to SEQ ID NO: 3046

SEQ ID NO: 3113 - DNA, 201 bp, Homo sapiens; identical to SEQ ID NO: 3047

SEQ ID NO: 3114 - DNA, 201 bp, Homo sapiens; identical to SEQ ID NO: 3048
  misc_feature (1)...(201): n = A,T,C or G, or insertion/deletion polymorphism (see Tables 1-2)

SEQ ID NO: 3115 - DNA, 201 bp, Homo sapiens; identical to SEQ ID NO: 3049

SEQ ID NO: 3116 - DNA, 201 bp, Homo sapiens; identical to SEQ ID NO: 3050

SEQ ID NO: 3117 - DNA, 201 bp, Homo sapiens; identical to SEQ ID NO: 3051

SEQ ID NO: 3118 - DNA, 201 bp, Homo sapiens; identical to SEQ ID NO: 3052

SEQ ID NO: 3119 - DNA, 201 bp, Homo sapiens; identical to SEQ ID NO: 3053

SEQ ID NO: 3120 - DNA, 201 bp, Homo sapiens; identical to SEQ ID NO: 3054

SEQ ID NO: 3121 - DNA, 201 bp, Homo sapiens; identical to SEQ ID NO: 3055
  misc_feature (1)...(201): n = A,T,C or G, or insertion/deletion polymorphism (see Tables 1-2)

SEQ ID NO: 3122 - DNA, 201 bp, Homo sapiens; identical to SEQ ID NO: 3056
  misc_feature (1)...(201): n = A,T,C or G, or insertion/deletion polymorphism (see Tables 1-2)

SEQ ID NO: 3123 - DNA, 201 bp, Homo sapiens; identical to SEQ ID NO: 3057

SEQ ID NO: 3124 - DNA, 201 bp, Homo sapiens; identical to SEQ ID NO: 3058

SEQ ID NO: 3125 - DNA, 201 bp, Homo sapiens; identical to SEQ ID NO: 3059
  misc_feature (1)...(201): n = A,T,C or G, or insertion/deletion polymorphism (see Tables 1-2)

SEQ ID NO: 3126 - DNA, 201 bp, Homo sapiens; identical to SEQ ID NO: 3060
  misc_feature (1)...(201): n = A,T,C or G, or insertion/deletion polymorphism (see Tables 1-2)

SEQ ID NO: 3127 - DNA, 201 bp, Homo sapiens; identical to SEQ ID NO: 3061

SEQ ID NO: 3128 - DNA, 201 bp, Homo sapiens; identical to SEQ ID NO: 3062

SEQ ID NO: 3129 - DNA, 201 bp, Homo sapiens; identical to SEQ ID NO: 3063

SEQ ID NO: 3130 - DNA, 201 bp, Homo sapiens; identical to SEQ ID NO: 3064
  misc_feature (1)...(201): n = A,T,C or G, or insertion/deletion polymorphism (see Tables 1-2)

SEQ ID NO: 3131 - DNA, 201 bp, Homo sapiens; identical to SEQ ID NO: 3065

SEQ ID NO: 3132 - DNA, 201 bp, Homo sapiens; identical to SEQ ID NO: 3066

SEQ ID NO: 3133 - DNA, 201 bp, Homo sapiens; identical to SEQ ID NO: 3067

SEQ ID NO: 3134 - DNA, 201 bp, Homo sapiens
ggagccggccttggacacgagtcaccttatctctctaagccgagaaaagtggcctcctggaggtccctcaggacggcagggagcatgcctctgggcggccragcgtccctgaccccgcagaagctgtggctgggaaccgcaaagccaggaagtctgacccaggccctgaactcacccctcacctgggagcatgcgtggacc

SEQ ID NO: 3135 - DNA, 201 bp, Homo sapiens
cgagccagcaaccctgaggggcggccgggcagcgccgccaccatgttcctgggcaccggggagccggccttggacacgagtcaccttatctctctaagccragaaaagtggcctcctggaggtccctcaggacggcagggagcatgcctctgggcggccgagcgtccctgaccccgcagaagctgtggctgggaaccgcaa

SEQ ID NO: 3136 - DNA, 201 bp, Homo sapiens; identical to SEQ ID NO: 3070

SEQ ID NO: 3137 - DNA, 201 bp, Homo sapiens; identical to SEQ ID NO: 3071

SEQ ID NO: 3138 - DNA, 201 bp, Homo sapiens; identical to SEQ ID NO: 3072

SEQ ID NO: 3139 - DNA, 201 bp, Homo sapiens; identical to SEQ ID NO: 3073

SEQ ID NO: 3140 - DNA, 201 bp, Homo sapiens; identical to SEQ ID NO: 3074
  misc_feature (1)...(201): n = A,T,C or G, or insertion/deletion polymorphism (see Tables 1-2)

SEQ ID NO: 3141 - DNA, 201 bp, Homo sapiens; identical to SEQ ID NO: 3075

SEQ ID NO: 3142 - DNA, 201 bp, Homo sapiens; identical to SEQ ID NO: 3076

SEQ ID NO: 3143 - DNA, 201 bp, Homo sapiens; identical to SEQ ID NO: 3077

SEQ ID NO: 3144 - DNA, 201 bp, Homo sapiens; identical to SEQ ID NO: 3078
  misc_feature (1)...(201): n = A,T,C or G, or insertion/deletion polymorphism (see Tables 1-2)

SEQ ID NO: 3145 - DNA, 201 bp, Homo sapiens; identical to SEQ ID NO: 3079
  misc_feature (1)...(201): n = A,T,C or G, or insertion/deletion polymorphism (see Tables 1-2)

SEQ ID NO: 3146 - DNA, 201 bp, Homo sapiens; identical to SEQ ID NO: 3080

SEQ ID NO: 3147 - DNA, 201 bp, Homo sapiens; identical to SEQ ID NO: 3081

SEQ ID NO: 3148 - DNA, 201 bp, Homo sapiens; identical to SEQ ID NO: 3082

SEQ ID NO: 3149 - DNA, 201 bp, Homo sapiens
tccactccttgaggtatttccacaccaccatgtcccggcccggccgcgcggatccccgcttcctctccgtgggcgacgtggacgacacgcagtgcgtgcgsctcgacagcgacgccacgagtcccaggatggagccgcgggcgccgtggatggagcaggaggggccggaatattgggaagaggagacagggaccgccaagg

SEQ ID NO: 3150 - DNA, 201 bp, Homo sapiens
tgggaacctgactcccagcagtcacaggtcaggggaaggtccctgctgaggacagacctcaggaggacaattggtccagcctcaacacatcctcttccctygggttttctgatcctgacctgggtctgtagtcacagttctggaaacttctctaggatctcatgccctgcctcctccctggcctctcacagtttgttttct

SEQ ID NO: 3151 - DNA, 201 bp, Homo sapiens
ggtcgctgctgtgatgtggaggaataagatcccaggtaggaaaggggtgagctctgagtttccttcttccattggtggatttcaagccccaggtaggagtwggctcatatcttgcctagttgtgaggcaccatctccacacacatttaccctgttcagaggccctgtctatcaacgcttactcttttgtaaagcacttgtg

SEQ ID NO: 3152 - DNA, 201 bp, Homo sapiens
tcagggcccctcacgttcacctcctttcttagagctgtcttcccagcccatcatccccgttgtgggcatcattgctggcctggttcttctagttgctgtawtcactgtagctgtggtcgctgctgtgatgtggaggaataagatcccaggtaggaaaggggtgagctctgagtttccttcttccattggtggatttcaagc

SEQ ID NO: 3153 - DNA, 201 bp, Homo sapiens
tggatttcaagccccaggtaggagtaggctcatatcttgcctagttgtgaggcaccatctccacacacatttaccctgttcagaggccctgtctatcaacvcttactcttttgtaaagcacttgtgaaaatgaaggacaaatttatcaccttgattgtggtcatgggaacctgactcccagcagtcacaggtcaggggaag

SEQ ID NO: 3154 - DNA, 201 bp, Homo sapiens
gcctgagcccctcacactaagatggggtaaggagacgaatgaggggtcatgtctcttctcaggcaaagcagaagtccttctggagcctttaagcagggtcrgggctgaggcctgggggtcagggcccctcacgttcacctcctttcttagagctgtcttcccagcccatcatccccgttgtgggcatcattgctggcctgg

SEQ ID NO: 3155 - DNA, 201 bp, Homo sapiens
gagtaggctcatatcttgcctagttgtgaggcaccatctccacacacatttaccctgttcagaggccctgtctatcaacgcttactcttttgtaaagcacytgtgaaaatgaaggacaaatttatcaccttgattgtggtcatgggaacctgactcccagcagtcacaggtcaggggaaggtccctgctgaggacagacct

SEQ ID NO: 3156 - DNA, 201 bp, Homo sapiens
agtggtgtcttctggagagaagcagaggtacacatgccatgtgcagcacgaggggttgcctgagcccctcacactaagatggggtaaggagacgaatgagvggtcatgtctcttctcaggcaaagcagaagtccttctggagcctttaagcagggtcagggctgaggcctgggggtcagggcccctcacgttcacctcctt

SEQ ID NO: 3157 - DNA, 201 bp, Homo sapiens
aggacaaatttatcaccttgattgtggtcatgggaacctgactcccagcagtcacaggtcaggggaaggtccctgctgaggacagacctcaggaggacaaytggtccagcctcaacacatcctcttcccttgggttttctgatcctgacctgggtctgtagtcacagttctggaaacttctctaggatctcatgccctgcc

SEQ ID NO: 3158 - DNA, 201 bp, Homo sapiens
gcccggccgcgcggatccccgcttcctctccgtgggcgacgtggacgacacgcagtgcgtgcggctcgacagcgacgccacgagtcccaggatggagccgcgggcgccgtggatggagcaggaggggccggaatattgggaagaggagacagggaccgccaaggccaaagcacagttttaccgagtgaacctgcggaccct

SEQ ID NO: 3159 - DNA, 201 bp, Homo sapiens
ttgtggagaccagacttgcagggtacagaaccttccagaagtgggcagctgcagtggtgtcttctggagagaagcagaggtacacatgccatgtgcagcaygaggggttgcctgagcccctcacactaagatggggtaaggagacgaatgaggggtcatgtctcttctcaggcaaagcagaagtccttctggagcctttaa

SEQ ID NO: 3160 - DNA, 201 bp, Homo sapiens
aggacagacctcaggaggacaattggtccagcctcaacacatcctcttcccttgggttttctgatcctgacctgggtctgtagtcacagttctggaaactyctctaggatctcatgccctgcctcctccctggcctctcacagtttgttttctttccacagatggaaaaggaggcagttatgctcaggcttcatgtaagtg

SEQ ID NO: 3161 - DNA, 201 bp, Homo sapiens
cgccaaggccaaagcacagttttaccgagtgaacctgcggaccctgagcggctactacaaccagagtgaggcctgtgagtgacaccggccgggggcgcagvtcactacccctccacatcccccacggaccgcccgggtctccccgagtctctgggtccgagatccacgccgaggcagcgggacctggagacccttgacccg

SEQ ID NO: 3162 - DNA, 201 bp, Homo sapiens
ttctcaggatggtcacatgggtgctgtgtctcatgaggaatgcaaagtgcctgaattttctacctcttgccctcagatcccctgaaggcacaggtaacccwccaccccatctccaactatgaggccacgctgaggtgctgggccctgggcttctaccctctggagatcacactgacccaggagcgggatggggaggaccaa

SEQ ID NO: 3163 - DNA, 201 bp, Homo sapiens
gcacagttttaccgagtgaacctgcggaccctgagcggctactacaaccagagtgaggcctgtgagtgacaccggccgggggcgcaggtcactacccctcyacatcccccacggaccgcccgggtctccccgagtctctgggtccgagatccacgccgaggcagcgggacctggagacccttgacccgggagaggcccagg

SEQ ID NO: 3164 - DNA, 107 bp, Homo sapiens
ggaaackttgagacagagcgcttggcacagaagtagcggggtcagggcgaagtcccagggcctcaggcatggctctcaggatctcaggccccaaaggcggtgtatgg

SEQ ID NO: 3165 - DNA, 201 bp, Homo sapiens
gacaccggccgggggcgcaggtcactacccctccacatcccccacggaccgcccgggtctccccgagtctctgggtccgagatccacgccgaggcagcggvacctggagacccttgacccgggagaggcccaggagccgttacccggtttcattttcagccaaaatccccgcaggttggtcctggcgagggcggggctcgg

SEQ ID NO: 3166 - DNA, 169 bp, Homo sapiens
ggaaacgttgagacagagcgcttggcacagaagtagcggggtcagggcgaagtcccagggcctcaggcmtggctctcaggatctcaggccccaaaggcggtgtatggattggggaggcccagcgctggggattccccatctccgcagggtttctcttctccctctccca

SEQ ID NO: 3167 - DNA, 201 bp, Homo sapiens
gaagtagcggggtcagggcgaagtcccagggcctcaggcatggctctcaggatctcaggccccaaaggcggtgtatggattggggaggcccagcgctgggsattccccatctccgcagggtttctcttctccctctcccaacctgtgtcgggtccttcttcctggatactcaccaggctgccccagttctcactcccattg

SEQ ID NO: 3168 - DNA, 201 bp, Homo sapiens
cgcaggtcactacccctccacatcccccacggaccgcccgggtctccccgagtctctgggtccgagatccacgccgaggcagcgggacctggagacccttbacccgggagaggcccaggagccgttacccggtttcattttcagccaaaatccccgcaggttggtcctggcgagggcggggctcggtgggcggggctggcc

SEQ ID NO: 3169 - DNA, 201 bp, Homo sapiens
tcgggggccctggtcctgacccagacctgggcaggtgagtgcggggtcgggagggaaacggcgtctgtggggagtagctaggggcctgcccggcgggggckcaggaacccggttgcggtgccgggaggagggtcgggagggtctcagccccctccttgctcccaggcttccactccttgaggtatttccacaccaccatgt

SEQ ID NO: 3170 - DNA, 201 bp, Homo sapiens
cagggtctcacacccatctagaggatgtctgtctgcgacgtggggtcggacgggcgcctactccgcgggtatcaccagcttgcttacgatggcaaggatthcatcgtcctgaacgaggacctgtgctccttgacagccgcagacacggcggctcagatcacccagctcaagtgggaggcggcccggggggcggagctgctc

SEQ ID NO: 3171 - DNA, 201 bp, Homo sapiens
aggacctgtgctccttgacagccgcagacacggcggctcagatcacccagctcaagtgggaggcggcccggggggcggagctgctcaaaacctacctgccsggaaggtgggcggagtggctcagcaaaggccttaagaatgagaaggagaggctgcaatgcgcaggtaccagaggccacgggtcgcctccctgatctcctg

SEQ ID NO: 3172 - DNA, 201 bp, Homo sapiens
tcaagtgggaggcggcccggggggcggagctgctcaaaacctacctgccgggaaggtgggcggagtggctcagcaaaggccttaagaatgagaaggagagkctgcaatgcgcaggtaccagaggccacgggtcgcctccctgatctcctgcagatatccctgagccaccttccaaaagaaggggaggaaaatgggaccaac

SEQ ID NO: 3173 - DNA, 201 bp, Homo sapiens
ccctgcttctgctgctctcgggggccctggtcctgacccagacctgggcaggtgagtgcggggtcgggagggaaacggcgtctgtggggagtagctagggkcctgcccggcgggggcgcaggaacccggttgcggtgccgggaggagggtcgggagggtctcagccccctccttgctcccaggcttccactccttgaggta

SEQ ID NO: 3174 - DNA, 201 bp, Homo sapiens
gctcaaaacctacctgccgggaaggtgggcggagtggctcagcaaaggccttaagaatgagaaggagaggctgcaatgcgcaggtaccagaggccacgggkcgcctccctgatctcctgcagatatccctgagccaccttccaaaagaaggggaggaaaatgggaccaacgctaaaatatccctctccctcttgtcctgag

SEQ ID NO: 3175 - DNA, 201 bp, Homo sapiens
aaaacctacctgccgggaaggtgggcggagtggctcagcaaaggccttaagaatgagaaggagaggctgcaatgcgcaggtaccagaggccacgggtcgcytccctgatctcctgcagatatccctgagccaccttccaaaagaaggggaggaaaatgggaccaacgctaaaatatccctctccctcttgtcctgaggcag

SEQ ID NO: 3176 - DNA, 201 bp, Homo sapiens
gttcacctcctttcttagagctgtcttcccagcccatcatccccgttgtgggcatcattgctggcctggttcttctagttgctgtaatcactgtagctgtrgtcgctgctgtgatgtggaggaataagatcccaggtaggaaaggggtgagctctgagtttccttcttccattggtggatttcaagccccaggtaggagta

SEQ ID NO: 3177 - DNA, 201 bp, Homo sapiens
aaagcacagttttaccgagtgaacctgcggaccctgagcggctactacaaccagagtgaggcctgtgagtgacaccggccgggggcgcaggtcactacccstccacatcccccacggaccgcccgggtctccccgagtctctgggtccgagatccacgccgaggcagcgggacctggagacccttgacccgggagaggccc

SEQ ID NO: 3178 - DNA, 201 bp, Homo sapiens
tcagacactagaactttccaaggaataagagattatcccaggtgcctgtgtccagaatgttgtctgggttctgtgctcccttccccaccccagatgtcccdtccattctcaggatggtcacatgggtgctgtgtctcatgaggaatgcaaagtgcctgaattttctacctcttgccctcagatcccctgaaggcacaggta

SEQ ID NO: 3179 - DNA, 201 bp, Homo sapiens
tcagggcgaagtcccagggcctcaggcatggctctcaggatctcaggccccaaaggcggtgtatggattggggaggcccagcgctggggattccccatctycgcagggtttctcttctccctctcccaacctgtgtcgggtccttcttcctggatactcaccaggctgccccagttctcactcccattgagtgtcgggttt

SEQ ID NO: 3180 - DNA, 201 bp, Homo sapiens
cttgccctcagatcccctgaaggcacaggtaaccctccaccccatctccaactatgaggccacgctgaggtgctgggccctgggcttctaccctctggagrtcacactgacccaggagcgggatggggaggaccaaattcaggatgcagagtttgtggagaccagacttgcagggtacagaaccttccagaagtgggcagc

SEQ ID NO: 3181 - DNA, 201 bp, Homo sapiens
cagggcgaagtcccagggcctcaggcatggctctcaggatctcaggccccaaaggcggtgtatggattggggaggcccagcgctggggattccccatctcygcagggtttctcttctccctctcccaacctgtgtcgggtccttcttcctggatactcaccaggctgccccagttctcactcccattgagtgtcgggtttc

SEQ ID NO: 3182 - DNA, 201 bp, Homo sapiens
cctgaaggcacaggtaaccctccaccccatctccaactatgaggccacgctgaggtgctgggccctgggcttctaccctctggagatcacactgacccagragcgggatggggaggaccaaattcaggatgcagagtttgtggagaccagacttgcagggtacagaaccttccagaagtgggcagctgcagtggtgtcttc

SEQ ID NO: 3183 - DNA, 201 bp, Homo sapiens
cgcttcctctccgtgggcgacgtggacgacacgcagtgcgtgcggctcgacagcgacgccacgagtcccaggatggagccgcgggcgccgtggatggagcmggaggggccggaatattgggaagaggagacagggaccgccaaggccaaagcacagttttaccgagtgaacctgcggaccctgagcggctactacaaccag

SEQ ID NO: 3184 - DNA, 201 bp, Homo sapiens
aggcggtgtatggattggggaggcccagcgctggggattccccatctccgcagggtttctcttctccctctcccaacctgtgtcgggtccttcttcctggmtactcaccaggctgccccagttctcactcccattgagtgtcgggtttctagagaagccaatcaatgtagccgcggtcccggttctaaagttcccacgcac

SEQ ID NO: 3185 - DNA, 201 bp, Homo sapiens
gagtgaacctgcggaccctgagcggctactacaaccagagtgaggcctgtgagtgacaccggccgggggcgcaggtcactacccctccacatcccccacgraccgcccgggtctccccgagtctctgggtccgagatccacgccgaggcagcgggacctggagacccttgacccgggagaggcccaggagccgttacccgg

SEQ ID NO: 3186 - DNA, 201 bp, Homo sapiens
gccgaggcagcgggacctggagacccttgacccgggagaggcccaggagccgttacccggtttcattttcagccaaaatccccgcaggttggtcctggcgdgggcggggctcggtgggcggggctggccgcgggggcggggccagggtctcacacccatctagaggatgtctgtctgcgacgtggggtcggacgggcgcct

SEQ ID NO: 3187 - DNA, 201 bp, Homo sapiens
aaggcacaggtaaccctccaccccatctccaactatgaggccacgctgaggtgctgggccctgggcttctaccctctggagatcacactgacccaggagcsggatggggaggaccaaattcaggatgcagagtttgtggagaccagacttgcagggtacagaaccttccagaagtgggcagctgcagtggtgtcttctgga

SEQ ID NO: 3188 - DNA, 201 bp, Homo sapiens
atggattggggaggcccagcgctggggattccccatctccgcagggtttctcttctccctctcccaacctgtgtcgggtccttcttcctggatactcaccmggctgccccagttctcactcccattgagtgtcgggtttctagagaagccaatcaatgtagccgcggtcccggttctaaagttcccacgcacccaccggga

SEQ ID NO: 3189 - DNA, 201 bp, Homo sapiens
ccgcagggtttctcttctccctctcccaacctgtgtcgggtccttcttcctggatactcaccaggctgccccagttctcactcccattgagtgtcgggttyctagagaagccaatcaatgtagccgcggtcccggttctaaagttcccacgcacccaccgggactccgattcttcccagtcgccgaggatggtgtcatggc

SEQ ID NO: 3190 - DNA, 201 bp, Homo sapiens
ggcctgggggtcagggcccctcacgttcacctcctttcttagagctgtcttcccagcccatcatccccgttgtgggcatcattgctggcctggttcttcthgttgctgtaatcactgtagctgtggtcgctgctgtgatgtggaggaataagatcccaggtaggaaaggggtgagctctgagtttccttcttccattggtg

SEQ ID NO: 3191 - DNA, 201 bp, Homo sapiens
gttctcactcccattgagtgtcgggtttctagagaagccaatcaatgtagccgcggtcccggttctaaagttcccacgcacccaccgggactccgattctycccagtcgccgaggatggtgtcatggcgccccgaaccctgcttctgctgctctcgggggccctggtcctgacccagacctgggcaggtgagtgcggggtc

SEQ ID NO: 3192 - DNA, 201 bp, Homo sapiens
atggtgtcatggcgccccgaaccctgcttctgctgctctcgggggccctggtcctgacccagacctgggcaggtgagtgcggggtcgggagggaaacggcstctgtggggagtagctaggggcctgcccggcgggggcgcaggaacccggttgcggtgccgggaggagggtcgggagggtctcagccccctccttgctccc

SEQ ID NO: 3193 - DNA, 201 bp, Homo sapiens
tgcggggtcgggagggaaacggcgtctgtggggagtagctaggggcctgcccggcgggggcgcaggaacccggttgcggtgccgggaggagggtcgggagvgtctcagccccctccttgctcccaggcttccactccttgaggtatttccacaccaccatgtcccggcccggccgcgcggatccccgcttcctctccgtgg

SEQ ID NO: 3194 - DNA, 201 bp, Homo sapiens
gctcagcaaaggccttaagaatgagaaggagaggctgcaatgcgcaggtaccagaggccacgggtcgcctccctgatctcctgcagatatccctgagccaycttccaaaagaaggggaggaaaatgggaccaacgctaaaatatccctctccctcttgtcctgaggcagaagagtcctcctgggtttctaaatcctatacc

SEQ ID NO: 3195 - DNA, 201 bp, Homo sapiens
aagaatgagaaggagaggctgcaatgcgcaggtaccagaggccacgggtcgcctccctgatctcctgcagatatccctgagccaccttccaaaagaagggcaggaaaatgggaccaacgctaaaatatccctctccctcttgtcctgaggcagaagagtcctcctgggtttctaaatcctataccagagagtgactgaggg

SEQ ID NO: 3196 - DNA, 201 bp, Homo sapiens
gagagtgactgagggcccgccctgcactctgggacaattaacggatgaagtctctgcgggaaaggaggggaagacaatccctggaatactgatacgcggtmccctttgaccccccagcagccttgggcaccaggaattttcctctcaggccttgttctctgcctcatactcaatgtgtgtgggggtctgattccagctctt

SEQ ID NO: 3197 - DNA, 201 bp, Homo sapiens
aatccctggaatactgatacgcggtcccctttgaccccccagcagccttgggcaccaggaattttcctctcaggccttgttctctgcctcatactcaatgygtgtgggggtctgattccagctcttctgagtccctcggcctccactcaggtcaggaccagaaatctctgtttccgcctcagacactagaactttccaagg

SEQ ID NO: 3198 - DNA, 134 bp, Homo sapiens
ggagcccatgggggagctcagccaccccaaaattcctcctttagtcacatcacctgtgggctctgaccagattttgtttttgttccaccccaaacaggaasagtacccagggctctgatgtgtctctcacggct

SEQ ID NO: 3199 - DNA, 201 bp, Homo sapiens
ggcctccactcaggtcaggaccagaaatctctgtttccgcctcagacactagaactttccaaggaataagagattatcccaggtgcctgtgtccagaatgytgtctgggttctgtgctcccttccccaccccagatgtcccatccattctcaggatggtcacatgggtgctgtgtctcatgaggaatgcaaagtgcctgaa

SEQ ID NO: 3200 - DNA, 105 bp, Homo sapiens
aaattcctcctttagtcacatcacctgtgggctctgaccagattttgtttttgttccaccccaaacaggaacagtacccagggctctgatgtgtctctcahggct

SEQ ID NO: 3201 - DNA, 201 bp, Homo sapiens
ttccgcctcagacactagaactttccaaggaataagagattatcccaggtgcctgtgtccagaatgttgtctgggttctgtgctcccttccccaccccagdtgtcccatccattctcaggatggtcacatgggtgctgtgtctcatgaggaatgcaaagtgcctgaattttctacctcttgccctcagatcccctgaaggc

SEQ ID NO: 3202 - DNA, 201 bp, Homo sapiens
gtggatggagcaggaggggccggaatattgggaagaggagacagggaccgccaaggccaaagcacagttttaccgagtgaacctgcggaccctgagcggcyactacaaccagagtgaggcctgtgagtgacaccggccgggggcgcaggtcactacccctccacatcccccacggaccgcccgggtctccccgagtctctg

SEQ ID NO: 3203 - DNA, 201 bp, Homo sapiens
tgtctgggtctttggggttgatgtgggatctgggagaattttgaaacggatcattgctgtcaggatgaaggctgcccatgggccccgggggctgaagggaragaagagagagcctgcagtgctggaacctgtaagtcatgctggtcacagggctgaggtggtggaaagaggagaagcaacagaccatgtgtcaacatatgc

SEQ ID NO: 3204 - DNA, 201 bp, Homo sapiens
ctatctgaccctcgttcccatggccgaggacacctgtgacctccagggggagcactggggcctgcaccagcctctcctcaggcactgggaggtccatgaamtaatccaggtgcctgagaccatggagatgctggtctgtgccctcggcctgctggtgggcctggcgggggtccttaatggcaccattgtctcaaagaccaa

SEQ ID NO: 3205 - DNA, 201 bp, Homo sapiens
agggggagcactggggcctgcaccagcctctcctcaggcactgggaggtccatgaactaatccaggtgcctgagaccatggagatgctggtctgtgccctsggcctgctggtgggcctggcgggggtccttaatggcaccattgtctcaaagaccaagcgatctgacagcatccccgggtccaggggctcctatgagtcat

SEQ ID NO: 3206 - DNA, 201 bp, Homo sapiens
tttatgctgctgtctgggtctttggggttgatgtgggatctgggagaattttgaaacggatcattgctgtcaggatgaaggctgcccatgggccccggggkctgaagggagagaagagagagcctgcagtgctggaacctgtaagtcatgctggtcacagggctgaggtggtggaaagaggagaagcaacagaccatgtgt

SEQ ID NO: 3207 - DNA, 201 bp, Homo sapiens
accctgctgctgcatcccacacctcctgctcttggcacccgtgagcttctgctgcctttcctttatgctgctgtctgggtctttggggttgatgtgggatmtgggagaattttgaaacggatcattgctgtcaggatgaaggctgcccatgggccccgggggctgaagggagagaagagagagcctgcagtgctggaacct

SEQ ID NO: 3208 - DNA, 155 bp, Homo sapiens
atggccatgaagggccagtctgtcaccctcattgttgactgcaagatttgttctmatatcttccagtattctctgtcagttggactgcttcctgtctactctgctacatcttctgcctgccttgcagttatggctgccttttctaccctgctgct

SEQ ID NO: 3209 - DNA, 201 bp, Homo sapiens
cacacctcctgctcttggcacccgtgagcttctgctgcctttcctttatgctgctgtctgggtctttggggttgatgtgggatctgggagaattttgaaayggatcattgctgtcaggatgaaggctgcccatgggccccgggggctgaagggagagaagagagagcctgcagtgctggaacctgtaagtcatgctggtca

SEQ ID NO: 3210 - DNA, 201 bp, Homo sapiens
cctctggggagtatatgtttgaatttgatgaggaggagcagttctacgtgaacctggatgagaaggagatggtctggcctctaccagagtttattcacacytttgactttggtgctcagaggggtattgctggcatcgtcatggcaaggaagcacttgaacacccggatcaatggtccaaacagacttgggccacaaatgg

SEQ ID NO: 3211 - DNA, 201 bp, Homo sapiens
tgcttcctgtctactctgctacatcttctgcctgccttgcagttatggctgccttttctaccctgctgctgcatcccacacctcctgctcttggcacccgygagcttctgctgcctttcctttatgctgctgtctgggtctttggggttgatgtgggatctgggagaattttgaaacggatcattgctgtcaggatgaagg

SEQ ID NO: 3212 - DNA, 201 bp, Homo sapiens
aattttgaaacggatcattgctgtcaggatgaaggctgcccatgggccccgggggctgaagggagagaagagagagcctgcagtgctggaacctgtaagtyatgctggtcacagggctgaggtggtggaaagaggagaagcaacagaccatgtgtcaacatatgcggagtttgtgcagacgcacagaccctctggggagta

SEQ ID NO: 3213 - DNA, 201 bp, Homo sapiens
cctctggggagtatatgtttgaatttgatgaggaggagcagttctacgtgaacctggatgagaaggagatggtctggcctctaccagagtttattcacacytttgactttggtgctcagaggggtattgctggcatcgtcatggcaaggaagcacttgaacacccggatcaatggtccaaacagacttgggccacaaatgc

SEQ ID NO: 3214 - DNA, 201 bp, Homo sapiens; identical to SEQ ID NO: 3204

SEQ ID NO: 3215 - DNA, 193 bp, Homo sapiens
agggggagcactggggcctgcaccagcctctcctcaggcactgggaggtccatgaactaatccaggtgcctgagaccatggagatgctggtctgtgccctsggcctgctggtgggcctggcgggggtccttaatggcaccattgtctcaaagaccaagcgatctgacagcatccccgggtccaggggctccta

SEQ ID NO: 3216 - DNA, 201 bp, Homo sapiens
gcccccgatcttccgtatcccacacttcttttctcccatcccagttgcaatctcactcacaaacatcacagtaccaccccaggggcggcagtagacaccarcccagaaatttagacagggatctcttatctttggaaaataggggttaggcatgagggtggttatgattaagaagataattttgttgttaaatagcattaa

SEQ ID NO: 3217 - DNA, 201 bp, Homo sapiens
cacaagacaggtagggaaaggggacttgtggtagtgggccatacctggggacgaaaagagacccactgtaattgatgcatcgtggcccccgatcttccgtrtcccacacttcttttctcccatcccagttgcaatctcactcacaaacatcacagtaccaccccaggggcggcagtagacaccaacccagaaatttagaca

SEQ ID NO: 3218 - DNA, 201 bp, Homo sapiens
gaaatgagtggttggaagcccagcagatggaagcacctggacttaggggtaggggaggggtgtgtgtgtgacttggggaaagagagggcggctcccaccgrgaggagacagaaggtgaagacatatagaaactttacaccgcacacaccgtcaacgcattttcacatgctcaactgatattttttgttgcttccttggccc

SEQ ID NO: 3219 - DNA, 122 bp, Homo sapiens
catgacatttcaattcatctctgcaaatgaaaagggttcttcctcttgggggaaatctgtgtgtcagttctgtcagctgcaagttcttgtgtaatgaagtsaatgctgtcaggccaagtgaa

SEQ ID NO: 3220 - DNA, 201 bp, Homo sapiens
ggtccccttgattgtagagaaggctccaaaagcaagggtgcctgatctggacaggaggaagtacctagtgccctccgaccttaccgatggccagttctacsttttaatccggaagagaatccacctgagacctgaggacgccttattcttctttgtcaacaacactatccctcccactagtgctaccatgggccaactata

SEQ ID NO: 3221 - DNA, 201 bp, Homo sapiens
  misc_feature (1)...(201): n = A,T,C or G, or insertion/deletion polymorphism (see Tables 1-2)
tctttggaaaataggggttaggcatgagggtggttatgattaagaagataattttgttgttaaatagcattaaactggaattgacagagtgagttgagcanctctgtctaacctgctctttctctctggtgctcctcatctcacccctaccttggaatttaataagcttcaggcatttccaattgcagactaaaaccactt

SEQ ID NO: 3222 - DNA, 201 bp, Homo sapiens
  misc_feature (1)...(201): n = A,T,C or G, or insertion/deletion polymorphism (see Tables 1-2)
tatcggaaaaaggaaggagaaaagatccggaagaaatatccggacagggtccccttgattgtagagaaggctccaaaagcaagggtgcctgatctggacangaggaagtacctagtgccctccgaccttaccgatggccagttctaccttttaatccggaagagaatccacctgagacctgaggacgccttattcttcttt

SEQ ID NO: 3223 - DNA, 201 bp, Homo sapiens
agagatgtcttatgtagggaaggggcaggtatgaagtgaggtagattatctatacctctcactcattcaggattctcgctcccatgctgctgtcccttcaktctcacactcacaggaatgctatgtgatggccagctgcttcccttcttggttatccactgcagctgctagttagaaaggtttgcagggatgacttttagt

SEQ ID NO: 3224 - DNA, 201 bp, Homo sapiens
ccctttgagtatcggaaaaaggaaggagaaaagatccggaagaaatatccggacagggtccccttgattgtagagaaggctccaaaagcaagggtgcctgwtctggacaggaggaagtacctagtgccctccgaccttaccgatggccagttctaccttttaatccggaagagaatccacctgagacctgaggacgcctta

SEQ ID NO: 3225 - DNA, 201 bp, Homo sapiens
gcggagggagcgggacgtggccagcggtcagcggcgaaggaggcaggccctgcgcggggatcacggaagccctgtgattcaccatgaagttccagtacaargaggtccatccctttgagtatcggaaaaaggaaggagaaaagatccggaagaaatatccggacagggtccccttgattgtagagaaggctccaaaagcaa

SEQ ID NO: 3226 - DNA, 181 bp, Homo sapiens
cagaagtagttttatgaaaggaaaatatcctacaagtaaaaggaaaaagcacaattctgaattgtttgcgtgggtgttaaatgcagtaaaacactgggcargtacttacaataaaggcttcactgcttggttctgtttcaaaacagagtttgtggccgtgcagtttaatctgtacagctaa

SEQ ID NO: 3227 - DNA, 201 bp, Homo sapiens
catacccctatgtatttcttcctctccaatctctcttttatggatctttgtttgaccacttgtactgtccctcagacactggtcaactttaaggggaaggycaagaccatcacctatggtggctgcgtgacccagctattcattgccttgggactcggggggagtggagtgtgtcttattgtctgccatggcctatgaccg

SEQ ID NO: 3228 - DNA, 201 bp, Homo sapiens
tcagacactggtcaactttaaggggaaggacaagaccatcacctatggtggctgcgtgacccagctattcattgccttgggactcggggggagtggagtgsgtcttattgtctgccatggcctatgaccgctatgcagccgtctgccgcccactccactacatggtgagcatgcatccccaactttgcttgcagttggttg

SEQ ID NO: 3229 - DNA, 201 bp, Homo sapiens
ttctgtgggaacatttgtatgagcatcctatgagtgggagagtgggctgggatgtgcatcctgctccctgaacccttccatccgagactgtgcccacatcygaagcacaaggacatcaaatcatcagcacaagaacatcaacaggaatgccaccctccccagtgtctgaactccctgtccctgtcaaataaaccagaacaa

SEQ ID NO: 3230 - DNA, 201 bp, Homo sapiens; identical to SEQ ID NO: 3229

SEQ ID NO: 3231 - DNA, 201 bp, Homo sapiens
  misc_feature (1)...(201): n = A,T,C or G, or insertion/deletion polymorphism (see Tables 1-2)
tgcattgtacacaggcagctctgcagggaagtctgtgactgcctggccagacttagggctcacgctctggtcagagttatggcaccccagactctgctgcntgtcctggttctctgtgtgctgctgctgcaggcccagggaggataccgtgacaagatgaggatgcagagaatcaaggtctgtgagaagcgacccagcata

SEQ ID NO: 3232 - DNA, 201 bp, Homo sapiens
  misc_feature (1)...(201): n = A,T,C or G, or insertion/deletion polymorphism (see Tables 1-2)
aggcaggaattggagaaaatttccctagagtacatcatgcgctgtctgcgggaagtcagcttctgctacccgcaaaacttcctgggcaaggaggtggtggncaactgcatccaggagcacattaaacagctgcattgcaagggggccctgcgagacagccagctggctgggatgtgtgcagtgtctctaaagggtgaactg

SEQ ID NO: 3233 - DNA, 201 bp, Homo sapiens
tcctatggctattttcagaggagaaatcattcgtggcagatgtggaggccaattgtgaaaaagtcctgctctcctggtcagatcgcaggaagctacacgargtgctgtcttcctatgagaccagatgtgctatactgtttggtactttgataatgaagaaaggacagaagccaaaaagaaattcaggaatttaattaggaa

SEQ ID NO: 3234 - DNA, 201 bp, Homo sapiens
ggatcctatggctattttcagaggagaaatcattcgtggcagatgtggaggccaattgtgaaaaagtcctgctctcctggtcagatcgcaggaagctacasgaggtgctgtcttcctatgagaccagatgtgctatactgtttggtactttgataatgaagaaaggacagaagccaaaaagaaattcaggaatttaattag

SEQ ID NO: 3235 - DNA, 126 bp, Homo sapiens
  misc_feature (1)...(126): n = A,T,C or G, or insertion/deletion polymorphism (see Tables 1-2)
cgttccctctctgggtgcacgctggnggtccccgacttctgcactatgcgtgaaatgcccctgggacacatcatgaggcaggaattggagaaaatttccctagagtacatcatgcgctgtctgcgg

SEQ ID NO: 3236 - DNA, 201 bp, Homo sapiens
gtggcttgctatcttaaaaatggaataggttacattcatcatgtggacacctcaacaacgatggctgctgcaccacctgcatctactatctgaacaagaaytgggataccaggctacacggtgggatcctatggctattttcagaggagaaatcattcgtggcagatgtggaggccaattgtgaaaaagtcctgctctcct

SEQ ID NO: 3237 - DNA, 201 bp, Homo sapiens
  misc_feature (1)...(201): n = A,T,C or G, or insertion/deletion polymorphism (see Tables 1-2)
aagtcagcttctgctacccgcaaaacttcctgggcaaggaggtggtgggcaactgcatccaggagcacattaaacagctgcattgcaagggggccctgcgngacagccagctggctgggatgtgtgcagtgtctctaaagggtgaactgtggggtgatcagttcaccccacagttctgggagcaacaagaagggccgcgag

SEQ ID NO: 3238 - DNA, 102 bp, Homo sapiens
  misc_feature (1)...(102): n = A,T,C or G, or insertion/deletion polymorphism (see Tables 1-2)
cnttccctctctgggtgcacgctggaggtccccgacttctgcactatgcgtgaaatgcccctgggacacatcatgaggcaggaattggagaaaatttcccta

SEQ ID NO: 3239 - DNA, 201 bp, Homo sapiens
agacagctgaggtcaccgcggcgcgcacaggccccgaacgctcaggagtgtggttgttaggagagcacacaggtgttcatacagtggcatttgggacacawtcgttggaacctgaagaatctgaagttttttttaccaccatctttttctactctgtatggaagtagatctttatggggaaaagagaatttggggtgttct

SEQ ID NO: 3240 - DNA, 201 bp, Homo sapiens
aggagagcacacaggtgttcatacagtggcatttgggacacaatcgttggaacctgaagaatctgaagttttttttaccaccatctttttctactctgtawggaagtagatctttatggggaaaagagaatttggggtgttctgcaagccagtcaaagtggcacagcaaatcatataaatcgaattaaatggacaacaccg

SEQ ID NO: 3241 - DNA, 201 bp, Homo sapiens
ctttcggtttaaaacatgctatatgtactgtatgtcctgtagcccagtgcggctccacagcatggaatctgatgtatgatatgatagaatgtggcactaamtgcagtttcagattttattttttttaatcatatgaactaaaattgtcaattgtgaggtgtgcttttctcatcatgttggttatattgcacaattggttat

SEQ ID NO: 3242 - DNA, 201 bp, Homo sapiens
ccacagcatggaatctgatgtatgatatgatagaatgtggcactaaatgcagtttcagattttattttttttaatcatatgaactaaaattgtcaattgtraggtgtgcttttctcatcatgttggttatattgcacaattggttatatttatgacctgatattcaaagactctggcattgatagccagtgtgttttctta

SEQ ID NO: 3243 - DNA, 150 bp, Homo sapiens
tgtctattctaacacatcagcttattcaaaagcaagaattttaaaaataagataaatgtaaagttgttttataaacgatcctgttaattaaaccacagacmccatatatccttctgcatcctttggccaataaaagttgctggagaacca

SEQ ID NO: 3244 - DNA, 201 bp, Homo sapiens
aaatactagatcagtagacattcactaatataccaaaataaaatgaaaaattgagtttttccgtgaactttatactgtccagctctgttgattttaaagcytcttcatccaggtcagttcaggaagtatatctggagtacctgctctgtttttggctgtgagactagcactaaggattctggtacctttacccaaacctac

SEQ ID NO: 3245 - DNA, 201 bp, Homo sapiens
agctgaggtcaccgcggcgcgcacaggccccgaacgctcaggagtgtggttgttaggagagcacacaggtgggtgttcatacagtggcatttgggacacawtcgttggaacctgaagaatctgaagttttttttaccaccatctttttctactctgtatggaagtagatctttatggggaaaagagaatttggggtgttct

SEQ ID NO: 3246 - DNA, 201 bp, Homo sapiens
tgtgtccagttgtacagaagtgctattccctggcccaggggcagttgtacctttagcagggacaccaggaccatcagcctgctatacatagccagcatggstttggagggctggtaccccttgttgtactggttttaaaacactcctgccaatgtagtaacatgaggcatatttactttaaatcatctctacaaatttgaa

SEQ ID NO: 3247 - DNA, 201 bp, Homo sapiens
gagcacacaggtgggtgttcatacagtggcatttgggacacaatcgttggaacctgaagaatctgaagttttttttaccaccatctttttctactctgtawggaagtagatctttatggggaaaagagaatttggggtgttctgcaagccagtcaaagtggcacagcaaatcatataaatcgaattaaatggacaacaccg

SEQ ID NO: 3248 - DNA, 201 bp, Homo sapiens
ttaatcaggctttgcctttagggagaatgaggaggagagataattgggtattgttcaggctagtaataaatgtcatgtttctatttcccgcaactcattargttttcaggaagctcttaatttagatttctaggaaagtaattattcagtcttcctagaaaaagattataaagaccatttaaactggagattgtaatttat

SEQ ID NO: 3249 - DNA, 201 bp, Homo sapiens; identical to SEQ ID NO: 3241

SEQ ID NO: 3250 - DNA, 201 bp, Homo sapiens; identical to SEQ ID NO: 3242

SEQ ID NO: 3251 - DNA, 201 bp, Homo sapiens
tgtctattctaacacatcagcttattcaaaagcaagaattttaaaaataagataaatgtaaagttgttttataaacgatcctgttaattaaaccacagacmccatatatccttctgcatcctttggccaataaaagttgctggagaaccaaaccatggtggttcttaatcaggctttgcctttagggagaatgaggaggag

SEQ ID NO: 3252 - DNA, 201 bp, Homo sapiens
ggcttgtataagagtggctgaattcaagaacattgattcttagcagatcaataatagtatttaaagaatctgatgctaaaattagaaacctaaatgatttrtaatttgtactgtgacacagcagatgatgtttccttattttctgacatctttttatgtttttggagaggcacattagaggtgctttaaaaaaaacctgtg

SEQ ID NO: 3253 - DNA, 201 bp, Homo sapiens
agaaaataatgtggttagggaatctgtttttttcttttaaaagagcatttatgtacttttttccttcatatatccccctcattttttttctttttctttcttttttttttaattttattttttgtagagacagggagggtctcactgtgttacccaggctggtctcaaactcctggcctcaagggatcttcccacctcagc

SEQ ID NO: 3254 - DNA, 201 bp, Homo sapiens
gtctttcgtgaagcattggagacagtgacttcccagcatgtgtccagttgtacagaagtgctattccctggcccaggggcagttgtacctttagcagggayaccaggaccatcagcctgctatacatagccagcatggctttggagggctggtaccccttgttgtactggttttaaaacactcctgccaatgtagtaacat

SEQ ID NO: 3255 - DNA, 201 bp, Homo sapiens
atgtgtccagttgtacagaagtgctattccctggcccaggggcagttgtacctttagcagggacaccaggaccatcagcctgctatacatagccagcatgsctttggagggctggtaccccttgttgtactggttttaaaacactcctgccaatgtagtaacatgaggcatatttactttaaatcatctctacaaatttga

SEQ ID NO: 3256 - DNA, 201 bp, Homo sapiens
tggcaaatcttgcttacttcatcagtttattgaaaaaaaattcaaagatgactcaaatcatacaataggagtggaatttggttcaaagataataaatgttkgtggtaaatatgtaaagttacaaatatgggatacagcaggacaagaacgattcaggtccgtgacgagaagttattaccgaggcgcggccggggctctcct

SEQ ID NO: 3257 - DNA, 201 bp, Homo sapiens
ctgtgttacccaggctggtctcaaactcctggcctcaagggatcttcccacctcagcctcccaaagtgctgggattacaggcatgagccaccatgcctggccccccccaggtataatataatataaatataaatttatattatgaattatatagattctccctttatatacttataaattttttataacagattttcaaat

SEQ ID NO: 3258 - DNA, 201 bp, Homo sapiens; identical to SEQ ID NO: 3244

SEQ ID NO: 3259 - DNA, 201 bp, Homo sapiens
tggcaaatcttgcttacttcatcagtttattgaaaaaaaattcaaagatgactcaaatcatacaataggagtggaatttggttcaaagataataaatgttkgtggtaaatatgtaaagttacaaatatgggatacagcaggacaagaacgattcagaaacttcatttttggaaactttgattgacaagacagctaaaattt

SEQ ID NO: 3260 - DNA, 201 bp, Homo sapiens; identical to SEQ ID NO: 3245

SEQ ID NO: 3261 - DNA, 201 bp, Homo sapiens; identical to SEQ ID NO: 3246

SEQ ID NO: 3262 - DNA, 201 bp, Homo sapiens; identical to SEQ ID NO: 3247

SEQ ID NO: 3263 - DNA, 201 bp, Homo sapiens; identical to SEQ ID NO: 3248

SEQ ID NO: 3264 - DNA, 201 bp, Homo sapiens; identical to SEQ ID NO: 3241

SEQ ID NO: 3265 - DNA, 201 bp, Homo sapiens; identical to SEQ ID NO: 3242

SEQ ID NO: 3266 - DNA, 201 bp, Homo sapiens; identical to SEQ ID NO: 3251

SEQ ID NO: 3267 - DNA, 201 bp, Homo sapiens; identical to SEQ ID NO: 3252

SEQ ID NO: 3268 - DNA, 201 bp, Homo sapiens; identical to SEQ ID NO: 3253

SEQ ID NO: 3269 - DNA, 201 bp, Homo sapiens; identical to SEQ ID NO: 3254

SEQ ID NO: 3270 - DNA, 201 bp, Homo sapiens; identical to SEQ ID NO: 3255

SEQ ID NO: 3271 - DNA, 201 bp, Homo sapiens; identical to SEQ ID NO: 3257

SEQ ID NO: 3272 - DNA, 201 bp, Homo sapiens; identical to SEQ ID NO: 3244

SEQ ID NO: 3273 - DNA, 201 bp, Homo sapiens; identical to SEQ ID NO: 3239

SEQ ID NO: 3274 - DNA, 201 bp, Homo sapiens; identical to SEQ ID NO: 3240

SEQ ID NO: 3275 - DNA, 201 bp, Homo sapiens; identical to SEQ ID NO: 3256

SEQ ID NO: 3276 - DNA, 201 bp, Homo sapiens; identical to SEQ ID NO: 3241

SEQ ID NO: 3277 - DNA, 201 bp, Homo sapiens; identical to SEQ ID NO: 3242

SEQ ID NO: 3278 - DNA, 150 bp, Homo sapiens; identical to SEQ ID NO: 3243

SEQ ID NO: 3279 - DNA, 201 bp, Homo sapiens; identical to SEQ ID NO: 3244

SEQ ID NO: 3280 - DNA, 201 bp, Homo sapiens; identical to SEQ ID NO: 3239

SEQ ID NO: 3281 - DNA, 201 bp, Homo sapiens; identical to SEQ ID NO: 3240

SEQ ID NO: 3282 - DNA, 201 bp, Homo sapiens; identical to SEQ ID NO: 3256

SEQ ID NO: 3283 - DNA, 201 bp, Homo sapiens
ctttcggtttaaaacatgctatatgtactgtatgtcctgtagcccagtgcggctccacagcatggaatctgatgtatgatatgatagaatgtggcactaamtgcagtttcagattttattttttttaatcatatgaactaaaattatttatgacctgatattcaaagactctggcattgatagccagtgtgttttcttatt

SEQ ID NO: 3284 - DNA, 201 bp, Homo sapiens; identical to SEQ ID NO: 3244

SEQ ID NO: 3285 - DNA, 201 bp, Homo sapiens
tgggtcaccacaggcacctggagacaaagtggaaatgaaagaaaatcagtaaggaagagctctgtggctgaactgggtgctcatcacgggaactgctgggstatggaatacagatgtggcagctcaggtttcaatgtaattaggctactgagcggatcagctgtagcactggttatagcccccactgtcttactgacaatg

SEQ ID NO: 3286 - DNA, 201 bp, Homo sapiens
acggaacttggatctgtcctataatcagctgcattctctgggatctgaacagtttcggggcttgcggaagctgctgagtttacatttacggtctaactccytgagaaccatccctgtgcgaatattccaagactgccgcaacctggaacttttggacctgggatataaccggatccgaagtttagccaggaatgtctttgc

SEQ ID NO: 3287 - DNA, 201 bp, Homo sapiens
gaagtgagctgagcgtgtgcgcggtacggggctctcctgccttctgggctccaacgcagctctgtggctgaactgggtgctcatcacgggaactgctgggstatggaatacagatgtggcagctcaggtagccccaaattgcctggaagaatacatcatgtttttcgataagaagaaattgtaggatccagtttttttttt

SEQ ID NO: 3288 - DNA, 201 bp, Homo sapiens; identical to SEQ ID NO: 3286

SEQ ID NO: 3289 - DNA, 201 bp, Homo sapiens; identical to SEQ ID NO: 3286

SEQ ID NO: 3290 - DNA, 201 bp, Homo sapiens
ccaggatgttttgtgccgctcagctcctgcccgtgtcattgtggtctcctcagagtcccatcggtggagatttacagatattaacgactccttgggaaaastggacttcagtcgcctctctccaacaaaaaacgactattgggcgatgctggcttataacaggtccaagctctgcaacatcctcttctccaacgagctgca

SEQ ID NO: 3291 - DNA, 201 bp, Homo sapiens
tgtaggttccgtatctccctggagaagcaccagcaattctctttcttttactgttatagaatagcctgaggtcccctcgtcccatccagctaccaccacgrccaccactgcagccaggggctggccttctcctacttagggaagaaaaagcaagtgttcactgctccttgctgcattgatccaggagataattgtttcatt

SEQ ID NO: 3292 - DNA, 201 bp, Homo sapiens
aagaacggcttggcagccagtccggctaagtggagctcagagcggatgggcacacacacccgccctgtgtgtgtcccctcacgcaagtgccagggctgggycccttccaaatgtccctccaacacagatccgcaagagtaaaggaaataagagcattcacaacagagtgaaaaatcttaagtaccaatgggaagcagggaa

SEQ ID NO: 3293 - DNA, 201 bp, Homo sapiens
gggaattcctggggtaaagtatcacttttctggggctgggctaggcataggtctctttgctttctggtggtggcctgtttgaaagtaaaaacctggttggygtgtaggttccgtatctccctggagaagcaccagcaattctctttcttttactgttatagaatagcctgaggtcccctcgtcccatccagctaccaccac

SEQ ID NO: 3294 - DNA, 201 bp, Homo sapiens
aagcagggaattcctggggtaaagtatcacttttctggggctgggctaggcataggtctctttgctttctggtggtggcctgtttgaaagtaaaaacctgsttggcgtgtaggttccgtatctccctggagaagcaccagcaattctctttcttttactgttatagaatagcctgaggtcccctcgtcccatccagctacc

SEQ ID NO: 3295 - DNA, 201 bp, Homo sapiens
tctcctacttagggaagaaaaagcaagtgttcactgctccttgctgcattgatccaggagataattgtttcattcatcctgaccaagactgagccagcttrgcaactgctggggagacaaatctcagaaccttgtcccagccagtgaggatgacagtgacacccagagggagtagaatacgcagaactaccaggtggcaaa

SEQ ID NO: 3296 - DNA, 201 bp, Homo sapiens
cctacttggacccaagactggcgtttactgtggatgataatccgaccaagccaaccacccggcaaagatacgacggcagcaccactgccatggaaattctscagggccgggatttcactggcaaagtggttgtggtcactggagctaattcaggaatagggttcgaaaccgccaagtcttttgccctccatggtgcacatg

SEQ ID NO: 3297 - DNA, 201 bp, Homo sapiens
gtcccagccagtgaggatgacagtgacacccagagggagtagaatacgcagaactaccaggtggcaaagtacttgtcatagactcctttgctaatgctatrcaaaaaattctttagagattataacaaatttttcaaatcattccttagataccttgaaaggcaggaagggaagcgtatatacttaagaatacacaggata

SEQ ID NO: 3298 - DNA, 201 bp, Homo sapiens
caagaaactgatgagaacggacaagtgttttttgttgaccatataaataaaagaaccacctacttggacccaagactggcgtttactgtggatgataatcygaccaagccaaccacccggcaaagatacgacggcagcaccactgccatggaaattctccagggccgggatttcactggcaaagtggttgtggtcactgga

SEQ ID NO: 3299 - DNA, 129 bp, Homo sapiens
agagaataaaacgttagttaatccctttgtctgtcaatcacagtctcagttctcttgctttcacattgtacttaaacctcctgctgtgcctcgcatcctaygcttaataaaagaacatgcttgaatatc

SEQ ID NO: 3300 - DNA, 201 bp, Homo sapiens
ggacctcgctctgctccgtagcgtgcagcattttgctgaagcattcaaggccaagaatgtgcctcttcatgtgcttgtgtgcaacgcagcaacttttgctstaccctggagtctcaccaaagatggcctggagaccacctttcaagtgaatcatctggggcacttctaccttgtccagctcctccaggatgttttgtgccg

SEQ ID NO: 3301 - DNA, 201 bp, Homo sapiens
acacccgccctgtgtgtgtcccctcacgcaagtgccagggctgggccccttccaaatgtccctccaacacagatccgcaagagtaaaggaaataagagcaktcacaacagagtgaaaaatcttaagtaccaatgggaagcagggaattcctggggtaaagtatcacttttctggggctgggctaggcataggtctctttgc

SEQ ID NO: 3302 - DNA, 201 bp, Homo sapiens
ggccgggatttcactggcaaagtggttgtggtcactggagctaattcaggaatagggttcgaaaccgccaagtcttttgccctccatggtgcacatgtgaycttggcctgcaggaacatggcaagggcgagtgaagcagtgtcacgcattttagaagaatggcataaagccaaggtagaaacaatgaccctggacctcgct

SEQ ID NO: 3303 - DNA, 201 bp, Homo sapiens
gtcgggccccgacgcgcgcgggtctcgtttggagcgggagtgagttcctgagcgagtggacccggcagcgggcgataggggggccaggtgcctccacagtyagccatggcagcgctgcgctacgcggggctggacgacacggacagtgaggacgagctgcctccgggctgggaggagagaaccaccaaggacggctgggtt

SEQ ID NO: 3304 - DNA, 201 bp, Homo sapiens
tccctggagaagcaccagcaattctctttcttttactgttatagaatagcctgaggtcccctcgtcccatccagctaccaccacggccaccactgcagccrggggctggccttctcctacttagggaagaaaaagcaagtgttcactgctccttgctgcattgatccaggagataattgtttcattcatcctgaccaagac

SEQ ID NO: 3305 - DNA, 201 bp, Homo sapiens
agtgaaaaatcttaagtaccaatgggaagcagggaattcctggggtaaagtatcacttttctggggctgggctaggcataggtctctttgctttctggtgstggcctgtttgaaagtaaaaacctggttggcgtgtaggttccgtatctccctggagaagcaccagcaattctctttcttttactgttatagaatagcctg

SEQ ID NO: 3306 - DNA, 201 bp, Homo sapiens
tctccaacaaaaaacgactattgggcgatgctggcttataacaggtccaagctctgcaacatcctcttctccaacgagctgcaccgtcgcctctccccacrcggggtcacgtcgaacgcagtgcatcctggaaatatgatgtactccaacattcatcgcagctggtgggtgtacacactgctgtttaccttggcgaggcct

SEQ ID NO: 3307 - DNA, 201 bp, Homo sapiens
gccgctgcatgccctcaccagaagctcagagcgaagagacggcccggaccctgtgggcgctcagcgagaggctgatccaagaacggcttggcagccagtcyggctaagtggagctcagagcggatgggcacacacacccgccctgtgtgtgtcccctcacgcaagtgccagggctgggccccttccaaatgtccctccaac

SEQ ID NO: 3308 - DNA, 201 bp, Homo sapiens
agctcctgcccgtgtcattgtggtctcctcagagtcccatcggtggagatttacagatattaacgactccttgggaaaactggacttcagtcgcctctctscaacaaaaaacgactattgggcgatgctggcttataacaggtccaagctctgcaacatcctcttctccaacgagctgcaccgtcgcctctccccacgcgg

SEQ ID NO: 3309 - DNA, 201 bp, Homo sapiens
cctccatggtgcacatgtgatcttggcctgcaggaacatggcaagggcgagtgaagcagtgtcacgcattttagaagaatggcataaagccaaggtagaarcaatgaccctggacctcgctctgctccgtagcgtgcagcattttgctgaagcattcaaggccaagaatgtgcctcttcatgtgcttgtgtgcaacgcagc

SEQ ID NO: 3310 - DNA, 201 bp, Homo sapiens
gtgccgctcagctcctgcccgtgtcattgtggtctcctcagagtcccatcggtggagatttacagatattaacgactccttgggaaaactggacttcagtygcctctctccaacaaaaaacgactattgggcgatgctggcttataacaggtccaagctctgcaacatcctcttctccaacgagctgcaccgtcgcctctc

SEQ ID NO: 3311 - DNA, 201 bp, Homo sapiens
agagagctaagcaattggctgctttgacactggaagatgaagaagaagtaaagaaagaggctgatcctggagaaacaccatcagaggctccaagtgaagcragaacgactccagcagaaaatggggtgaatcacactacaaccctgacacccaagccaccctcccaggctctccacagccagccagctccaggttctgtaa

SEQ ID NO: 3312 - DNA, 201 bp, Homo sapiens
agcaacagaaatcgtttgtgaaacttcaaaagaaacactacaaagaaatgaaagacctggttaagagacaccacaagaaaaccactgaccttatcaaagarcacactaccaagtataatgaaattcagaatgactacttgagaaggagagccgctttggaaaagtccgccaaaaaggacagtaagaaaaaatcggaaccca

SEQ ID NO: 3313 - DNA, 201 bp, Homo sapiens
acactttgtctgttaagattatttcaggtcagtttctttctgataagaaagttgggacttacgtggaagtagatatgtttggtttgcctgtggatacaagraggaaggcatttaagaccaaaacatcccaaggaaatgctgtgaatcctgtctgggaagaagaacctattgtgttcaaaaaggtggttcttcctactctgg

SEQ ID NO: 3314 - DNA, 201 bp, Homo sapiens
gataacagaagctaaatccaaagacaaaagtcagatggaagaggagaagacagagatgatccggtcatatatccaggaagtggtgcagtatatcaagaggytagaagaagcgcaaagtaaacggcaagaaaaactcgtagagaaacacaaggaaatacgtcagcagatcctggatgaaaagcccaagggggaaggttcctc

SEQ ID NO: 3315 - DNA, 201 bp, Homo sapiens
gagccgctttggaaaagtccgccaaaaaggacagtaagaaaaaatcggaacccagcagccctgatcatggttcatcaacgattgagcaagacctcgctgcyctggatgctgaaatgacccaaaagttaatagacttgaaggacaaacaacagcagcagctgcttaatcttcggcaagaacagtattatagtgaaaaatacc

SEQ ID NO: 3316 - DNA, 201 bp, Homo sapiens
attttgatccatttactgaaggcatcgtagatgggatagtggcaaacactttgtctgttaagattatttcaggtcagtttctttctgataagaaagttggracttacgtggaagtagatatgtttggtttgcctgtggatacaaggaggaaggcatttaagaccaaaacatcccaaggaaatgctgtgaatcctgtctggg

SEQ ID NO: 3317 - DNA, 201 bp, Homo sapiens
gaagttaaaacccagaagccagatgctcacagttttattttactttaaaataaacctgtctgactgtagctttgcgaaatatcttaaaacgcaaaaaccarttgtgtcctgaaaattgtttcaagaatttaatatttttatgaaaattattttatttaactttaagcaataactagagattacaattaaattttaatcaaa

SEQ ID NO: 3318 - DNA, 201 bp, Homo sapiens
attacttgaaatagactaagataaagaaaaggggtctgtatgatgtgcagttttgtgcctttatgtatttgccttgttctttgtcgaatgtgtgaaattcygtactgtggtttttcctataatagaaagtagagctgtgtattaaattagactgtgtctctctgatacctttacactactgagaatagcatggttttggcc

SEQ ID NO: 3319 - DNA, 201 bp, Homo sapiens
ggagatgattatattttgatctgaagggtttggggtgttcattagacacttaataaaacttaacttccaatgaaaaagaaatcttttgtaaatcattctayttttgcactttgaaagaaaggcgttaatcataaagaagcaagaatggtcaaaatcgaatgctgcatttttataaacaaaattacagactgtctgaaattg

SEQ ID NO: 3320 - DNA, 201 bp, Homo sapiens
acatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgc

SEQ ID NO: 3321 - DNA, 201 bp, Homo sapiens
ttgagaagtatgaacccaacaacagcctcgccagaaaaggacaaatatcagtggatgggttcatgcgctatctgagtggagaagaaaacggagtcgtttcrcctgagaaactggatttgaatgaagacatgtctcagcccctttctcactatttcattaattcctcgcacaacacctacctcacagctggccaactggctg

SEQ ID NO: 3322 - DNA, 201 bp, Homo sapiens
cacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatg

SEQ ID NO: 3323 - DNA, 201 bp, Homo sapiens
acacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaat

SEQ ID NO: 3324 - DNA, 201 bp, Homo sapiens
tattaaactgcttattcaaaagttgacggatgtcgcagaagagtgtcagaacaatcagttaaagaagctcaaagaaatctgtgagaaagaaaagaaagaaytaaagaagaaaatggataaaaagaggcaggagaagataacagaagctaaatccaaagacaaaagtcagatggaagaggagaagacagagatgatccggtc

SEQ ID NO: 3325 - DNA, 201 bp, Homo sapiens
aacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaa

SEQ ID NO: 3326 - DNA, 201 bp, Homo sapiens
gtgaatgctcctgccaggccttcagaaattgcatggccactccagcgtcatcggactctctcttattacaaagatcactgcccaggaccatcttcccgagragcatcccttagcctaaaatccacaccaaagggagagttccagaggaatccatgaagaattcccatgcccaggctccatgtgtcatgtggaaacctccac

SEQ ID NO: 3327 - DNA, 201 bp, Homo sapiens; identical to SEQ ID NO: 3311

SEQ ID NO: 3328 - DNA, 201 bp, Homo sapiens; identical to SEQ ID NO: 3312

SEQ ID NO: 3329 - DNA, 201 bp, Homo sapiens; identical to SEQ ID NO: 3313

SEQ ID NO: 3330 - DNA, 201 bp, Homo sapiens
gataacagaagctaaatccaaagacaaaagtcagatggaagaggagaagacagagatgatccggtcatatatccaggaagtggtgcagtatatcaagaggytagaagaagcgcaaagtaaacggcaagaaaaactcgtagagaaacacaaggaaatacgtcagcagatcctggatgaaaagcccaagctgcaggtggagct

SEQ ID NO: 3331 - DNA, 201 bp, Homo sapiens; identical to SEQ ID NO: 3315

SEQ ID NO: 3332 - DNA, 201 bp, Homo sapiens; identical to SEQ ID NO: 3316

SEQ ID NO: 3333 - DNA, 201 bp, Homo sapiens; identical to SEQ ID NO: 3317

SEQ ID NO: 3334 - DNA, 201 bp, Homo sapiens; identical to SEQ ID NO: 3318

SEQ ID NO: 3335 - DNA, 201 bp, Homo sapiens; identical to SEQ ID NO: 3319

SEQ ID NO: 3336 - DNA, 201 bp, Homo sapiens; identical to SEQ ID NO: 3320

SEQ ID NO: 3337 - DNA, 201 bp, Homo sapiens; identical to SEQ ID NO: 3321

SEQ ID NO: 3338 - DNA, 201 bp, Homo sapiens; identical to SEQ ID NO: 3322

SEQ ID NO: 3339 - DNA, 201 bp, Homo sapiens; identical to SEQ ID NO: 3323

SEQ ID NO: 3340 - DNA, 201 bp, Homo sapiens; identical to SEQ ID NO: 3324

SEQ ID NO: 3341 - DNA, 201 bp, Homo sapiens; identical to SEQ ID NO: 3325

SEQ ID NO: 3342 - DNA, 201 bp, Homo sapiens; identical to SEQ ID NO: 3326

SEQ ID NO: 3343 - DNA, 201 bp, Homo sapiens; identical to SEQ ID NO: 3311

SEQ ID NO: 3344 - DNA, 201 bp, Homo sapiens; identical to SEQ ID NO: 3312

SEQ ID NO: 3345 - DNA, 201 bp, Homo sapiens; identical to SEQ ID NO: 3313

SEQ ID NO: 3346 - DNA, 201 bp, Homo sapiens; identical to SEQ ID NO: 3314

SEQ ID NO: 3347 - DNA, 201 bp, Homo sapiens; identical to SEQ ID NO: 3315

SEQ ID NO: 3348 - DNA, 201 bp, Homo sapiens; identical to SEQ ID NO: 3316

SEQ ID NO: 3349 - DNA, 201 bp, Homo sapiens; identical to SEQ ID NO: 3317

SEQ ID NO: 3350 - DNA, 201 bp, Homo sapiens; identical to SEQ ID NO: 3318

SEQ ID NO: 3351 - DNA, 201 bp, Homo sapiens; identical to SEQ ID NO: 3319

SEQ ID NO: 3352 - DNA, 201 bp, Homo sapiens; identical to SEQ ID NO: 3320

SEQ ID NO: 3353 - DNA, 201 bp, Homo sapiens; identical to SEQ ID NO: 3321

SEQ ID NO: 3354 - DNA, 201 bp, Homo sapiens; identical to SEQ ID NO: 3322

SEQ ID NO: 3355 - DNA, 201 bp, Homo sapiens; identical to SEQ ID NO: 3323

SEQ ID NO: 3356 - DNA, 201 bp, Homo sapiens; identical to SEQ ID NO: 3324

SEQ ID NO: 3357 - DNA, 201 bp, Homo sapiens; identical to SEQ ID NO: 3325

SEQ ID NO: 3358 - DNA, 201 bp, Homo sapiens; identical to SEQ ID NO: 3326

SEQ ID NO: 3359 - DNA, 201 bp, Homo sapiens; identical to SEQ ID NO: 3311

SEQ ID NO: 3360 - DNA, 201 bp, Homo sapiens; identical to SEQ ID NO: 3312

SEQ ID NO: 3361 - DNA, 201 bp, Homo sapiens; identical to SEQ ID NO: 3313

SEQ ID NO: 3362 - DNA, 201 bp, Homo sapiens; identical to SEQ ID NO: 3330

SEQ ID NO: 3363 - DNA, 201 bp, Homo sapiens; identical to SEQ ID NO: 3315

SEQ ID NO: 3364 - DNA, 201 bp, Homo sapiens; identical to SEQ ID NO: 3316

SEQ ID NO: 3365 - DNA, 201 bp, Homo sapiens; identical to SEQ ID NO: 3317

SEQ ID NO: 3366 - DNA, 201 bp, Homo sapiens; identical to SEQ ID NO: 3318

SEQ ID NO: 3367 - DNA, 201 bp, Homo sapiens; identical to SEQ ID NO: 3319

SEQ ID NO: 3368 - DNA, 201 bp, Homo sapiens; identical to SEQ ID NO: 3320

SEQ ID NO: 3369 - DNA, 201 bp, Homo sapiens; identical to SEQ ID NO: 3321

SEQ ID NO: 3370 - DNA, 201 bp, Homo sapiens; identical to SEQ ID NO: 3322

SEQ ID NO: 3371 - DNA, 201 bp, Homo sapiens; identical to SEQ ID NO: 3323

SEQ ID NO: 3372 - DNA, 201 bp, Homo sapiens; identical to SEQ ID NO: 3324

SEQ ID NO: 3373 - DNA, 201 bp, Homo sapiens; identical to SEQ ID NO: 3325

SEQ ID NO: 3374 - DNA, 201 bp, Homo sapiens; identical to SEQ ID NO: 3326

SEQ ID NO: 3375 - DNA, 201 bp, Homo sapiens; identical to SEQ ID NO: 3311

SEQ ID NO: 3376 - DNA, 201 bp, Homo sapiens; identical to SEQ ID NO: 3312

SEQ ID NO: 3377 - DNA, 201 bp, Homo sapiens; identical to SEQ ID NO: 3313

SEQ ID NO: 3378 - DNA, 201 bp, Homo sapiens; identical to SEQ ID NO: 3330

SEQ ID NO: 3379 - DNA, 201 bp, Homo sapiens; identical to SEQ ID NO: 3315

SEQ ID NO: 3380 - DNA, 201 bp, Homo sapiens; identical to SEQ ID NO: 3316

SEQ ID NO: 3381 - DNA, 201 bp, Homo sapiens; identical to SEQ ID NO: 3317

SEQ ID NO: 3382 - DNA, 201 bp, Homo sapiens; identical to SEQ ID NO: 3318

SEQ ID NO: 3383 - DNA, 201 bp, Homo sapiens; identical to SEQ ID NO: 3319

SEQ ID NO: 3384 - DNA, 201 bp, Homo sapiens; identical to SEQ ID NO: 3320

SEQ ID NO: 3385 - DNA, 201 bp, Homo sapiens; identical to SEQ ID NO: 3321

SEQ ID NO: 3386 - DNA, 201 bp, Homo sapiens; identical to SEQ ID NO: 3322

SEQ ID NO: 3387 - DNA, 201 bp, Homo sapiens; identical to SEQ ID NO: 3323

SEQ ID NO: 3388 - DNA, 201 bp, Homo sapiens; identical to SEQ ID NO: 3324

SEQ ID NO: 3389 - DNA, 201 bp, Homo sapiens; identical to SEQ ID NO: 3325

SEQ ID NO: 3390 - DNA, 201 bp, Homo sapiens; identical to SEQ ID NO: 3326

SEQ ID NO: 3391 - DNA, 201 bp, Homo sapiens
tacacaggaaagaaactatgaggccacccatggatgactctcagacacttttgacccctgtggtgagctgtgggcccccaggagctctgctcacccgcccmgtcgtcctcactatgcatcactgcgcagaccccaataccgaggactggaaaatactgctcaagaaccaggcagcacagggacagtgggaggatgtggtgg

SEQ ID NO: 3392 - DNA, 201 bp, Homo sapiens
tgacccagtcgttgttggagaatgaagccctcagcctgaagaaccagagtctagcaaggcagactgatccatcctgtaccgcatttggcagcttcaactcrctgggaggtcaccttattgttcccaattcaggagtcagcttgctgattcccgctggggccattccccaagggagagtctacgaaatgtatgtgactgtac

SEQ ID NO: 3393 - DNA, 201 bp, Homo sapiens
ctgcaaattacacctgtgttgccaaaaacattgttgccaagaggaaaagtacaactgccactgtcatagtctatgtcaacggtggctggtccacctggacrgagtggtctgtgtgtaacagccgctgtggacgagggtatcagaaacgtacaaggacttgtaccaacccggcaccactcaatgggggtgccttctgtgaag

SEQ ID NO: 3394 - DNA, 201 bp, Homo sapiens
gggcccctgtgctgctcctcgctggagtacagcatccgagtctactgtctggatgacacccaggatgccctgaaggaaattttacatcttgagagacagaygggaggacagctcctagaagaacctaaggctcttcattttaaaggcagcacccacaacctgcgcctgtcaattcacgatatcgcccattccctctggaag

SEQ ID NO: 3395 - DNA, 201 bp, Homo sapiens
accccctgctacattcagctggatgcagaggcctgccacatcctcacagagaacctcagcacctacgccctggtaggacattccaccaccaaagcggctgygaagcgcctcaagctggccatctttgggcccctgtgctgctcctcgctggagtacagcatccgagtctactgtctggatgacacccaggatgccctgaag

SEQ ID NO: 3396 - DNA, 201 bp, Homo sapiens
  misc_feature (1)...(201): n = A,T,C or G, or insertion/deletion polymorphism (see Tables 1-2)
tttttcatgaactcccagaaacttttccttctgatccacctgagcctctgccacatttccttattgagcctgaagaagcttatattgtgaagaataagccngtgaacctgtactgtaaagcaagccctgccacccagatctatttcaagtgtaatagtgaatgggttcatcagaaggaccacatagtagatgaaagagtag

SEQ ID NO: 3397 - DNA, 201 bp, Homo sapiens
  misc_feature (1)...(201): n = A,T,C or G, or insertion/deletion polymorphism (see Tables 1-2)
ccccctgctacattcagctggatgcagaggcctgccacatcctcacagagaacctcagcacctacgccctggtaggacattccaccaccaaagcggctgcnaagcgcctcaagctggccatctttgggcccctgtgctgctcctcgctggagtacagcatccgagtctactgtctggatgacacccaggatgccctgaagg

SEQ ID NO: 3398 - DNA, 201 bp, Homo sapiens
ttgaagatcggaatttttatattactattgatcacaacctcatcataaagcaggcccgactctctgatactgcaaattacacctgtgttgccaaaaacatygttgccaagaggaaaagtacaactgccactgtcatagtctatgtcaacggtggctggtccacctggacggagtggtctgtgtgtaacagccgctgtggac

SEQ ID NO: 3399 - DNA, 201 bp, Homo sapiens
aagacatgaaacggtggtgtccttagcagcagaagggcagtattaaccaccatgctggaaggggaaatgaaggacaaaaatgcacagggagtctgtggccrtccaggtgaatcacagctgaggaggaaatccagatgagaccaatgcacttcacaggcaagactgcagcaggagccagaaggaaaacagatacaactgccc

SEQ ID NO: 3400 - DNA, 201 bp, Homo sapiens
gatcttccagctcaactgcaccgtgtcagaggaacctactggcatcgatttgccgctgctggatcctgcgaacaccatcaccacggtcacggggcccagtrctttcagcatccctctccctatccggcagaagctctgtagcagcctggatgccccccagacgagaggccatgactggaggatgctggcccataagctgaa

SEQ ID NO: 3401 - DNA, 201 bp, Homo sapiens
tccttattgagcctgaagaagcttatattgtgaagaataagcctgtgaacctgtactgtaaagcaagccctgccacccagatctatttcaagtgtaatagygaatgggttcatcagaaggaccacatagtagatgaaagagtagatgaaacttccggtctcattgtccgggaagtgagcattgagatttcgcgccagcaag

SEQ ID NO: 3402 - DNA, 201 bp, Homo sapiens
tgaagttgaagctgtggacggtttgttgtgtctatttcagattagtaatttacagagaaatcacagacttttgctacaaatcgtgtgcatcaagtgtctcwgataatcctcccatcagtgttctgtttctagaacttgtagaaccagtgttactgtttgtatcagggaagtggagaatctaagtgtaaaaaagaaataact

SEQ ID NO: 3403 - DNA, 201 bp, Homo sapiens; identical to SEQ ID NO: 3391

SEQ ID NO: 3404 - DNA, 201 bp, Homo sapiens; identical to SEQ ID NO: 3392

SEQ ID NO: 3405 - DNA, 201 bp, Homo sapiens; identical to SEQ ID NO: 3394

SEQ ID NO: 3406 - DNA, 201 bp, Homo sapiens; identical to SEQ ID NO: 3395

SEQ ID NO: 3407 - DNA, 201 bp, Homo sapiens; identical to SEQ ID NO: 3393

SEQ ID NO: 3408 - DNA, 201 bp, Homo sapiens; identical to SEQ ID NO: 3396
  misc_feature (1)...(201): n = A,T,C or G, or insertion/deletion polymorphism (see Tables 1-2)

SEQ ID NO: 3409 - DNA, 201 bp, Homo sapiens; identical to SEQ ID NO: 3397
  misc_feature (1)...(201): n = A,T,C or G, or insertion/deletion polymorphism (see Tables 1-2)

SEQ ID NO: 3410 - DNA, 201 bp, Homo sapiens; identical to SEQ ID NO: 3398

SEQ ID NO: 3411 - DNA, 201 bp, Homo sapiens; identical to SEQ ID NO: 3399

SEQ ID NO: 3412 - DNA, 201 bp, Homo sapiens; identical to SEQ ID NO: 3400

SEQ ID NO: 3413 - DNA, 201 bp, Homo sapiens; identical to SEQ ID NO: 3401

SEQ ID NO: 3414 - DNA, 201 bp, Homo sapiens; identical to SEQ ID NO: 3402

SEQ ID NO: 3415 - DNA, 201 bp, Homo sapiens
  misc_feature (1)...(201): n = A,T,C or G, or insertion/deletion polymorphism (see Tables 1-2)
gcagtgtgtgggagaggaccagccaagcgattctgattcttcccggttttccgaaagcatggcttcgctcagtgactatgaatgctccaggcagagctttncaagtgactcctccagcaaatccagctctcctgcttcaacaagccctccaagggttgtaacatttgatgaagtgatggctacagcaaggaacttatcaaa

SEQ ID NO: 3416 - DNA, 201 bp, Homo sapiens
cttgccccgtcgcgccgtcgtccccccgctatccggttttgtgatggccgcgccgtggctgcctccctagagtccctcagggccctttaaataccgcgttgggggggacactggggctgggggggtttgttgggctggtgagttttcgaggtgactgtgctgtgctcggtgaggggacgcccagagagccctgacccgggg

SEQ ID NO: 3417 - DNA, 201 bp, Homo sapiens
cccggtgctacctttttacccacacttaagtgacgcaaaatgcccttcaatggcgagaagcagtgtgtgggagaggaccagccaagcgattctgattcttyccggttttccgaaagcatggcttcgctcagtgactatgaatgctccaggcagagctttgcaagtgactcctccagcaaatccagctctcctgcttcaaca

SEQ ID NO: 3418 - DNA, 197 bp, Homo sapiens
aagggccctggatccccttgccccgtcgcgccgtcgtccccccgctatccggttttgtgatggccgcgccgtggctgcctccctagagtccctcagsgccctttaaataccgcgttgggggggacactggggctgggggggtttgttgggctggtgagttttcgaggtgactgtgctgtgctcggtgaggggacgcc

SEQ ID NO: 3419 - DNA, 201 bp, Homo sapiens
gtaatattagcattacagaagacacacacatcacatagaccctcagaagacgtaaacatcacatagaccctatttgtgcatcattttcaagtttaaaacayatatttgtaatgaacagaaaacaatttgtaattaattatattacctatataatacttgtaaatgttttcttaaccatttatatttggcttatgacattta

SEQ ID NO: 3420 - DNA, 201 bp, Homo sapiens
tcgcgccgtcgtccccccgctatccggttttgtgatggccgcgccgtggctgcctccctagagtccctcagggccctttaaataccgcgttgggggggacrctggggctgggggggtttgttgggctggtgagttttcgaggtgactgtgctgtgctcggtgaggggacgcccagagagccctgacccggggtcactccgt

SEQ ID NO: 3421 - DNA, 201 bp, Homo sapiens
cagctctcctgcttcaacaagccctccaagggttgtaacatttgatgaagtgatggctacagcaaggaacttatcaaacttgactcttgctcatgagattkctgtaaatgagaactttcaattgaaacaagaggctctcccagaaaagagtttggctggtcgagtgaagcacattgttcaccaggccttctgggacgtctt

SEQ ID NO: 3422 - DNA, 201 bp, Homo sapiens; identical to SEQ ID NO: 3417

SEQ ID NO: 3423 - DNA, 201 bp, Homo sapiens; identical to SEQ ID NO: 3419

SEQ ID NO: 3424 - DNA, 201 bp, Homo sapiens; identical to SEQ ID NO: 3421

SEQ ID NO: 3425 - DNA, 201 bp, Homo sapiens; identical to SEQ ID NO: 3415
  misc_feature (1)...(201): n = A,T,C or G, or insertion/deletion polymorphism (see Tables 1-2)

SEQ ID NO: 3426 - DNA, 201 bp, Homo sapiens
tcatgagtgatccgcatgggaccgcgatgcctctgacgtctgccatcctggagagcagcagagcgtcactagcagccaaacaggaagacaagtgtttcacrgacataagaaatttaaagtggaagcactttctagagcacacaaaacagcctccctaacacatgagaagtcaccagcaacacagaaatcaccaacaagtag

SEQ ID NO: 3427 - DNA, 161 bp, Homo sapiens
acacatgagaagtcaccagcaacacagaaatcaccaacaagtaggtcaccacatttttaaagatcataggaaattgttcacgccaacaaatctcagtgaayctcagctctcagccttgaaaacaaggatggctgtactactcacttttttcttcttcttcc

SEQ ID NO: 3428 - DNA, 201 bp, Homo sapiens
gagtgatccgcatgggaccgcgatgcctctgacgtctgccatcctggagagcagcagagcgtcactagcagccaaacaggaagacaagtgtttcacggacrtaagaaatttaaagtggaagcactttctagagcacacaaaacagcctccctaacacatgagaagtcaccagcaacacagaaatcaccaacaagtaggtca

SEQ ID NO: 3429 - DNA, 145 bp, Homo sapiens
cagcaacacagaaatcaccaacaagtaggtcaccacatttttaaagatcataggaaattgttcacgccaacaaatctcagtgaacctcagctctcagcctygaaaacaaggatggctgtactactcacttttttcttcttcttcc

SEQ ID NO: 3430 - DNA, 201 bp, Homo sapiens
agaatgactcagtcaaaaatcttaatctggacccttttcataagatggtgccaagaacgaagaaggaagctcctgcccctcctaaagccgaagccaaagcraaggctttgcaaggccaagaaggcagtgttgaaagatgtccacagccacaaaaaaaacaagatccacatgtcacccaccttccggcggcccaagacactg

SEQ ID NO: 3431 - DNA, 201 bp, Homo sapiens
aaagccgaagccaaagcgaaggctttgcaaggccaagaaggcagtgttgaaagatgtccacagccacaaaaaaaacaagatccacatgtcacccaccttcyggcggcccaagacactgtgactccggaggcagcccaaatatccttggaagagcacccccaggagaaataagcttgaccaccatgttatcatcaagtttcc

SEQ ID NO: 3432 - DNA, 201 bp, Homo sapiens
cttccggcggcccaagacactgtgactccggaggcagcccaaatatccttggaagagcacccccaggagaaataagcttgaccaccatgttatcatcaagwttccgctgaccactgagtaggctgtgaagaagatagaaaacaacagcctacttgtgttcactgtggatgttaaagccaacaagcaccagatcaaacaggc

SEQ ID NO: 3433 - DNA, 201 bp, Homo sapiens
ctggcgctgcggcgaccgaccggggcgtcaggatccctggcccccggagagcgaagggcgggcgggtcccggagcaagaagaattgtatagaaatgtaaamaacatttatgtgtgcttcacatgtggcatgaaaaaaatgaggacctctggtcaaaattgcctgagttcagaatttcatgctggaaggaaagttagacgta

SEQ ID NO: 3434 - DNA, 201 bp, Homo sapiens
tgatcttgtctggttttctgttattttttgatttggtgacatagctctcaaagatttggtgacacagcttcttgagtcactttcatctctcttaaaaaaawtttttttttaacaacttttaagttcaggggtacatgtgccagtttgtttcataggtaaacttacgtcatgggggtttgttgtatagatgatttcatcacc

SEQ ID NO: 3435 - DNA, 201 bp, Homo sapiens
tcaagctgcaggctggggctgtgggcagggtggtggattaccagaatgggttttacaaggttttctttactttgctatggccaggcaaagttaaagtatcygtatctctggtccaccccagtgaagggatcagagttcttcagcgcttacaggaagataaaccagacagggtctatttcaagagtctcttccgttcaggaa

SEQ ID NO: 3436 - DNA, 201 bp, Homo sapiens
ccttccctttggaagtgtacatccggcggctcaggaacatccgtcgagcagtggttcggctcctcgatcgaagcccaaagaccgtggtggtcatccggacrgccaacgcccaagagctgggacctgaggtgagccttttcaacagcgactggtacaactttcagctggacaccatccttcggaggatgttctcaggggttg

SEQ ID NO: 3437 - DNA, 201 bp, Homo sapiens
gggactacaggtatgtaccaccatgcccagctaatttttgtatctttttgtagagactacattttgccatgttgtccaggctggtcttaaactcctgagcycaagcatctgcccacctcagcttcccaaagtgctgggattacaggtgtgagccactgtgcccagctgagagtttttcttgtcgtgaaagaacttgacatt

SEQ ID NO: 3438 - DNA, 201 bp, Homo sapiens
acttttggaactggaagggggaaatctgtaaatggaaatttatttttatgttctgaaatttgagggtttaggaattgacttttgtgtaaagaatgctacgrtattataaagctgtggaagttttttccactagtttcaggtgttttttttttttttgttgttgttgttattttgaactacttaccaaaattagaagttaaa

SEQ ID NO: 3439 - DNA, 201 bp, Homo sapiens
tgaaatttgagggtttaggaattgacttttgtgtaaagaatgctacggtattataaagctgtggaagttttttccactagtttcaggtgtttttttttttkttgttgttgttgttattttgaactacttaccaaaattagaagttaaaatctaattagaaattaataagatactaaaattcatgacagttttttgtttgtt

SEQ ID NO: 3440 - DNA, 201 bp, Homo sapiens
gtcccttccttgcagtggaccagaagcacaacatcctgctcaaataccgctgccatggtccacccatccgcttcacgactgtctttagcaatgagctccaktatgtggcgaatgagctgaatggcattgtgggagggaagaacacagtggttgccatagctgtatggtctcacttcagcaccttccctttggaagtgtaca

SEQ ID NO: 3441 - DNA, 201 bp, Homo sapiens
  misc_feature (1)...(201): n = A,T,C or G, or insertion/deletion polymorphism (see Tables 1-2)
gtcttaaactcctgagctcaagcatctgcccacctcagcttcccaaagtgctgggattacaggtgtgagccactgtgcccagctgagagtttttcttgtcntgaaagaacttgacatttcctcaaggatttataaaggaggctgaggagtaattttcccaggagaattttaaaaagaaagcgggcattgctcctccagtgg

SEQ ID NO: 3442 - DNA, 201 bp, Homo sapiens
gtgtcaatatcaaaatgccagtcaactccagtggacctgattgggtaactgtgattcccaggagaataaaagaaactaacagtctagaactatctcaaggstcaggaacttttccttctgggtattattataaagaccagtggaggcccagaaagtttaagatgcgtcagtttaatgaccctgacaacattacagagtgct

SEQ ID NO: 3443 - DNA, 201 bp, Homo sapiens
ccagcttctcctgaagctcggtatggccacaacactaaattctgcccgaggagattaagcaaaatagtatgggacttccaagaaatgtttttaaagtcagrggcaggcctttcttcatgccttcttcctctttgctggctggaatgcaaagaccatggcaggaggccaagcagccatcctggaaggtgaaagcctcatact

SEQ ID NO: 3444 - DNA, 201 bp, Homo sapiens
cccgaggagattaagcaaaatagtatgggacttccaagaaatgtttttaaagtcagaggcaggcctttcttcatgccttcttcctctttgctggctggaaygcaaagaccatggcaggaggccaagcagccatcctggaaggtgaaagcctcatactaaggacgtcagacagcgaaataagagcctgggtccttgaccctg

SEQ ID NO: 3445 - DNA, 201 bp, Homo sapiens
agccgcggtgcgctcgggtcccgggaacccgcgaaggtccacagctcccgccctgactccgccgccgcgccggccatggccccggctagtccatccaggcyggccgggcccgggaagtgcgcgaagccggcccccggcgactccgcccccgccacgcctcccaggcctccagcctcccagtctctcggaatccgcagccta

SEQ ID NO: 3446 - DNA, 201 bp, Homo sapiens
ccctgactccgccgccgcgccggccatggccccggctagtccatccaggctggccgggcccgggaagtgcgcgaagccggcccccggcgactccgcccccrccacgcctcccaggcctccagcctcccagtctctcggaatccgcagcctaggtgtggcgccccgaccggactttcacttctggccagccctttccccacc

SEQ ID NO: 3447 - DNA, 201 bp, Homo sapiens
cccgggaacccgcgaaggtccacagctcccgccctgactccgccgccgcgccggccatggccccggctagtccatccaggctggccgggcccgggaagtgmgcgaagccggcccccggcgactccgcccccgccacgcctcccaggcctccagcctcccagtctctcggaatccgcagcctaggtgtggcgccccgaccgg

SEQ ID NO: 3448 - DNA, 201 bp, Homo sapiens
gcagctcgcgcaggctgcccgggccgtagccgtaggctagccgcggtgcgctcgggtcccgggaacccgcgaaggtccacagctcccgccctgactccgcygccgcgccggccatggccccggctagtccatccaggctggccgggcccgggaagtgcgcgaagccggcccccggcgactccgcccccgccacgcctccca

SEQ ID NO: 3449 - DNA, 201 bp, Homo sapiens
gatttaatttcccagcttctcctgaagctcggtatggccacaacactaaattctgcccgaggagattaagcaaaatagtatgggacttccaagaaatgttkttaaagtcagaggcaggcctttcttcatgccttcttcctctttgctggctggaatgcaaagaccatggcaggaggccaagcagccatcctggaaggtgaa

SEQ ID NO: 3450 - DNA, 201 bp, Homo sapiens
actaaattctgcccgaggagattaagcaaaatagtatgggacttccaagaaatgtttttaaagtcagaggcaggcctttcttcatgccttcttcctctttkctggctggaatgcaaagaccatggcaggaggccaagcagccatcctggaaggtgaaagcctcatactaaggacgtcagacagcgaaataagagcctgggt

SEQ ID NO: 3451 - DNA, 201 bp, Homo sapiens
ggggtcatagttctccctgagtgagactcacctgctcctctggcccctggtcctgtcctgttctccagcatggtgtgtctgaagctccctggaggctcctrcatggcagctctgacagtgacactgatggtgctgagctccccactggctttggctggggacacccaacgtaagtgcacattgtgggtgctgagctactat

SEQ ID NO: 3452 - DNA, 186 bp, Homo sapiens
agaggggtcatagttctccctgagtgagactcacctgctcctctggcccctggtcctgtcctgttctccagcatggtgtgtctgargctccctggaggctcctgcatggcagctctgacagtgacactgatggtgctgagctccccactggctttggctggggacacccaacgtaagtgcacattg

SEQ ID NO: 3453 - DNA, 201 bp, Homo sapiens
gttctccctgagtgagactcacctgctcctctggcccctggtcctgtcctgttctccagcatggtgtgtctgaagctccctggaggctcctgcatggcagytctgacagtgacactgatggtgctgagctccccactggctttggctggggacacccaacgtaagtgcacattgtgggtgctgagctactatggggtgggg

SEQ ID NO: 3454 - DNA, 201 bp, Homo sapiens
ttctccctgagtgagactcacctgctcctctggcccctggtcctgtcctgttctccagcatggtgtgtctgaagctccctggaggctcctgcatggcagckctgacagtgacactgatggtgctgagctccccactggctttggctggggacacccaacgtaagtgcacattgtgggtgctgagctactatggggtgggga

SEQ ID NO: 3455 - DNA, 199 bp, Homo sapiens
agaggggtcatagttctccctgagtgagactcacctgctcctctggcccctggtcctgtcctgttctccagcatggtgtgtctgaagctccctggaggytcctgcatggcagctctgacagtgacactgatggtgctgagctccccactggctttggctggggacacccaacgtaagtgcacattgtgggtgctgagct

SEQ ID NO: 3456 - DNA, 201 bp, Homo sapiens
catagttctccctgagtgagactcacctgctcctctggcccctggtcctgtcctgttctccagcatggtgtgtctgaagctccctggaggctcctgcatgrcagctctgacagtgacactgatggtgctgagctccccactggctttggctggggacacccaacgtaagtgcacattgtgggtgctgagctactatggggt

SEQ ID NO: 3457 - DNA, 188 bp, Homo sapiens
agaggggtcatagttctccctgagtgagactcacctgctcctctggcccctggtcctgtcctgttctccagcatggtgtgtctgaagytccctggaggctcctgcatggcagctctgacagtgacactgatggtgctgagctccccactggctttggctggggacacccaacgtaagtgcacattgtg

SEQ ID NO: 3458 - DNA, 201 bp, Homo sapiens
tttgggggaggacaatccggccttcttgggactgttccagcccacctcccagatgcttcggtcagtctgatccacgagatatctcaggctgggaagaacayatcttgggccaacttccacagcagccatgcgtccaaggatacagaatcaggcaggccgataaaaggattttgacttgggtttcacaggaaggaggtatgc

SEQ ID NO: 3459 - DNA, 201 bp, Homo sapiens
taggaagttgtgtcagaggagtgcagtcatctcttattcatggtagtgttttggttcgattttggagcatccaccaggttcgcgtacaggagaagaaacasggatgatctctgtctttattttgggggaggacaatccggccttcttgggactgttccagcccacctcccagatgcttcggtcagtctgatccacgagata

SEQ ID NO: 3460 - DNA, 201 bp, Homo sapiens; identical to SEQ ID NO: 3459

SEQ ID NO: 3461 - DNA, 201 bp, Homo sapiens; identical to SEQ ID NO: 3458

SEQ ID NO: 3462 - DNA, 201 bp, Homo sapiens
gctgggtacagcctccatataagtactgtgagaaaaggtgtactaaaataatgacttgtgtacgtccaaatcatacatgctgctggacctactgtggaaayatctgcttagacaacgaagagccccttaaatcaatgctaaacccctagattctattggccgatcactactgtgggctgaaggatgaccatctggtctaag

SEQ ID NO: 3463 - DNA, 201 bp, Homo sapiens
caaatacacacagagagcaccatgaagccctggattcttctactcgtcatgttcatctctggagttgtgatgcttctgcctgtgctgggaagcttctggamcaaagatccctttctagatatgataagagaaactgagcagtgctgggtacagcctccatataagtactgtgagaaaaggtgtactaaaataatgacttgt

SEQ ID NO: 3464 - DNA, 201 bp, Homo sapiens
cttcagagtattgggaaaagacttgccttctgccagaacttaacccaaatacacacagagagcaccatgaagccctggattcttctactcgtcatgttcayctctggagttgtgatgcttctgcctgtgctgggaagcttctggaacaaagatccctttctagatatgataagagaaactgagcagtgctgggtacagcct

SEQ ID NO: 3465 - DNA, 201 bp, Homo sapiens
agagctgtcagccagttactacagacactcaatgcagacaccttcagagtattgggaaaagacttgccttctgccagaacttaacccaaatacacacagasagcaccatgaagccctggattcttctactcgtcatgttcatctctggagttgtgatgcttctgcctgtgctgggaagcttctggaacaaagatccctttc

SEQ ID NO: 3466 - DNA, 201 bp, Homo sapiens
ctctggacacctcccacgggacctccatctgactgcgccgcctgccctcctgcccaccctcccacccacccgaccagcagagctttttaatacaagaaaayaacaacacaaaccacacacactcgcacacacacacatacacagagactctttcatttttcttgtacatatgtgtaaataatgacagaatggagtggggta

SEQ ID NO: 3467 - DNA, 201 bp, Homo sapiens
agcggtacatggactattcagtggggattctaattaagaagcccgaggagaaaatcagcatcttctccctctttgctccatttgatttcgctgtgtgggcytgcattgcagcagccatccctgtggttggtgtgctgatatttgtgttgaacaggatacaggctgtgagggctcagagtgctgcccagcccaggccgtcag

SEQ ID NO: 3468 - DNA, 201 bp, Homo sapiens
gcaaagacatgcgcaagttggcgacatgggactcagagaagggcttgaatggcagcttgcaagagaggcccatgggcagccgcctccaaggattgactctyaaagtggtgactgtcttggaagagcctttcgtgatggtggctgagaacatcctaggacagcccaagcgctacaaagggttctccatagatgtcctggatg

SEQ ID NO: 3469 - DNA, 201 bp, Homo sapiens
gccccgatggtgaggcctacacactggcttcgagaccacccgtccgcctcaatgatgtcatgctcaggctggtgacggagctgcgctggcagaagttcgtyatgttctacgacagcgagtatgatatccgtgggcttcaaagctttctggaccaggcctcgcggctgggccttgacgtctctttacaaaaggtggacaaga

SEQ ID NO: 3470 - DNA, 201 bp, Homo sapiens
cggagctgcgctggcagaagttcgtcatgttctacgacagcgagtatgatatccgtgggcttcaaagctttctggaccaggcctcgcggctgggccttgaygtctctttacaaaaggtggacaagaacattagccacgtattcaccagcctcttcaccacgatgaagacagaggagctgaatcgctaccgggacacgcttc

SEQ ID NO: 3471 - DNA, 201 bp, Homo sapiens; identical to SEQ ID NO: 3466

SEQ ID NO: 3472 - DNA, 201 bp, Homo sapiens
tccaccagggaagttgcttgtagccccaaaagtaaaggcctatctctgggtcataaatcctgcaggcagtccaacaaacagggctggctccagcacaaacyctcccttccacctttacgaccctctccagaccagacctggagtcctcttcaagcagcaatccaacccagagcaggggccctccccactcaggcatctgat

SEQ ID NO: 3473 - DNA, 201 bp, Homo sapiens
agttgcttgtagccccaaaagtaaaggcctatctctgggtcataaatcctgcaggcagtccaacaaacagggctggctccagcacaaactctcccttccasctttacgaccctctccagaccagacctggagtcctcttcaagcagcaatccaacccagagcaggggccctccccactcaggcatctgataacctctgaga

SEQ ID NO: 3474 - DNA, 201 bp, Homo sapiens
gctccataacacctcctggaacgggatgatcggggagctcatcagcaagagagcagacttggccatctctgccatcaccatcaccccagagagggagagcrttgtggacttcagcaagcggtacatggactattcagtggggattctaattaagaagcccgaggagaaaatcagcatcttctccctctttgctccatttga

SEQ ID NO: 3475 - DNA, 201 bp, Homo sapiens
ctcaggcatctgataacctctgagatttccaggcctatccctgtgcaggtacagctgcagggaagcccagttttctaagcctaggaccacctaacagcgcyccctccttcagttgccctttctgaggcaactaaactacagaatcagggaaagaaccattaggagtggaactgggggaatctgagttgtgtcacttcagtt

SEQ ID NO: 3476 - DNA, 201 bp, Homo sapiens
ccacgatgaagacagaggagctgaatcgctaccgggacacgcttcgccgcgccatcctgctgctcagcccacagggagcccactccttcatcaacgaggcygtggagaccaacctggcttccaaggacagccactgggtctttgtgaatgaggaaatcagtgacccggagatcctggatctggtccatagtgcccttggaa

SEQ ID NO: 3477 - DNA, 201 bp, Homo sapiens; identical to SEQ ID NO: 3470

SEQ ID NO: 3478 - DNA, 201 bp, Homo sapiens; identical to SEQ ID NO: 3467

SEQ ID NO: 3479 - DNA, 201 bp, Homo sapiens; identical to SEQ ID NO: 3474

SEQ ID NO: 3480 - DNA, 201 bp, Homo sapiens; identical to SEQ ID NO: 3468

SEQ ID NO: 3481 - DNA, 201 bp, Homo sapiens; identical to SEQ ID NO: 3469

SEQ ID NO: 3482 - DNA, 201 bp, Homo sapiens; identical to SEQ ID NO: 3476

SEQ ID NO: 3483 - DNA, 201 bp, Homo sapiens; identical to SEQ ID NO: 3467

SEQ ID NO: 3484 - DNA, 201 bp, Homo sapiens; identical to SEQ ID NO: 3468

SEQ ID NO: 3485 - DNA, 201 bp, Homo sapiens; identical to SEQ ID NO: 3469

SEQ ID NO: 3486 - DNA, 201 bp, Homo sapiens; identical to SEQ ID NO: 3470

SEQ ID NO: 3487 - DNA, 201 bp, Homo sapiens; identical to SEQ ID NO: 3466

SEQ ID NO: 3488 - DNA, 201 bp, Homo sapiens; identical to SEQ ID NO: 3472

SEQ ID NO: 3489 - DNA, 201 bp, Homo sapiens; identical to SEQ ID NO: 3473

SEQ ID NO: 3490 - DNA, 201 bp, Homo sapiens; identical to SEQ ID NO: 3474

SEQ ID NO: 3491 - DNA, 201 bp, Homo sapiens; identical to SEQ ID NO: 3475

SEQ ID NO: 3492 - DNA, 201 bp, Homo sapiens; identical to SEQ ID NO: 3476

SEQ ID NO: 3493 - DNA, 201 bp, Homo sapiens
tttgtttggcaaatgttactcctgtattgagtaagtctaacattacgtcccttttctttttggggaggggtagccagaggagtgagtttttcatttagatsaacattgatcaaccattaagacaagatagttgaagacatgtatgtggactgtcaacaaaaataacattttttgaaaagcttttattttcaacatgtaaaa

SEQ ID NO: 3494 - DNA, 201 bp, Homo sapiens
aaaggcggcgccctgaagaagtgcaagagcagaggccttctctagaccttgccaagatggcacagaactgtcagaccttcagcagcctcagctgcctgagygcagggacagaggactgcggtccccagagccccttcgcccgccacgtcagcaacaccagggcctggaccgccctgctctcagcctccggcccagggggca

SEQ ID NO: 3495 - DNA, 201 bp, Homo sapiens
ccctctggccccacactggcaatgatgccacaccttgccatgtccacgctgttggtcaaacccctctgtcatgcctctttaaagagaaaagaagagaaagattttttttttttttaatggcagaccgaagtggagatcttgtagcctagataggatagtctgaccttctagcatagtctttttggcaaatgatttgtgttt

SEQ ID NO: 3496 - DNA, 201 bp, Homo sapiens
acatgagcagttttcctttgtggaatactgtcctccctcagccaacagcacacctgcctcaacaccagagctggcgagacgctccagcggcctttcccgcwgccgctcccagccgtgtgtccttaacgacaagaaggtcggtgttaaaaggcggcgccctgaagaagtgcaagagcagaggccttctctagaccttgccaa

SEQ ID NO: 3497 - DNA, 201 bp, Homo sapiens
cctctggccccacactggcaatgatgccacaccttgccatgtccacgctgttggtcaaacccctctgtcatgcctctttaaagagaaaagaagagaaagaktttttttttttttaatggcagaccgaagtggagatcttgtagcctagataggatagtctgaccttctagcatagtctttttggcaaatgatttgtgtttt

SEQ ID NO: 3498 - DNA, 201 bp, Homo sapiens
ccccctagcaagcgccagtgccgctcactgtccttctccgatgagatgtccagttgccggacatcatggaggcccttgggctccaaagtctggactcccgkggaaaagagacgctgctacagcgggggcagcgtccagcgctattccaacggcttcagcaccatgcagaggagttccagcttcagcctcccttcccgggcc

SEQ ID NO: 3499 - DNA, 201 bp, Homo sapiens
  misc_feature (1)...(201): n = A,T,C or G, or insertion/deletion polymorphism (see Tables 1-2)
agactgaggaagggcagagccagaagcaagccgtgccaggccatctgcctgctcatggggtcctaaagcgcgggctaagcctgcaggaaagccggggcggnggggggggcttagtgccacatgcaccccactcattccaaagccaccaaactgccaggggctgccgtccacccgtggggcccaggggctggggccacagcc

SEQ ID NO: 3500 - DNA, 201 bp, Homo sapiens
ggaagggacaagctgtggagctggctgagtcacagccacctccccacctccccgcaagctggtcccatcgaccagcaagcccagccccagggcgcttaggsagaaatgacccagcctcctcagaccccgcctgcctgtcctgtgcccaccacgcagcagtcaggggagaaaatggtggctatcccttctgcttagagaaag

SEQ ID NO: 3501 - DNA, 201 bp, Homo sapiens
gctggcagaaagcccccagccccacagccctgagagatggtgttgctagctcaggtggctgacacatggggtatgccgggcactgggcaggtcccagagcyggggaaccagctcacctctggttgctgtagctcctgccggaggcatgtctacttgtgatcccggacagccgaacccaagagctggtggctctgagcagac

SEQ ID NO: 3502 - DNA, 201 bp, Homo sapiens
tgcgagcaggtgggcagatgagggccctatgcgcactcaggggtgaagggcgtccgctggccactctgcaggggcccctgcaggattccaggcacctcccrtttgtccttgaggactgctggctgtaaccagggcacatcacccacctcaagacaagcccacgcccttgtcagcttagggggagcccagtcctgagggctg

SEQ ID NO: 3503 - DNA, 201 bp, Homo sapiens
gagcgtggcagccaccaggtccacagaactactgcagcccagaggacagctttgaagtttgcgtcttttctgcctctttccctgtgggatgttgggcagtstctgttgtccccggcagagctgggcaccgctctgtatccccctggtggtgggggctgtcagggagggcctggggtgggggccaggggccatctgctatgt

SEQ ID NO: 3504 - DNA, 201 bp, Homo sapiens
tgggtgttgccgtgcttcaggaagtgtggcgaccagaaagcgtagacccggggcccagggtctgcccgcccctgcagcctggcctccccgcacaggctgtrgcttgcactccagccgctctagtctctcaggaatttgcttgttacttgtactgtgtaaataaagcttcctggttcaatacccaagtgcctggtgccagct

SEQ ID NO: 3505 - DNA, 201 bp, Homo sapiens
gctgtttctggggctgcaggggcttccctgagctggatgttgtgggtgttgccgtgcttcaggaagtgtggcgaccagaaagcgtagacccggggcccagrgtctgcccgcccctgcagcctggcctccccgcacaggctgtggcttgcactccagccgctctagtctctcaggaatttgcttgttacttgtactgtgtaa

SEQ ID NO: 3506 - DNA, 201 bp, Homo sapiens; identical to SEQ ID NO: 3494

SEQ ID NO: 3507 - DNA, 201 bp, Homo sapiens; identical to SEQ ID NO: 3495

SEQ ID NO: 3508 - DNA, 201 bp, Homo sapiens; identical to SEQ ID NO: 3496

SEQ ID NO: 3509 - DNA, 201 bp, Homo sapiens; identical to SEQ ID NO: 3497

SEQ ID NO: 3510 - DNA, 201 bp, Homo sapiens; identical to SEQ ID NO: 3498

SEQ ID NO: 3511 - DNA, 201 bp, Homo sapiens
  misc_feature (1)...(201): n = A,T,C or G, or insertion/deletion polymorphism (see Tables 1-2)
agactgaggaagggcagagccagaagcaagccgtgccaggccatctgcctgctcatggggtcctaaagcgcgggctaagcctgcaggaaagccggggcggnggggggggcttagtgccacatgcaccccactcattccaaagccaccaaactgccaggggctgccgtccacccgtggggagcttgttctgaccagacgtac

SEQ ID NO: 3512 - DNA, 201 bp, Homo sapiens; identical to SEQ ID NO: 3500

SEQ ID NO: 3513 - DNA, 201 bp, Homo sapiens; identical to SEQ ID NO: 3501

SEQ ID NO: 3514 - DNA, 201 bp, Homo sapiens; identical to SEQ ID NO: 3502

SEQ ID NO: 3515 - DNA, 201 bp, Homo sapiens; identical to SEQ ID NO: 3503

SEQ ID NO: 3516 - DNA, 201 bp, Homo sapiens; identical to SEQ ID NO: 3504

SEQ ID NO: 3517 - DNA, 201 bp, Homo sapiens; identical to SEQ ID NO: 3505

SEQ ID NO: 3518 - DNA, 201 bp, Homo sapiens; identical to SEQ ID NO: 3494

SEQ ID NO: 3519 - DNA, 201 bp, Homo sapiens; identical to SEQ ID NO: 3495

SEQ ID NO: 3520 - DNA, 201 bp, Homo sapiens; identical to SEQ ID NO: 3496

SEQ ID NO: 3521 - DNA, 201 bp, Homo sapiens; identical to SEQ ID NO: 3497

SEQ ID NO: 3522 - DNA, 201 bp, Homo sapiens; identical to SEQ ID NO: 3498

SEQ ID NO: 3523 - DNA, 201 bp, Homo sapiens; identical to SEQ ID NO: 3511
  misc_feature (1)...(201): n = A,T,C or G, or insertion/deletion polymorphism (see Tables 1-2)

SEQ ID NO: 3524 - DNA, 201 bp, Homo sapiens; identical to SEQ ID NO: 3500

SEQ ID NO: 3525 - DNA, 201 bp, Homo sapiens; identical to SEQ ID NO: 3501

SEQ ID NO: 3526 - DNA, 201 bp, Homo sapiens; identical to SEQ ID NO: 3502

SEQ ID NO: 3527 - DNA, 201 bp, Homo sapiens; identical to SEQ ID NO: 3503

SEQ ID NO: 3528 - DNA, 201 bp, Homo sapiens; identical to SEQ ID NO: 3504

SEQ ID NO: 3529 - DNA, 201 bp, Homo sapiens; identical to SEQ ID NO: 3505

SEQ ID NO: 3530 - DNA, 201 bp, Homo sapiens; identical to SEQ ID NO: 3494

SEQ ID NO: 3531 - DNA, 201 bp, Homo sapiens; identical to SEQ ID NO: 3495

SEQ ID NO: 3532 - DNA, 201 bp, Homo sapiens; identical to SEQ ID NO: 3496

SEQ ID NO: 3533 - DNA, 201 bp, Homo sapiens; identical to SEQ ID NO: 3497

SEQ ID NO: 3534 - DNA, 201 bp, Homo sapiens; identical to SEQ ID NO: 3498

SEQ ID NO: 3535 - DNA, 201 bp, Homo sapiens; identical to SEQ ID NO: 3499
  misc_feature (1)...(201): n = A,T,C or G, or insertion/deletion polymorphism (see Tables 1-2)

SEQ ID NO: 3536 - DNA, 201 bp, Homo sapiens; identical to SEQ ID NO: 3500

SEQ ID NO: 3537 - DNA, 201 bp, Homo sapiens; identical to SEQ ID NO: 3501

SEQ ID NO: 3538 - DNA, 201 bp, Homo sapiens; identical to SEQ ID NO: 3502

SEQ ID NO: 3539 - DNA, 201 bp, Homo sapiens; identical to SEQ ID NO: 3503

SEQ ID NO: 3540 - DNA, 201 bp, Homo sapiens; identical to SEQ ID NO: 3504

SEQ ID NO: 3541 - DNA, 201 bp, Homo sapiens; identical to SEQ ID NO: 3505

SEQ ID NO: 3542 - DNA, 201 bp, Homo sapiens; identical to SEQ ID NO: 3494

SEQ ID NO: 3543 - DNA, 201 bp, Homo sapiens; identical to SEQ ID NO: 3495

SEQ ID NO: 3544 - DNA, 201 bp, Homo sapiens; identical to SEQ ID NO: 3496

SEQ ID NO: 3545 - DNA, 201 bp, Homo sapiens; identical to SEQ ID NO: 3497

SEQ ID NO: 3546 - DNA, 201 bp, Homo sapiens; identical to SEQ ID NO: 3498

SEQ ID NO: 3547 - DNA, 201 bp, Homo sapiens; identical to SEQ ID NO: 3499
  misc_feature (1)...(201): n = A,T,C or G, or insertion/deletion polymorphism (see Tables 1-2)

SEQ ID NO: 3548 - DNA, 201 bp, Homo sapiens; identical to SEQ ID NO: 3500

SEQ ID NO: 3549 - DNA, 201 bp, Homo sapiens; identical to SEQ ID NO: 3501

SEQ ID NO: 3550 - DNA, 201 bp, Homo sapiens; identical to SEQ ID NO: 3502

SEQ ID NO: 3551 - DNA, 201 bp, Homo sapiens; identical to SEQ ID NO: 3503

SEQ ID NO: 3552 - DNA, 201 bp, Homo sapiens; identical to SEQ ID NO: 3504

SEQ ID NO: 3553 - DNA, 201 bp, Homo sapiens; identical to SEQ ID NO: 3505

SEQ ID NO: 3554 - DNA, 198 bp, Homo sapiens
gctgttcttggtggagcgatttgtctggctaattccgataataaacgagactctggcatgctaactcattatgcgaccccagagtggtcagcgtcctsaaacttcttagagggacaagtggcattcagccacccgagattgagcagtaacaggtctgtgatgcccttagatgtccggggctgcatgtgtgttacactg

SEQ ID NO: 3555 - DNA, 201 bp, Homo sapiens
aaaaatggaccaaggttaacacgttgatgagtcaggggctcccacgaaagccgctgtggagcaatgaagaaaatgtgttggttgatatagacagcaggacrgtggccatggaagttggaatctgctaaggagtgtgtaacaactcacctgctgaatcaactagccctgaaaatggatggtgctggagcgtccggcccatac

SEQ ID NO: 3556 - DNA, 201 bp, Homo sapiens
agtggtcagcgtcctcaaacttcttagagggacaagtggcattcagccacccgagattgagcagtaacaggtctgtgatgcccttagatgtccggggctgmatgtgtgttacactggctcagcgtgtgcctaccctatgctggcaggtgcgggtaacccattgaacctcatttgtgatggggatgggggattgcaattatt

SEQ ID NO: 3557 - DNA, 118 bp, Homo sapiens
tagacagcaggacagtggccatggaagttggaatctgctaaggagtgtgtaacaactcacctgctgaatcaactagccctgaaaatggatggtgctggagygtccggcccatacccgg

SEQ ID NO: 3558 - DNA, 201 bp, Homo sapiens
aaacttcttagagggacaagtggcattcagccacccgagattgagcagtaacaggtctgtgatgcccttagatgtccggggctgcatgtgtgttacactgsctcagcgtgtgcctaccctatgctggcaggtgcgggtaacccattgaacctcatttgtgatggggatgggggattgcaattattccccatgaatgagcaa

SEQ ID NO: 3559 - DNA, 201 bp, Homo sapiens
ctttagggtgtctgtcagtttacatttggggctttcccgtgatcggattcaggatttacatttttggcaggaacagcacagaaatgatgctgtgacccacrtgcatcacattaggggcccatgatgtgggactgcgctttccttgctgctgttaacttttatcagttaaggttgtgttttccgcattgtgaagatactgtt

SEQ ID NO: 3560 - DNA, 201 bp, Homo sapiens
ttcagatttttattggactttctcggctttgacattttggagagtgaggtgttattctttagggtgtctgtcagtttacatttggggctttcccgtgatcrgattcaggatttacatttttggcaggaacagcacagaaatgatgctgtgacccacatgcatcacattaggggcccatgatgtgggactgcgctttccttg

SEQ ID NO: 3561 - DNA, 201 bp, Homo sapiens
ccttctacccataagtactttttcagtgtgtacatcttaagaatcaggactttctcttccataaccacagtccatcagatgcaggaaataagacaataatrcaatactatgacttagcccacagttcatgttcaaatcttaccgatcaccatgcctctttggtcttgcttaatctgaaacagttcagatttttattggact

SEQ ID NO: 3562 - DNA, 201 bp, Homo sapiens
gcaacctctgcctcccgggttcaagtgcttctcctgcctcagcctcccgattacaggcatgcaccaccatgcccggctaattttgtatttttagtagagayagcgtttctccatgttaggctggtctcaatctcctgacctcaggtgatctgcccgcctcggtctcccaaagtgctggaattataggcgtgagccaccacg

SEQ ID NO: 3563 - DNA, 201 bp, Homo sapiens
gtatgtgactcttccttggaaaaaataatctctcagaaaaggacttctaatacatcctcagggtagaatgtgtttccgtgattactttttttttttgagayggagtttcgctcttgttgcccaggctggagtgcaatggcgtgatcttagctcactgcaacctctgcctcccgggttcaagtgcttctcctgcctcagcct

SEQ ID NO: 3564 - DNA, 201 bp, Homo sapiens; identical to SEQ ID NO: 3559

SEQ ID NO: 3565 - DNA, 201 bp, Homo sapiens; identical to SEQ ID NO: 3560

SEQ ID NO: 3566 - DNA, 201 bp, Homo sapiens; identical to SEQ ID NO: 3561

SEQ ID NO: 3567 - DNA, 201 bp, Homo sapiens; identical to SEQ ID NO: 3562

SEQ ID NO: 3568 - DNA, 201 bp, Homo sapiens; identical to SEQ ID NO: 3563

SEQ ID NO: 3569 - DNA, 201 bp, Homo sapiens
atccacttccgtggttttgctgtcatttctcttgatgccatattttcaggtccctcgtgggagggggcataaggtctccatcgtgatgccctctctgcagctgtccagccagcagtgagtgggcccacacatgtgcattcctgtgcttgaattgccaaataaacagtgtccctttcattgctgcccaaacagactggaagc

SEQ ID NO: 3570 - DNA, 201 bp, Homo sapiens
aatccacttccgtggttttgctgtcatttctcttgatgccatattttcaggtccctcgtgggagggggcataaggtctccatcgtgatgccctctctgcagctgtccagccagcagtgagtgggcccacacatgtgcattcctgtgcttgaattgccaaataaacagtgtccctttcattgctgcccaaacagactggaag

SEQ ID NO: 3571 - DNA, 201 bp, Homo sapiens
tccagctctttgcacacattcttcccgcttgcaggaatggaatccaaacacctgatacggaatgatgacttggcagtggggagtggggcagcttgtctccrctaacttaggaccaaaactaggaaactcaccatgagcatgtgttggagatcagctgtggcctccagcccctgtacacacagaggcaagccccacctctga

SEQ ID NO: 3572 - DNA, 201 bp, Homo sapiens
ggtatccccattggccactggtggaggtgcactggaaggtcagggccttgacaccacagagccaagcaacacacacctccttgggcccaggccccagcacrgtggccctccagtgctggcaggtggcctcacccacagcaggggaggcgtgggtcctccaatgaccttcctgcccctgccagatgattttcacaactacct

SEQ ID NO: 3573 - DNA, 201 bp, Homo sapiens
aggcccccgggtatccccattggccactggtggaggtgcactggaaggtcagggccttgacaccacagagccaagcaacacacacctccttgggcccaggycccagcacggtggccctccagtgctggcaggtggcctcacccacagcaggggaggcgtgggtcctccaatgaccttcctgcccctgccagatgattttca

SEQ ID NO: 3574 - DNA, 201 bp, Homo sapiens
taatccacttccgtggttttgctgtcatttctcttgatgccatattttcaggtccctcgtgggagggggcataaggtctccatcgtgatgccctctctgcagctgtccagccagcagtgagtgggcccacacatgtgcattcctgtgcttgaattgccaaataaacagtgtccctttcattgctgcccaaacagactggaa

SEQ ID NO: 3575 - DNA, 201 bp, Homo sapiens
gtccttcccagttcaacacgggtggcagcagatggcccagcccagggaaagtccacctgaccattagaaggactcatcctccagccaccaaagcaaggctrcagaggaagaggagcttgtcacaaacattaaccggctcagggctgggtaactgcattgacaaatttggaagcagcagggccagagagccaaggcccccgg

SEQ ID NO: 3576 - DNA, 201 bp, Homo sapiens
aagcttcttatgggacttttgtcctactgtggcctggttaaaggctttgtcctcctgtttaatccacttccgtggttttgctgtcatttctcttgatgccrtattttcaggtccctcgtgggagggggcataaggtctccatcgtgatgccctctctgcagctgtccagccagcagtgagtgggcccacacatgtgcattc

SEQ ID NO: 3577 - DNA, 159 bp, Homo sapiens
gtgatatcactgggctccagcaagggcaaggccagcttcgcaggtgacgatgccccgtyggccgccttcccctccatcttggggcgcccgcgacaccagggcatgatggtgggcatgggccagaaggactccaatgtgggcgatgaggcccagagcaag

SEQ ID NO: 3578 - DNA, 201 bp, Homo sapiens
ggcgacaggtcacccacattgtgtgcatatatgaggggcacgccctcccccacaccatcctgcgtctggatctcgctggccaggacctgaccgaccgcctyatgaagatcctcacattgtgcggctacagctttaccacccgcagagggagagctcctgtgtgacatcatcaaggagaagctgtgctaagtcgccctggac

SEQ ID NO: 3579 - DNA, 201 bp, Homo sapiens
agaagctgtgctaagtcgccctggactttgagcaggagatggccccacgggtcctcctgggagaagagctatgagctgtcagatggccaggtcatcaccakcagcaacaagcggttccactgccccgaggcgctcttccagccttctttcctgggcatggaatcctgtggcatctacaaaactaccttcaaatccatcgtg

SEQ ID NO: 3580 - DNA, 201 bp, Homo sapiens
  misc_feature (1)...(201): n = A,T,C or G, or insertion/deletion polymorphism (see Tables 1-2)
accatcctgcgtctggatctcgctggccaggacctgaccgaccgccttatgaagatcctcacattgtgcggctacagctttaccacccgcagagggagagntcctgtgtgacatcatcaaggagaagctgtgctaagtcgccctggactttgagcaggagatggccccacgggtcctcctgggagaagagctatgagctgt

SEQ ID NO: 3581 - DNA, 201 bp, Homo sapiens
ttggttacccaccacacccccaacaattccacaagcattgaatataatcacagcacattcagaaaaaatacttgcttcagaatctatacgagctgctgtgrataggcgcatcagagggtaggtcacattcactaaatgtctatatgcacaattggtgcaacaaaggtttgtgccagaccggcggagtggatacaggctgcc

SEQ ID NO: 3582 - DNA, 201 bp, Homo sapiens
caatatacccttggagtaattctaaatatttaaatttctcccttactgctattcatcctcagatcaaaatttcaagttgacaaatttggatttgaaaactsattcactttttcaatttttttaatgaggcataacatgcatatggttaagtgcacaaatcttaagtgtacagtcagtgaatttttgcatgtatgtatgtac

SEQ ID NO: 3583 - DNA, 201 bp, Homo sapiens
aaatttctcccttactgctattcatcctcagatcaaaatttcaagttgacaaatttggatttgaaaactcattcactttttcaatttttttaatgaggcayaacatgcatatggttaagtgcacaaatcttaagtgtacagtcagtgaatttttgcatgtatgtatgtacctgaagcaagatatagaacttatttacttgt

SEQ ID NO: 3584 - DNA, 201 bp, Homo sapiens
aagggagcagagctgcctcgagaaccttctgaggctccaatcacttttgatgcagattcttttcttaattattttgataagattttagggccaaggcctartgagtcagattctgatgatctggatgatgaagactttgaatgtttagatagtgatgatgacttggactttgaaacacacgaacctggcgaagaggcttcc

SEQ ID NO: 3585 - DNA, 201 bp, Homo sapiens
  misc_feature (1)...(201): n = A,T,C or G, or insertion/deletion polymorphism (see Tables 1-2)
gacacagtggagtactgcctgttcctgataccagatgagtcaagggactcagataaacataaagagattcttcagaagtacattgagagaataatcactcngtttgcacctatgctggtcccctacatctggcagaatcagcctttcaatcttaaatataaacctgggaaaggaggtgttcctgctcatatgtttggcgtg

SEQ ID NO: 3586 - DNA, 201 bp, Homo sapiens
  misc_feature (1)...(201): n = A,T,C or G, or insertion/deletion polymorphism (see Tables 1-2)
gtttcaaatatattggaatcctatagctcccaagctggactggcaggacctgcttccaatcttttacaaagcatgggagtgcagctgcctgacaacaccgntcacagaccaacaagtaagccaacaaaaaattaaccagcacatttagcttctcttttttctttttaaataaatattgaatatgattctgttcatttctag

SEQ ID NO: 3587 - DNA, 201 bp, Homo sapiens
  misc_feature (1)...(201): n = A,T,C or G, or insertion/deletion polymorphism (see Tables 1-2)
aagccaacaaaaaattaaccagcacatttagcttctcttttttctttttaaataaatattgaatatgattctgttcatttctagtttagattactcatttngtaaaaatgtttcttcattacaagttttacagattgacttctccatgagccccaaatgtggccctcttggcacaagtctttgtgatctcagctgtgggtt

SEQ ID NO: 3588 - DNA, 201 bp, Homo sapiens
agcagaactatgacttaactgaagtctcagagagcatgaaagctttcatatccaaagtctcaacccacaagggagcagagctgcctcgagaaccttctgargctccaatcacttttgatgcagattcttttcttaattattttgataagattttagggccaaggcctaatgagtcagattctgatgatctggatgatgaag

SEQ ID NO: 3589 - DNA, 201 bp, Homo sapiens
ccaggaactagcacacacctgcatcagcaaaagtttcaccactaggaaccaagtggaacctgtatcccagactaccgataacaattcagatgaggaagatkctggtacgggagaatctgttatggcaccagtagatgtagacctgaacctggtttcaaatatattggaatcctatagctcccaagctggactggcaggacc

SEQ ID NO: 3590 - DNA, 201 bp, Homo sapiens
tgttaatagaagctgctgactttctccctaaatggctggatcctgaaaatagcaccaatagggtatttttctgccatggggaattgtgtattatccctgcwccaagaaaatctggagcagaatcttggttacccaccacacccccaacaattccacaagcattgaatataatcacagcacattcagaaaaaatacttgctt

SEQ ID NO: 3591 - DNA, 201 bp, Homo sapiens
ctcaccagatcagctggaccagctgctgcaggaagctgttggcaaaaaagaatccgagtctgtttccaaggaggagaaggagcagaactatgacttaactsaagtctcagagagcatgaaagctttcatatccaaagtctcaacccacaagggagcagagctgcctcgagaaccttctgaggctccaatcacttttgatgc

SEQ ID NO: 3592 - DNA, 201 bp, Homo sapiens
agtcggagaggcggctaaggaaaggtgccacagcagagacgcgaaggagaggccctagaaccttttcaaagaagaatggaagaaaccatgaagcttgctamgatggaagacacagtggagtactgcctgttcctgataccagatgagtcaagggactcagataaacataaagagattcttcagaagtacattgagagaata

SEQ ID NO: 3593 - DNA, 201 bp, Homo sapiens
ggaggagaaggagcagaactatgacttaactgaagtctcagagagcatgaaagctttcatatccaaagtctcaacccacaagggagcagagctgcctcgaraaccttctgaggctccaatcacttttgatgcagattcttttcttaattattttgataagattttagggccaaggcctaatgagtcagattctgatgatct

SEQ ID NO: 3594 - DNA, 201 bp, Homo sapiens
ttcccccagaggatgatgaccagtggttagatctctcaccagatcagctggaccagctgctgcaggaagctgttggcaaaaaagaatccgagtctgtttcyaaggaggagaaggagcagaactatgacttaactgaagtctcagagagcatgaaagctttcatatccaaagtctcaacccacaagggagcagagctgcctc

SEQ ID NO: 3595 - DNA, 201 bp, Homo sapiens
aagcagctaatcttcccccagaggatgatgaccagtggttagatctctcaccagatcagctggaccagctgctgcaggaagctgttggcaaaaaagaatcygagtctgtttccaaggaggagaaggagcagaactatgacttaactgaagtctcagagagcatgaaagctttcatatccaaagtctcaacccacaagggag

SEQ ID NO: 3596 - DNA, 144 bp, Homo sapiens
aattgtgcaaccatccctaccatctaattctagaatattagaaaccccatactcactaatagtctctcattcccttctactcccagcccctagaaaccacwagtctactttctgtctctatggatttgcctattttggatattt

SEQ ID NO: 3597 - DNA, 201 bp, Homo sapiens
ccactaggaaccaagtggaacctgtatcccagactaccgataacaattcagatgaggaagattctggtacgggagaatctgttatggcaccagtagatgtwgacctgaacctggtttcaaatatattggaatcctatagctcccaagctggactggcaggacctgcttccaatcttttacaaagcatgggagtgcagctgc

SEQ ID NO: 3598 - DNA, 201 bp, Homo sapiens
ttggttacccaccacacccccaacaattccacaagcattgaatataatcacagcacattcagaaaaaatacttgcttcagaatctatacgagctgctgtgrataggcgcatcagaggggtcacattcactaaatgtctatatgcacaattggtgcaacaaaggtttgtgccagaccggcggagtggatacaggctgcctcc

SEQ ID NO: 3599 - DNA, 201 bp, Homo sapiens; identical to SEQ ID NO: 3582

SEQ ID NO: 3600 - DNA, 201 bp, Homo sapiens; identical to SEQ ID NO: 3583

SEQ ID NO: 3601 - DNA, 201 bp, Homo sapiens; identical to SEQ ID NO: 3585
  misc_feature (1)...(201): n = A,T,C or G, or insertion/deletion polymorphism (see Tables 1-2)

SEQ ID NO: 3602 - DNA, 201 bp, Homo sapiens; identical to SEQ ID NO: 3584

SEQ ID NO: 3603 - DNA, 201 bp, Homo sapiens; identical to SEQ ID NO: 3586
  misc_feature (1)...(201): n = A,T,C or G, or insertion/deletion polymorphism (see Tables 1-2)

SEQ ID NO: 3604 - DNA, 201 bp, Homo sapiens; identical to SEQ ID NO: 3587
  misc_feature (1)...(201): n = A,T,C or G, or insertion/deletion polymorphism (see Tables 1-2)

SEQ ID NO: 3605 - DNA, 201 bp, Homo sapiens; identical to SEQ ID NO: 3588

SEQ ID NO: 3606 - DNA, 201 bp, Homo sapiens; identical to SEQ ID NO: 3589

SEQ ID NO: 3607 - DNA, 201 bp, Homo sapiens; identical to SEQ ID NO: 3590

SEQ ID NO: 3608 - DNA, 201 bp, Homo sapiens; identical to SEQ ID NO: 3591

SEQ ID NO: 3609 - DNA, 201 bp, Homo sapiens; identical to SEQ ID NO: 3592

SEQ ID NO: 3610 - DNA, 201 bp, Homo sapiens; identical to SEQ ID NO: 3593

SEQ ID NO: 3611 - DNA, 201 bp, Homo sapiens; identical to SEQ ID NO: 3594

SEQ ID NO: 3612 - DNA, 201 bp, Homo sapiens; identical to SEQ ID NO: 3595

SEQ ID NO: 3613 - DNA, 144 bp, Homo sapiens; identical to SEQ ID NO: 3596

SEQ ID NO: 3614 - DNA, 201 bp, Homo sapiens; identical to SEQ ID NO: 3597

SEQ ID NO: 3615 - DNA, 201 bp, Homo sapiens
ttggttacccaccacacccccaacaattccacaagcattgaatataatcacagcacattcagaaaaaatacttgcttcagaatctatacgagctgctgtgrataggcgcatcagagggtacccagaaaaaattcaggcctcacttcatcgagcacactgcttccttccagctggcattgtggcagtgctaaagcagcgccc

SEQ ID NO: 3616 - DNA, 201 bp, Homo sapiens; identical to SEQ ID NO: 3589

SEQ ID NO: 3617 - DNA, 201 bp, Homo sapiens; identical to SEQ ID NO: 3584

SEQ ID NO: 3618 - DNA, 201 bp, Homo sapiens; identical to SEQ ID NO: 3590

SEQ ID NO: 3619 - DNA, 201 bp, Homo sapiens; identical to SEQ ID NO: 3593

SEQ ID NO: 3620 - DNA, 201 bp, Homo sapiens; identical to SEQ ID NO: 3591

SEQ ID NO: 3621 - DNA, 201 bp, Homo sapiens; identical to SEQ ID NO: 3594

SEQ ID NO: 3622 - DNA, 201 bp, Homo sapiens; identical to SEQ ID NO: 3595

SEQ ID NO: 3623 - DNA, 201 bp, Homo sapiens; identical to SEQ ID NO: 3592

SEQ ID NO: 3624 - DNA, 201 bp, Homo sapiens; identical to SEQ ID NO: 3585
  misc_feature (1)...(201): n = A,T,C or G, or insertion/deletion polymorphism (see Tables 1-2)

SEQ ID NO: 3625 - DNA, 201 bp, Homo sapiens; identical to SEQ ID NO: 3597

SEQ ID NO: 3626 - DNA, 193 bp, Homo sapiens
  misc_feature (1)...(193): n = A,T,C or G, or insertion/deletion polymorphism (see Tables 1-2)
gtttcaaatatattggaatcctatagctcccaagctggactggcaggacctgcttccaatcttttacaaagcatgggagtgcagctgcctgacaacaccgntcacagaccaacaagtaagccaacaaaaaattaaccagcacatttagcttctcttttttctttttaaataaatattgaatatgattctgttc

SEQ ID NO: 3627 - DNA, 201 bp, Homo sapiens; identical to SEQ ID NO: 3588

SEQ ID NO: 3628 - DNA, 194 bp, Homo sapiens
gcggtcaggggcctgtggaaccctagaggatggagcaggtggacagcaggggtgggcaaccctgccagctgggtactagggctattggggctggagggtcyaccccactgtactctagccacaaggctgtggggtggctgctttgcccaccagctgtccccctgataggggatctgggctgcaatacttctgta

SEQ ID NO: 3629 - DNA, 201 bp, Homo sapiens
gctgagggggtgctcctcccctccccccaggcactgacacattgaaaggaagcagagcaacaatgacacagcacggatgtgggaaaggggatcccccacgsgggcaggatggtccatctcaccggggtctcaccaggactccccgctcccacccagggccagcacgagcacctcccgttttctccccagtgcagagcgtgg

SEQ ID NO: 3630 - DNA, 201 bp, Homo sapiens
acacgtgtgcgccgcaaggctgggcctgtctcagcccacttcccgtcgccacccccaacggcctgagctcccccggagcctcactcgggcctttcctcagrccctcctgtctgctccacgtggggcgccggggcctcgaaccgcccgtcccctccagccgagtttccccacccgccaggccaccgcggcgtcggggtccca

SEQ ID NO: 3631 - DNA, 201 bp, Homo sapiens
cctttcctcagaccctcctgtctgctccacgtggggcgccggggcctcgaaccgcccgtcccctccagccgagtttccccacccgccaggccaccgcggcrtcggggtcccatacctgatgctgttgtcgcccctgctggtaaggcttaattggcccctggtggcaacgccgcgtccggatcttgccgccaccgccccctc

SEQ ID NO: 3632 - DNA, 201 bp, Homo sapiens
tggggcgccggggcctcgaaccgcccgtcccctccagccgagtttccccacccgccaggccaccgcggcgtcggggtcccatacctgatgctgttgtcgcycctgctggtaaggcttaattggcccctggtggcaacgccgcgtccggatcttgccgccaccgccccctccgactcctccggctcccgaggccatggcgga

SEQ ID NO: 3633 - DNA, 201 bp, Homo sapiens
agaactgttccttcagccaaagaaacaagccgtggaataggtgtatcaagtaatggtgcaaagcctgaagtaagtattctaggtttgtcggaacaaaactrtcagaaagccaactgtcaaatctgattagccacttatatcttagactatactttttgggaagtctagagatgtatataatgtgctaaattcaaagtagca

SEQ ID NO: 3634 - DNA, 201 bp, Homo sapiens
tctaagctatttacagagtgtttgtagctttcatttgcagcattatgttcccacaaattctgtactcagcatatacagtatagtttatctgctctatttcygtcttatagaaatcatgaatgtggtctgcagacattgatgaagaaaatctgttggtaattgatacatgggctaaagcatcagaggtttaatttgaagttt

SEQ ID NO: 3635 - DNA, 201 bp, Homo sapiens
aggcgccaccagcggaagtacaggcgctactcgcggtcatactcgcggagccggtcgcgatcccgcagccgccgttaccgagagaggcgctacgggttcamcaggagatactaccggtctccttcgcggtaccggtcccggtcccgtagcaggtcgcgctctcggggaaggtcgtactgcggaagggcgtacgcgatcgcg

SEQ ID NO: 3636 - DNA, 201 bp, Homo sapiens
gtcggaggagcaagtccaggtcccgttcccgaaggcgccaccagcggaagtacaggcgctactcgcggtcatactcgcggagccggtcgcgatcccgcagycgccgttaccgagagaggcgctacgggttcaccaggagatactaccggtctccttcgcggtaccggtcccggtcccgtagcaggtcgcgctctcggggaa

SEQ ID NO: 3637 - DNA, 201 bp, Homo sapiens
ttgccagcagggaagtaaaataattatgggaagagtgtcttaagcctaatattaaatcagttttgttaaggggaaaactcaatagttctgttacttaggcrgttagatccaagttgatttttgtgtctacagctaaattttgtttacaattaggctattttttaatataggatttagaaaccaagggtatgtgttttaaaa

SEQ ID NO: 3638 - DNA, 201 bp, Homo sapiens
gaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctg

SEQ ID NO: 3639 - DNA, 139 bp, Homo sapiens
cgcgtctgctaacgtagtccctcagtgcgcatccggacktaggaggtggaggttgtggaattcgccgttcgaaagcagggactaaaagccccacttcgtcttacgttccgaaaggaaggcgtctgttgagcctttctct

SEQ ID NO: 3640 - DNA, 201 bp, Homo sapiens
ggagcacagcagatggagggacagatccaggacgaggtcgcggagcagaaccccctttcgcttaagtgaaaaagatcgaatggagctgttagaaatagcaraaaccaatgcagcgaaagctctaggaacaaccaacattgacttgccagctagtctcagaactgttccttcagccaaagaaacaagccgtggaataggtgt

SEQ ID NO: 3641 - DNA, 201 bp, Homo sapiens; identical to SEQ ID NO: 3635

SEQ ID NO: 3642 - DNA, 201 bp, Homo sapiens; identical to SEQ ID NO: 3636

SEQ ID NO: 3643 - DNA, 139 bp, Homo sapiens; identical to SEQ ID NO: 3639

SEQ ID NO: 3644 - DNA, 201 bp, Homo sapiens
atcctttccggagaaagcgcaggctaaagccgcaggtgaagatgtccaactacgtgaacgacatgtggccgggctcgccgcaggagaaggattcgccctckacctcgcggtcgggcgggtccagccggctgtcgtcgcggtctaggagccgctctttttccagaagctctcggtcccattcccgcgtctcgagccggtttt

SEQ ID NO: 3645 - DNA, 201 bp, Homo sapiens
tcagccaaagaaacaagccgtggaataggtgtatcaagtaatggtgcaaagcctgaactgtcggaaaaggtaacagaagatggaactcgaaatcccaatgraaaacctacccagcaaagaagcatagcttttagctctaataattctgtagcaaagccaatacaaaaatcagctaaagctgccacagaagaggcatcttca

SEQ ID NO: 3646 - DNA, 201 bp, Homo sapiens
ggtcgtactgcggaagggcgtacgcgatcgcgcggggacagcgctactacggctttggtcgcacagtgtacccggaggagcacagcagatggagggacagmtccaggacgaggtcgcggagcagaaccccctttcgcttaagtgaaaaagatcgaatggagctgttagaaatagcaaaaaccaatgcagcgaaagctctag

SEQ ID NO: 3647 - DNA, 201 bp, Homo sapiens
ccggtcccgtagcaggtcgcgctctcggggaaggtcgtactgcggaagggcgtacgcgatcgcgcggggacagcgctactacggctttggtcgcacagtgyacccggaggagcacagcagatggagggacagatccaggacgaggtcgcggagcagaaccccctttcgcttaagtgaaaaagatcgaatggagctgttaga

SEQ ID NO: 3648 - DNA, 201 bp, Homo sapiens
tcctgagttgaggcttgcgggatcctttccggagaaagcgcaggctaaagccgcaggtgaagatgtccaactacgtgaacgacatgtggccgggctcgcckcaggagaaggattcgccctcgacctcgcggtcgggcgggtccagccggctgtcgtcgcggtctaggagccgctctttttccagaagctctcggtcccatt

SEQ ID NO: 3649 - DNA, 201 bp, Homo sapiens; identical to SEQ ID NO: 3640

SEQ ID NO: 3650 - DNA, 201 bp, Homo sapiens; identical to SEQ ID NO: 3635

SEQ ID NO: 3651 - DNA, 201 bp, Homo sapiens; identical to SEQ ID NO: 3636

SEQ ID NO: 3652 - DNA, 139 bp, Homo sapiens; identical to SEQ ID NO: 3639

SEQ ID NO: 3653 - DNA, 201 bp, Homo sapiens
ttcctgaaagttgctcaaggaacactttttgaactcattcgggctgcaaactacttagacatcaaaggtttgcttgatgttacatgcaagactgttgccartatgatcaaggggaaaactcctgaggagattcgcaagacattcaatatcaaaaatgactttactgaagaggaggaagcccaggtacgcaaagagaaccag

SEQ ID NO: 3654 - DNA, 201 bp, Homo sapiens
cctgaagatgatgagaacaaagaaaagcaaacagacgatatccctgtttgggaccaagaattcctgaaagttgctcaaggaacactttttgaactcattckggctgcaaactacttagacatcaaaggtttgcttgatgttacatgcaagactgttgccaatatgatcaaggggaaaactcctgaggagattcgcaagaca

SEQ ID NO: 3655 - DNA, 201 bp, Homo sapiens
agtttgtggttttttgggagaaatataactggacagtttgttagcttttcaattaaaaagacacttaacccatgtgggatgtcatgtttttataatcattkttcccatgtggagaaaattattcacactacttgcatgtaaaaaataatttaactttttacattaaaatatgtggtaaaacccagaaagcatccatcatga

SEQ ID NO: 3656 - DNA, 201 bp, Homo sapiens
gggctgcaaactacttagacatcaaaggtttgcttgatgttacatgcaagactgttgccaatatgatcaaggggaaaactcctgaggagattcgcaagacrttcaatatcaaaaatgactttactgaagaggaggaagcccaggtacgcaaagagaaccagtggtgtgaagagaagtgaaatgttgtgcctgacactgtaa

SEQ ID NO: 3657 - DNA, 201 bp, Homo sapiens
  misc_feature (1)...(201): n = A,T,C or G, or insertion/deletion polymorphism (see Tables 1-2)
cagtaggagataataacagcaagtgggtgaagcactgggtaaaaggtggatattattattaccacaatctggagacccaggaaggaggatgggatgaaccnccaaattttgtgcaaaattctatgcagctttctcgggaggagatccagagttctatctctggggtgactgccgcatataaccgagaacagctgtggctgg

SEQ ID NO: 3658 - DNA, 201 bp, Homo sapiens
attgtttttaaaactgttttatatcttaagagtgccttattaaagtatagatgtatgtcttaaaatgtgggtgataggaattttaaagatttatataatgyatcaaaagccttagaataagaaaagctttttttaaattgctttatctgtatatctgaactcttgaaacttatagctaaaacactaggatttatctgcagt

SEQ ID NO: 3659 - DNA, 163 bp, Homo sapiens
gcattctctgtctcctctctctcctcctttgaccttctcctcgaccagccatcatgacatttaccatgaatttacttcctcccaagagtttggactgcccrtcagattgttgctgcacatagttgcctttgtatctctgtatgaaataaaaggtcatttgttc

SEQ ID NO: 3660 - DNA, 201 bp, Homo sapiens
ccgactagtggatgggagagtcccattgctaaaattcagctactcagataaattcagaatgggtcaaggcacctgcctgtttttgttggtgcacagagatygacttgattcagagagacaattcactccatccctatggcagaggaatgggttagccctaatgtagaatgtcattgtttttaaaactgttttatatcttaa

SEQ ID NO: 3661 - DNA, 152 bp, Homo sapiens
  misc_feature (1)...(152): n = A,T,C or G, or insertion/deletion polymorphism (see Tables 1-2)
ctcctctctctcctcctttgaccttctcctcgaccagccatcatgacatttaccatgaatttacttcctcccaagagtttggactgcccgtcagattgttnctgcacatagttgcctttgtatctctgtatgaaataaaaggtcatttgttc

SEQ ID NO: 3662 - DNA, 201 bp, Homo sapiens
accagcagctggagaatgacctcaatctcatggatatcaaaattggactgctagtgaaaaataagattacgttgcaggatgtggtttcccacagtaaaaarcttaccaaaaaaaataaggaacagttgtctgatatgatgatgataaataaacagaagggaggtctcaaggctttgagcaaggagaagagagagaagttgg

SEQ ID NO: 3663 - DNA, 201 bp, Homo sapiens
agaattgtggctttagtagcacagaggatgccccaacaaactcatggcgttgaaaccacacagttctcattactgttatttattagctgtagcattctctktctcctctctctcctcctttgaccttctcctcgaccagccatcatgacatttaccatgaatttacttcctcccaagagtttggactgcccgtcagattgt

SEQ ID NO: 3664 - DNA, 186 bp, Homo sapiens
attactgttatttattagctgtagcattctctgtctcctctctctcctcctttgaccttctcctcgaccagccatcatgacatttaccatgaatttacttyctcccaagagtttggactgcccgtcagattgttgctgcacatagttgcctttgtatctctgtatgaaataaaaggtcatttgttc

SEQ ID NO: 3665 - DNA, 201 bp, Homo sapiens
cctcagattaaaagatgatgctattacaactagcattgcctcaaaaactgggaccaaccaaagtgtgtcaaccctgtttccttaaaagaggctatgaatcmcaaaggccacatccaagacaggcaataatgagcagagtttacagctcctttaataaaatgtgtcagtaattttaaggtttatagttccctcaacacaatt

SEQ ID NO: 3666 - DNA, 201 bp, Homo sapiens
ggtgtttgtttaattagcaatagggatggtaggattcaaatgtgtgtcatttagaagtggaagctattagcaccaatgacataaatacatacaagacacasaactaaaatgtcatgttattaacagttattaggttgtcatttaaaaataaagttcctttatatttctgtcccatcaggaaaactgaaggatatggggaat

SEQ ID NO: 3667 - DNA, 201 bp, Homo sapiens; identical to SEQ ID NO: 3657
  misc_feature (1)...(201): n = A,T,C or G, or insertion/deletion polymorphism (see Tables 1-2)

SEQ ID NO: 3668 - DNA, 201 bp, Homo sapiens; identical to SEQ ID NO: 3658

SEQ ID NO: 3669 - DNA, 201 bp, Homo sapiens
gcacattttcattgctactgtcttcaagcaccccaaatagagaaaacctgggcgtcagtggctcaatttgggccctgatctattctccctctttcttgtckatgttataacagagaggataaacttaaagggtccaaataacggtccgaatacaaaaggcattccttcagtgtgtgactgactcttagggaaatgtgagtt

SEQ ID NO: 3670 - DNA, 201 bp, Homo sapiens
ccaacgaatccacaccggagaaagaccctacaaatgtggagagtgtgggaagagcttcaatcagagctcccactttattacccatcagcgaatccacttakgagacaggccctatcgatgtcctgagtgtggcaagaccttcaatcagcgttcccatttcctcacacaccagagaacgcatacaggagaaaaacctttcca

SEQ ID NO: 3671 - DNA, 201 bp, Homo sapiens; identical to SEQ ID NO: 3660

SEQ ID NO: 3672 - DNA, 201 bp, Homo sapiens
ggtgtttgtttaattagcaatagggatggtaggattcaaatgtgtgtcatttagaagtggaagctattagcaccaatgacataaatacatacaagacacasaactaaaatgtcatgttattaacagttattaggttgtcatttaaaaataaagttcctttatatttctgtcccaaggagataatgtttttaaatttcatta

SEQ ID NO: 3673 - DNA, 201 bp, Homo sapiens; identical to SEQ ID NO: 3662

SEQ ID NO: 3674 - DNA, 201 bp, Homo sapiens; identical to SEQ ID NO: 3657
  misc_feature (1)...(201): n = A,T,C or G, or insertion/deletion polymorphism (see Tables 1-2)

SEQ ID NO: 3675 - DNA, 163 bp, Homo sapiens; identical to SEQ ID NO: 3659

SEQ ID NO: 3676 - DNA, 123 bp, Homo sapiens
ccggtcgggttctgggaggcacmgcctcggggttgcgggccgggtgcggctcggcggtggaggactcacttcctgctccatccccggctgggccctggggcggaactgatgacgcttgataat

SEQ ID NO: 3677 - DNA, 201 bp, Homo sapiens
gagaagcctatgtgtgcagaatgcgggaaaagctttaaccagagttcctatctcataagacacctaagaacccacactggcgagaggccctatacgtgcaytgagtgtgggaaaggcttcaaacagagctcagaccttgtcacccatcgcagaacacacacaggagagaagccctaccaatgcaaggggtgtgagaagaaa

SEQ ID NO: 3678 - DNA, 201 bp, Homo sapiens; identical to SEQ ID NO: 3669

SEQ ID NO: 3679 - DNA, 201 bp, Homo sapiens; identical to SEQ ID NO: 3665

SEQ ID NO: 3680 - DNA, 201 bp, Homo sapiens; identical to SEQ ID NO: 3658

SEQ ID NO: 3681 - DNA, 201 bp, Homo sapiens
gagccatgggtcctaccactccaaaactttgaggcgaggaagatcccgagggaaagccacacagactgtgagcatcaggtggcaaagctcaatcaggacarttctgaaacagcagaacaatgtggaacatcctcagaaaggaccaataaagatctttctcatactcttagttggggaggaaactgggagcaaggcctagaa

SEQ ID NO: 3682 - DNA, 201 bp, Homo sapiens
aggcctagaattagaagggcaacatggaacccttccaggagagggccagctggagtccttttcacaggagagggatttaaacaagctcctggatggatatrtaggagagaagcctatgtgtgcagaatgcgggaaaagctttaaccagagttcctatctcataagacacctaagaacccacactggcgagaggccctatac

SEQ ID NO: 3683 - DNA, 201 bp, Homo sapiens; identical to SEQ ID NO: 3660

SEQ ID NO: 3684 - DNA, 201 bp, Homo sapiens; identical to SEQ ID NO: 3670

SEQ ID NO: 3685 - DNA, 152 bp, Homo sapiens; identical to SEQ ID NO: 3661
  misc_feature (1)...(152): n = A,T,C or G, or insertion/deletion polymorphism (see Tables 1-2)

SEQ ID NO: 3686 - DNA, 201 bp, Homo sapiens; identical to SEQ ID NO: 3663

SEQ ID NO: 3687 - DNA, 201 bp, Homo sapiens; identical to SEQ ID NO: 3662

SEQ ID NO: 3688 - DNA, 186 bp, Homo sapiens; identical to SEQ ID NO: 3664

SEQ ID NO: 3689 - DNA, 201 bp, Homo sapiens
gctctcaaaggaatttccaggcctagtgtaatctcccagccggagcagaaagaagagccatgggtcctaccactccaaaactttgaggcgaggaagatccygagggaaagccacacagactgtgagcatcaggtggcaaagctcaatcaggacaattctgaaacagcagaacaatgtggaacatcctcagaaaggaccaat

SEQ ID NO: 3690 - DNA, 201 bp, Homo sapiens; identical to SEQ ID NO: 3666

SEQ ID NO: 3691 - DNA, 201 bp, Homo sapiens
gaggtgaagacattgtggctgaccatgttgcctcttacggtgtaaacttgtaccagtcttatggtccctctgggcagtacagccatgaatttgatggagaygaggagttctatgtggacctggagaggaaggagactgtctggcagttgcctctgttccgcagatttagaagatttgacccgcaatttgcactgacaaaca

SEQ ID NO: 3692 - DNA, 201 bp, Homo sapiens
tcagtcacagaaggtgtttctgagaccagcttcctctccaagagtgatcattccttcttcaagatcagttacctcaccttcctcccttctgatgatgagakttatgactgcaaggtggagcactggggcctggatgagcctcttctgaaacactgggagcctgagattccagcacctatgtcagagctcacagagactgtg

SEQ ID NO: 3693 - DNA, 201 bp, Homo sapiens; identical to SEQ ID NO: 2258

SEQ ID NO: 3694 - DNA, 201 bp, Homo sapiens
ggcactcagtcacagaaggtgtttctgagaccagcttcctctccaagagtgatcattccttcttcaagatcagttacctcaccttcctcccttctgatgakgagatttatgactgcaaggtggagcactggggcctggatgagcctcttctgaaacactgggagcctgagattccagcacctatgtcagagctcacagaga

SEQ ID NO: 3695 - DNA, 201 bp, Homo sapiens
ctgaggtcacagtgttttccaagtctcccgtgacactgggtcagcccaacaccctcatctgtcttgtggacaacatctttcctcctgtggtcaacatcacmtggctgagcaatgggcactcagtcacagaaggtgtttctgagaccagcttcctctccaagagtgatcattccttcttcaagatcagttacctcaccttcc

SEQ ID NO: 3696 - DNA, 201 bp, Homo sapiens
ccaagtctcccgtgacactgggtcagcccaacaccctcatctgtcttgtggacaacatctttcctcctgtggtcaacatcacctggctgagcaatgggcastcagtcacagaaggtgtttctgagaccagcttcctctccaagagtgatcattccttcttcaagatcagttacctcaccttcctcccttctgatgatgaga

SEQ ID NO: 3697 - DNA, 201 bp, Homo sapiens
tgattaaacgctccaactctaccgctgctaccaatgaggttcctgaggtcacagtgttttccaagtctcccgtgacactgggtcagcccaacaccctcatytgtcttgtggacaacatctttcctcctgtggtcaacatcacctggctgagcaatgggcactcagtcacagaaggtgtttctgagaccagcttcctctcca

SEQ ID NO: 3698 - DNA, 201 bp, Homo sapiens
aacatcgtgattaaacgctccaactctaccgctgctaccaatgaggttcctgaggtcacagtgttttccaagtctcccgtgacactgggtcagcccaacaycctcatctgtcttgtggacaacatctttcctcctgtggtcaacatcacctggctgagcaatgggcactcagtcacagaaggtgtttctgagaccagcttc

SEQ ID NO: 3699 - DNA, 201 bp, Homo sapiens
tgctaaaacataacttgaacatcgtgattaaacgctccaactctaccgctgctaccaatgaggttcctgaggtcacagtgttttccaagtctcccgtgacrctgggtcagcccaacaccctcatctgtcttgtggacaacatctttcctcctgtggtcaacatcacctggctgagcaatgggcactcagtcacagaaggtg

SEQ ID NO: 3700 - DNA, 201 bp, Homo sapiens; identical to SEQ ID NO: 3691

SEQ ID NO: 3701 - DNA, 157 bp, Homo sapiens
tcagtcacagaaggtgtttctgagaccagcttcctctccaagagtgatcattccttcttcaagatcagttacctcaccttcctcccttctgatgatgagakttatgactgcaaggtggagcactggggcctggatgagcctcttctgaaacactggg

SEQ ID NO: 3702 - DNA, 166 bp, Homo sapiens
aatgggcactcagtcacagaaggtgtttctgagaccagcttcctctccaagagtgatcattccttcttcaagatcagttacctcaccttcctcccttctgmtgatgagatttatgactgcaaggtggagcactggggcctggatgagcctcttctgaaacactggg

SEQ ID NO: 3703 - DNA, 162 bp, Homo sapiens
ggcactcagtcacagaaggtgtttctgagaccagcttcctctccaagagtgatcattccttcttcaagatcagttacctcaccttcctcccttctgatgakgagatttatgactgcaaggtggagcactggggcctggatgagcctcttctgaaacactggg

SEQ ID NO: 3704 - DNA, 201 bp, Homo sapiens; identical to SEQ ID NO: 3695

SEQ ID NO: 3705 - DNA, 201 bp, Homo sapiens; identical to SEQ ID NO: 3696

SEQ ID NO: 3706 - DNA, 201 bp, Homo sapiens
ttcacactttacaccagtgctgtttcctcaccatagaggttcctgaggtcacagtgttttccaagtctcccgtgacactgggtcagcccaacaccctcatytgtcttgtggacaacatctttcctcctgtggtcaacatcacctggctgagcaatgggcactcagtcacagaaggtgtttctgagaccagcttcctctcca

SEQ ID NO: 3707 - DNA, 201 bp, Homo sapiens
agagctattcacactttacaccagtgctgtttcctcaccatagaggttcctgaggtcacagtgttttccaagtctcccgtgacactgggtcagcccaacaycctcatctgtcttgtggacaacatctttcctcctgtggtcaacatcacctggctgagcaatgggcactcagtcacagaaggtgtttctgagaccagcttc

SEQ ID NO: 3708 - DNA, 201 bp, Homo sapiens
cagaagaagctcagggcagagctattcacactttacaccagtgctgtttcctcaccatagaggttcctgaggtcacagtgttttccaagtctcccgtgacrctgggtcagcccaacaccctcatctgtcttgtggacaacatctttcctcctgtggtcaacatcacctggctgagcaatgggcactcagtcacagaaggtg

SEQ ID NO: 3709 - DNA, 201 bp, Homo sapiens
ccaagtttcctgtgacgctgggtcagcccaacaccctcatctgtcttgtggacaacatctttcctcctgtggtcaacatcacctggctgagcaatgggcastcagtcacagaaggtgtttctgagaccagcttcctctccaagagtgatcattccttcttcaagatcagttacctcaccttcctcccttctgctgatgaga

SEQ ID NO: 3710 - DNA, 201 bp, Homo sapiens
ctgaggtcacagtgttttccaagtttcctgtgacgctgggtcagcccaacaccctcatctgtcttgtggacaacatctttcctcctgtggtcaacatcacmtggctgagcaatgggcactcagtcacagaaggtgtttctgagaccagcttcctctccaagagtgatcattccttcttcaagatcagttacctcaccttcc

SEQ ID NO: 3711 - DNA, 201 bp, Homo sapiens
aatgggcactcagtcacagaaggtgtttctgagaccagcttcctctccaagagtgatcattccttcttcaagatcagttacctcaccttcctcccttctgmtgatgagatttatgactgcaaggtggagcactggggcctggacgagcctcttctgaaacactgggagcctgagattccagcccctatgtcagagctcaca

SEQ ID NO: 3712 - DNA, 201 bp, Homo sapiens
ggcactcagtcacagaaggtgtttctgagaccagcttcctctccaagagtgatcattccttcttcaagatcagttacctcaccttcctcccttctgctgakgagatttatgactgcaaggtggagcactggggcctggacgagcctcttctgaaacactgggagcctgagattccagcccctatgtcagagctcacagaga

SEQ ID NO: 3713 - DNA, 201 bp, Homo sapiens
tcagtcacagaaggtgtttctgagaccagcttcctctccaagagtgatcattccttcttcaagatcagttacctcaccttcctcccttctgctgatgagakttatgactgcaaggtggagcactggggcctggacgagcctcttctgaaacactgggagcctgagattccagcccctatgtcagagctcacagagactttg

SEQ ID NO: 3714 - DNA, 201 bp, Homo sapiens
accaagggccgacgccaaggcctacagtgaccccagcacaggggagccggccacctacggcgagctccagcagcggtgccggcccgaccagctgaccgggytgagcctgctgccgctctcagaaaaggctgctcgggcccggcaggaggagctctactcagagctgcaggcccgtgagacctttgaaaagaccccggttga

SEQ ID NO: 3715 - DNA, 201 bp, Homo sapiens
ctcaacaaggacacgcacgaccagctgtcagagcccagcgaggtgcgcagctacgtggacccgtccaccgacgagcgcctcagctacacgcagctgctcargcggtgccgtcgtgacgacggcaccggccagctgctcctgccactgtcggacgcccgcaagctgaccttccgtggcctgcggaagcagatcaccatggag

SEQ ID NO: 3716 - DNA, 201 bp, Homo sapiens
cggaggccacggaggccgcacgccagcgcagccaggtggaggaggagctcttctcggtgcgcgtgcagatggaggagctgagcaagctcaaggcacgcatygaggctgagaaccgcgcactcatcttgcgtgacaaggacaatacgcagcgcttcctgcaggaggaggctgagaagatgaagcaggtggcggaggaggccg

SEQ ID NO: 3717 - DNA, 201 bp, Homo sapiens
cgcacgccagcgcagccaggtggaggaggagctcttctcggtgcgcgtgcagatggaggagctgagcaagctcaaggcacgcatcgaggctgagaaccgcrcactcatcttgcgtgacaaggacaatacgcagcgcttcctgcaggaggaggctgagaagatgaagcaggtggcggaggaggccgcgcggctgagtgtggc

SEQ ID NO: 3718 - DNA, 201 bp, Homo sapiens
tgcgtgtggccgagatgagccgagcccaggcccgcgctgaggaggacgcccagcgcttccggaagcaggcggaggagatcggtgagaagctgcaccgcacrgagctcgccacccaggagaaggtgaccctggtgcagacactggagatccagcgacagcagagtgaccatgatgccgagcgcctgcgggaggccatcgctg

SEQ ID NO: 3719 - DNA, 201 bp, Homo sapiens
gtgctttccagctcaccccccacactcactcctgagacccctggccctcctgttgcacccagccctggtctcagcagcgaccacccctgcctccaccctcygagctttgcatgttccactaaccccgggcgggtggcaggtggaggtgtcaggctgctggcgcctctgcaagggcagaacactaacctgaccgtgggcggg

SEQ ID NO: 3720 - DNA, 201 bp, Homo sapiens
tccggggtcctcagcagagcccagtttgagcagctcaaggacggcaagacgacggtcaaggacctttcggagctgggctccgtgcggacgctgctgcaggscagtggctgcctcgccggcatctacctggaggacaccaaggagaaggtgtccatctacgaggccatgcgccggggcctgctgagagccacaacggctgcg

SEQ ID NO: 3721 - DNA, 201 bp, Homo sapiens
tggaccctgtgcggaaccggcggctgaccgtcaacgaggctgtgaaggagggtgtggtgggccccgagctgcaccacaagctgctgtcggccgagcgcgcygtcactggctacaaggacccctacactggccagcagatctctctcttccaagccatgcagaagggcctcatcgtccgggagcacggcatccgcctgctgg

SEQ ID NO: 3722 - DNA, 201 bp, Homo sapiens
aggccaccgtgtctgcgccgttcggcaagttccagggcaagacggtgaccatttgggagatcatcaactcggaatacttcacggcagagcagcggcgggasctgctgcggcagttccgcacgggccggatcacagtggagaagatcatcaagatcatcatcacggtggtggaggagcaggagcagaagggccggctttgct

SEQ ID NO: 3723 - DNA, 201 bp, Homo sapiens
catcgaccgcgagctctaccagcagctgcagcgaggtgagcgctctgtgcgagacgtagccgaggtggacactgtgcggcgggctctccggggtgccaacrtcatcgcgggtgtatggctggaggaggcggggcagaagctgagtatctacaatgccctgaagaaagacctgctgccatccgacatggccgtggccctgtt

SEQ ID NO: 3724 - DNA, 201 bp, Homo sapiens
acgaccagctgtcagagcccagcgaggtgcgcagctacgtggacccgtccaccgacgagcgcctcagctacacgcagctgctcaggcggtgccgtcgtgaygacggcaccggccagctgctcctgccactgtcggacgcccgcaagctgaccttccgtggcctgcggaagcagatcaccatggaggagctggtgcgctcgc

SEQ ID NO: 3725 - DNA, 201 bp, Homo sapiens
gtcagagcccagcgaggtgcgcagctacgtggacccgtccaccgacgagcgcctcagctacacgcagctgctcaggcggtgccgtcgtgacgacggcaccrgccagctgctcctgccactgtcggacgcccgcaagctgaccttccgtggcctgcggaagcagatcaccatggaggagctggtgcgctcgcaggtcatgga

SEQ ID NO: 3726 - DNA, 201 bp, Homo sapiens
tgcgcagctacgtggacccgtccaccgacgagcgcctcagctacacgcagctgctcaggcggtgccgtcgtgacgacggcaccggccagctgctcctgccrctgtcggacgcccgcaagctgaccttccgtggcctgcggaagcagatcaccatggaggagctggtgcgctcgcaggtcatggacgaggccacggcgctgc

SEQ ID NO: 3727 - DNA, 201 bp, Homo sapiens
tggtgatccgcggcacgcagggggccgaggaggtgctcagggcccacgaggagcagctcaaggaggcccaggccgtgccggccaccctcccggagctcgargccaccaaggcctctctgaagaagctgcgggcccaggccgaggcacagcagcccacgttcgacgccctgcgggatgagctgcggggggcacaggaggtgg

SEQ ID NO: 3728 - DNA, 201 bp, Homo sapiens
ggatgagctgcggggggcacaggaggtgggggagcgactgcagcagcggcacggggagcgggacgtggaggtggagcgctggcgggagcgggtcgcccagytgcttgagcgctggcaggctgtgctggcccagaccgacgtgcggcagcgcgagctcgagcaactgggccgccagctgcgttactaccgcgagagtgcaga

SEQ ID NO: 3729 - DNA, 201 bp, Homo sapiens
gcagaccccttgggcgcctggctgcaggacgccaggcggcggcaggagcagatccaggccatgccgctggccgacagccaggctgtgcgggagcagctgcrgcaggagcaggccctgctggaggagatcgagcgccacggcgagaaggtcgaggagtgccagaggtttgcgaaacagtacatcaacgccatcaaggactat

SEQ ID NO: 3730 - DNA, 201 bp, Homo sapiens
ccatgcaccggaacctggtggataacatcacggggcagcggctgctggaggcgcaggcctgcaccgggggcatcatcgaccccagcaccggtgagcgcttscctgtcaccgacgccgtcaacaagggcctggtggacaagatcatggtggaccgcatcaacctggcccagaaggccttctgcggcttcgaggacccacgca

SEQ ID NO: 3731 - DNA, 201 bp, Homo sapiens
tacctggaggacaccaaggagaaggtgtccatctacgaggccatgcgccggggcctgctgagagccacaacggctgcgctcctgctggaggcgcaggcggscactggcttcctggtggaccccgtgcggaaccagcgcctgtatgtccacgaggccgtgaaggcgggcgtggtgggccccgagcttcacgagcagctgctg

SEQ ID NO: 3732 - DNA, 201 bp, Homo sapiens
tgaaggcgggcgtggtgggccccgagcttcacgagcagctgctgtctgccgagaaggccgtcaccggctacagagacccctactcgggcagcaccatctcyctcttccaggccatgcagaagggcctggttctccggcagcacggcatccgcctgctggaggcccagatcgccacgggcggcatcatcgaccccgtgcaca

SEQ ID NO: 3733 - DNA, 201 bp, Homo sapiens
agcgcctgtatgtccacgaggccgtgaaggcgggcgtggtgggccccgagcttcacgagcagctgctgtctgccgagaaggccgtcaccggctacagagayccctactcgggcagcaccatctccctcttccaggccatgcagaagggcctggttctccggcagcacggcatccgcctgctggaggcccagatcgccacgg

SEQ ID NO: 3734 - DNA, 201 bp, Homo sapiens
gggcaaggtcaccgtggagaaggtcatcaagattctcattaccatcgtggaggaggtggagaccctgcggcaggagaggctgtccttcagcggcctccgtkcccctgtgccagccagcgagctcctggcttccggggtcctcagcagagcccagtttgagcagctcaaggacggcaagacgacggtcaaggacctttcgga

SEQ ID NO: 3735 - DNA, 201 bp, Homo sapiens
tcctgctggaggcgcaggcggccactggcttcctggtggaccccgtgcggaaccagcgcctgtatgtccacgaggccgtgaaggcgggcgtggtgggcccygagcttcacgagcagctgctgtctgccgagaaggccgtcaccggctacagagacccctactcgggcagcaccatctccctcttccaggccatgcagaagg

SEQ ID NO: 3736 - DNA, 201 bp, Homo sapiens
cggcgcgcgagaagcagcgggccctgcaggccctggaggagctgcggctgcaggcggaggaggcggagcggcgcctgcggcaggccgaggtggagcgagcdcggcaggtacaggtggccctggagacggcgcagcgcagtgcagaggcggagctgcagagcaaacgcgcctccttcgccgagaagacggcacagctggagc

SEQ ID NO: 3737 - DNA, 201 bp, Homo sapiens
tggagctggcctcgcgcgtgaaggccgaggccgaggcggcgcgcgagaagcagcgggccctgcaggccctggaggagctgcggctgcaggcggaggaggcrgagcggcgcctgcggcaggccgaggtggagcgagcgcggcaggtacaggtggccctggagacggcgcagcgcagtgcagaggcggagctgcagagcaaac

SEQ ID NO: 3738 - DNA, 201 bp, Homo sapiens
ggaggatgcgtttccacaagctgcagaatgtccagattgccctggactacctccggcaccgccaggtgaagctggtgaacatcaggaatgatgacatcgcygacggcaaccccaagctgacccttggcctcatctggacaatcattctgcacttccagatctcagatatccaggtgagtgggcagtcggaggacatgacgg

SEQ ID NO: 3739 - DNA, 201 bp, Homo sapiens
tgcagttggaggccaccgagcgccagcgtggcggggctgagggggagctgcaggcactgcgtgcacgggcggaggaggctgaggcacaaaagcgacaggcrcaggaggaggccgagcgcttgcggaggcaggtgcaggacgagagccagcgtaagcggcaggcggaggtggagctggcctcgcgcgtgaaggccgaggccg

SEQ ID NO: 3740 - DNA, 201 bp, Homo sapiens
ccaagaacttgcagaagttcctggaaggcaccagctgcatcgctggtgtcttcgtggacgccaccaaggaacggctctcggtgtaccaggccatgaagaarggcatcatccgccccggcacagcctttgagctcctggaggcgcaggcggccaccggttacgtcatcgaccccatcaagggactgaagctgacggtggagg

SEQ ID NO: 3741 - DNA, 201 bp, Homo sapiens
aggcggccgctggcaaggcggagctggagctggagctgggacgcatccgcagcaacgcggaggacacgctgcgcagcaaggagcaggccgagctggaggcygcgaggcagcggcagctggcggcggaggaggagcggcggcgccgtgaggctgaggagcgcgtgcagaagagcctggcggccgaggaggaggccgcacggc

SEQ ID NO: 3742 - DNA, 201 bp, Homo sapiens
ggctgcgtgagcagctgcagctcctggaggagcagcaccgggccgcgctggcgcactcagaggaggtcactgcctcgcaggtggctgccacaaagaccctrcccaatggccgggatgcacttgatggccccgcggcagaggcagagccggagcacagcttcgatggcctgcggcggaaggtgtcagctcagaggctgcagg

SEQ ID NO: 3743 - DNA, 201 bp, Homo sapiens
cggagcacagcttcgatggcctgcggcggaaggtgtcagctcagaggctgcaggaggccggcatcctgagtgcggaggagctgcagcggttggcgcagggycacaccacggtggacgagctcgcacggcgggaagacgtgcgccactacctgcagggccgcagcagtatcgcagggctgttgctgaaggccaccaatgaga

SEQ ID NO: 3744 - DNA, 201 bp, Homo sapiens
gcggaaggtgtcagctcagaggctgcaggaggccggcatcctgagtgcggaggagctgcagcggttggcgcagggccacaccacggtggacgagctcgcayggcgggaagacgtgcgccactacctgcagggccgcagcagtatcgcagggctgttgctgaaggccaccaatgagaagctgagtgtttacgccgccctgca

SEQ ID NO: 3745 - DNA, 201 bp, Homo sapiens
agatgaaccgcgtcctggcggaccccagcgacgacaccaagggcttctttgaccccaacacgcacgagaacctcacgtacctgcagctactggagcgctgygtggaggaccccgagacgggcctgtgccttctgccactcacggataaggctgccaagggcggggagctggtctacactgactccgaggcccgggacgtct

SEQ ID NO: 3746 - DNA, 201 bp, Homo sapiens
gcttcctctctgaaaaggacagcctgctacagcgggagcgcttcatcgagcaggagaaggccaagctggagcagctcttccaggacgaggtggccaaggcmcagcagctgcgtgaggagcagcagcggcagcagcagcagatggagcaggaacggcagcggctggtggccagcatggaggaggcgcggcggcggcagcatg

SEQ ID NO: 3747 - DNA, 201 bp, Homo sapiens
tgcagcgtgaggcggctgcagccacgcagaaacggcaggagctggaagccgagctggccaaggtgcgggccgagatggaggtgctgctggccagcaaggcragggctgaggaggagtcgcgctccaccagcgagaagtccaagcagaggctggaggccgaggccggccggttccgcgagctggccgaggaggccgcccgcc

SEQ ID NO: 3748 - DNA, 201 bp, Homo sapiens
ccgagcggctgaagcagtcggcagaggagcaggcacaggcccgggctcaggcacaggcggctgcagagaagctgcgcaaggaggccgagcaagaggcggcrcggcgggcacaggcggagcaggcggccctgcggcagaagcaggcagctgacgcggagatggagaagcataagaaattcgccgagcagacgctgcggcaga

SEQ ID NO: 3749 - DNA, 201 bp, Homo sapiens
gcaggaacggcagcggctggtggccagcatggaggaggcgcggcggcggcagcatgaggccgaggagggcgtgcggcgcaagcaggaggagctgcagcagytggagcagcagcggcggcagcaggaggagctgctggctgaggagaaccagaggctgcgtgagcagctgcagctcctggaggagcagcaccgggccgcgct

SEQ ID NO: 3750 - DNA, 201 bp, Homo sapiens
ggctgccacaaagaccctgcccaatggccgggatgcacttgatggccccgcggcagaggcagagccggagcacagcttcgatggcctgcggcggaaggtgycagctcagaggctgcaggaggccggcatcctgagtgcggaggagctgcagcggttggcgcagggccacaccacggtggacgagctcgcacggcgggaaga

SEQ ID NO: 3751 - DNA, 201 bp, Homo sapiens
ggcagctgctgagtcccggcacggccctcatcctgctggaggcgcaggcggcctcaggcttcctgctggaccctgtgcggaaccggcggctgaccgtcaaygaggctgtgaaggagggtgtggtgggccccgagctgcaccacaagctgctgtcggccgagcgcgccgtcactggctacaaggacccctacactggccagc

SEQ ID NO: 3752 - DNA, 201 bp, Homo sapiens
ccccagcgacgacaccaagggcttctttgaccccaacacgcatgagaacctcacgtacaggcagctgctggagcggtgcgtggaggaccccgagacgggcytgcgccttctgccactgaaaggggcggagaaggctgaggtggtggagaccacgcaggtgtacactgaggaggagacaagaagggcatttgaagagacaca

SEQ ID NO: 3753 - DNA, 201 bp, Homo sapiens
cgtacaggcagctgctggagcggtgcgtggaggaccccgagacgggcttgcgccttctgccactgaaaggggcggagaaggctgaggtggtggagaccacrcaggtgtacactgaggaggagacaagaagggcatttgaagagacacagatcgacattcccggcggcggcagccacggcggctccaccatgtccctgtggg

SEQ ID NO: 3754 - DNA, 201 bp, Homo sapiens
tggaaggcaccagctgcatcgctggtgtcttcgtggacgccaccaaggaacggctctcggtgtaccaggccatgaagaagggcatcatccgccccggcacrgcctttgagctcctggaggcgcaggcggccaccggttacgtcatcgaccccatcaagggactgaagctgacggtggaggaggctgtgcgtatgggcattg

SEQ ID NO: 3755 - DNA, 201 bp, Homo sapiens
tgtacgaggcctaccgcaagggcctgattgaccaccagacgtacctggagctgtccgagcaggagtgcgagtgggaggagatcaccatctcctcctcggayggcgtggtcaagtccatgatcatcgaccgccgctccgggcgccagtacgacatcgatgatgccatcgccaagaacctcatcgaccgctcggcactggacc

SEQ ID NO: 3756 - DNA, 201 bp, Homo sapiens
cagcgaggtgagcgctctgtgcgagacgtagccgaggtggacactgtgcggcgggctctccggggtgccaacgtcatcgcgggtgtatggctggaggaggyggggcagaagctgagtatctacaatgccctgaagaaagacctgctgccatccgacatggccgtggccctgttggaagcccaggccggcaccgggcacatc

SEQ ID NO: 3757 - DNA, 201 bp, Homo sapiens
cagagctgcaggcccgtgagacctttgaaaagaccccggttgaggtccccgtgggtggcttcaagggcaggacggtgacggtgtgggagctcatcagctcwgagtacttcactgcggagcagcggcaggagctgttgcgtcagttccgcacgggcaaggtcaccgtggagaaggtcatcaagattctcattaccatcgtgg

SEQ ID NO: 3758 - DNA, 201 bp, Homo sapiens
ctcctaccccatcagccccgccgtctccaggacccagctggcctcctggtcagaccccactgaggagacgggccccgtggctggcatcctggacacggagwcgctggagaaggtgtccatcaccgaggccatgcaccggaacctggtggataacatcacggggcagcggctgctggaggcgcaggcctgcaccgggggcat

SEQ ID NO: 3759 - DNA, 201 bp, Homo sapiens
tggtggaggagggcacggggctgcggctgctggaggctgccgcgcagtccaccaagggctactacagcccctacagcgtcagcggctccggctctaccgcyggctcccgcaccggctcgcgcaccggctcccgggccggctcccgccgcggcagctttgacgccaccggctccggcttctccatgaccttctcttcatcct

SEQ ID NO: 3760 - DNA, 201 bp, Homo sapiens
tctcattaccatcgtggaggaggtggagaccctgcggcaggagaggctgtccttcagcggcctccgtgcccctgtgccagccagcgagctcctggcttccrgggtcctcagcagagcccagtttgagcagctcaaggacggcaagacgacggtcaaggacctttcggagctgggctccgtgcggacgctgctgcagggcag

SEQ ID NO: 3761 - DNA, 201 bp, Homo sapiens
gcctgctgagagccacaacggctgcgctcctgctggaggcgcaggcggccactggcttcctggtggaccccgtgcggaaccagcgcctgtatgtccacgargccgtgaaggcgggcgtggtgggccccgagcttcacgagcagctgctgtctgccgagaaggccgtcaccggctacagagacccctactcgggcagcacca

SEQ ID NO: 3762 - DNA, 201 bp, Homo sapiens
tacctgcccggttccaggcagacactgagcatctaccaggctctcaagaaagggctgctgagtgccgaggtggcccgcctgctgctggaggcacaggcagycacaggcttcctgctggacccggtgaagggggagcggctgactgtggatgaggctgtgcggaagggcctcgtggggcccgagctgcacgaccgcctgctc

SEQ ID NO: 3763 - DNA, 201 bp, Homo sapiens
ctctcgaggcggagtccgcctggtgctacctctatggcacgggctccgtggctggtgtctacctgcccggttccaggcagacactgagcatctaccaggcyctcaagaaagggctgctgagtgccgaggtggcccgcctgctgctggaggcacaggcagccacaggcttcctgctggacccggtgaagggggagcggctga

SEQ ID NO: 3764 - DNA, 201 bp, Homo sapiens
caacctgctccgggagggcaccaggagcctccgtgaggctctcgaggcggagtccgcctggtgctacctctatggcacgggctccgtggctggtgtctacytgcccggttccaggcagacactgagcatctaccaggctctcaagaaagggctgctgagtgccgaggtggcccgcctgctgctggaggcacaggcagccac

SEQ ID NO: 3765 - DNA, 201 bp, Homo sapiens
aggagatccgcgtggtgcgcctgcagttggaggccaccgagcgccagcgtggcggggctgagggggagctgcaggcactgcgtgcacgggcggaggaggckgaggcacaaaagcgacaggcgcaggaggaggccgagcgcttgcggaggcaggtgcaggacgagagccagcgtaagcggcaggcggaggtggagctggcct

SEQ ID NO: 3766 - DNA, 201 bp, Homo sapiens
caacaaggacacgcacgaccagctgtcagagcccagcgaggtgcgcagctacgtggacccgtccaccgacgagcgcctcagctacacgcagctgctcaggmggtgccgtcgtgacgacggcaccggccagctgctcctgccactgtcggacgcccgcaagctgaccttccgtggcctgcggaagcagatcaccatggagga

SEQ ID NO: 3767 - DNA, 201 bp, Homo sapiens
acgggcggcatcgtggaccccagcaagagccaccgcgtgcccctggatgtcgcctgcgcccgaggctgcctggatgaggagaccagcagggccctgtcggmaccaagggccgacgccaaggcctacagtgaccccagcacaggggagccggccacctacggcgagctccagcagcggtgccggcccgaccagctgaccggg

SEQ ID NO: 3768 - DNA, 201 bp, Homo sapiens
ctgcgggagcgagcggagcaggagtcggcgcggcagctgcagctggcccaggaggccgcccagaagcggctgcaggcggaagagaaggcacacgccttcgyggtgcagcagaaggagcaggagctacagcagacgctgcagcaggagcagagcgtgctggaccagctgcgcggcgaggcggaggcggcccggcgggcggct

SEQ ID NO: 3769 - DNA, 201 bp, Homo sapiens
ggagcggcggcgccgtgaggctgaggagcgcgtgcagaagagcctggcggccgaggaggaggccgcacggcagcggaaggcggcgctggaggaagtcgagyggctgaaagccaaggtggaggaggcgcggcgcctgcgggagcgagcggagcaggagtcggcgcggcagctgcagctggcccaggaggccgcccagaagcg

SEQ ID NO: 3770 - DNA, 201 bp, Homo sapiens
taccgcagggtgtaccgtctgcacgagcgcctggtagccatccgcaccgagtacaacctacggctgaaggcaggcgtggcggcccctgcaacccaggtggyccaggtgactctgcagagtgtgcagaggcgccccgagctggaggactccactctgcgctacctgcaggacctgctggcctgggtggaggagaaccagcac

SEQ ID NO: 3771 - DNA, 201 bp, Homo sapiens
cgggagcacggcatccgcctgctggaggcccagatcgccacgggcggcgttatcgaccccgtgcacagccaccgcgtgcccgtggacgtggcctaccggcrcggctacttcgacgaggagatgaaccgcgtcctggcggaccccagcgacgacaccaagggcttctttgaccccaacacgcacgagaacctcacgtacctg

SEQ ID NO: 3772 - DNA, 201 bp, Homo sapiens
aggaggccgacaagaacaggtccaagggcatctaccaatccctggagggagcggtgcaagcaggccagctcaaggtgccccctggctaccacccgctggaygtggagaaggagtggggcaagctgcacgtggccatcctggagcgggagaagcagctccgcagcgagtttgagaggctggagtgtcttcagcgcatcgtga

SEQ ID NO: 3773 - DNA, 201 bp, Homo sapiens
ttcatcctcctactcctcctcgggctacggccgccgctacgcctcggggtcctcggcctccctggggggccctgagtctgccgtggcctgaggctgcctgygcccaccccgctctgcatgcggcccagcccggctcccaccgaggcgcgggggccgttttcaacgcttaaaggtgtcttcctcccaagtggtgcctaaagt

SEQ ID NO: 3774 - DNA, 201 bp, Homo sapiens
ctactcctcctcgggctacggccgccgctacgcctcggggtcctcggcctccctggggggccctgagtctgccgtggcctgaggctgcctgcgcccacccygctctgcatgcggcccagcccggctcccaccgaggcgcgggggccgttttcaacgcttaaaggtgtcttcctcccaagtggtgcctaaagtttaaccaaa

SEQ ID NO: 3775 - DNA, 201 bp, Homo sapiens
agctggagctggagctgggacgcatccgcagcaacgcggaggacacgctgcgcagcaaggagcaggccgagctggaggctgcgaggcagcggcagctggcrgcggaggaggagcggcggcgccgtgaggctgaggagcgcgtgcagaagagcctggcggccgaggaggaggccgcacggcagcggaaggcggcgctggagg

SEQ ID NO: 3776 - DNA, 201 bp, Homo sapiens
accccagcaccggtgagcgcttccctgtcaccgacgccgtcaacaagggcctggtggacaagatcatggtggaccgcatcaacctggcccagaaggccttytgcggcttcgaggacccacgcaccaagaccaagatgtcggccgcccaggccctgaagaagggctggctctactacgaggccggccagcgcttcctggagg

SEQ ID NO: 3777 - DNA, 201 bp, Homo sapiens
tcgccgagaagacggcacagctggagcgctccctgcaggaggaacacgtggctgtggcacagctgcgggaggaggctgagcggcgggcacagcagcaggcygaggccgagcgggcgcgcgaggaggcagagcgggagctggagcgctggcagctcaaggccaacgaggcgctacggctgcggctgcaggcggaggaggtgg

SEQ ID NO: 3778 - DNA, 201 bp, Homo sapiens
cggctgcggctgcaggcggaggaggtggcgcagcagaagagcctggcgcaggccgaggctgagaagcagaaggaggaggcggagcgcgaggcgcggcggcrcggcaaggcggaggagcaggccgtccggcagcgggagctggctgaacaagagctggagaagcagcggcagctggcggaaggcaccgcgcagcagcgcctg

SEQ ID NO: 3779 - DNA, 201 bp, Homo sapiens
ttaccatcgtggaggaggtggagaccctgcggcaggagaggctgtccttcagcggcctccgtgcccctgtgccagccagcgagctcctggcttccggggtyctcagcagagcccagtttgagcagctcaaggacggcaagacgacggtcaaggacctttcggagctgggctccgtgcggacgctgctgcagggcagtggct

SEQ ID NO: 3780 - DNA, 201 bp, Homo sapiens
tcagcggcctccgtgcccctgtgccagccagcgagctcctggcttccggggtcctcagcagagcccagtttgagcagctcaaggacggcaagacgacggtyaaggacctttcggagctgggctccgtgcggacgctgctgcagggcagtggctgcctcgccggcatctacctggaggacaccaaggagaaggtgtccatct

SEQ ID NO: 3781 - DNA, 201 bp, Homo sapiens
gagctcctggcttccggggtcctcagcagagcccagtttgagcagctcaaggacggcaagacgacggtcaaggacctttcggagctgggctccgtgcggaygctgctgcagggcagtggctgcctcgccggcatctacctggaggacaccaaggagaaggtgtccatctacgaggccatgcgccggggcctgctgagagcc

SEQ ID NO: 3782 - DNA, 201 bp, Homo sapiens
ctggccagcagatctctctcttccaagccatgcagaagggcctcatcgtccgggagcacggcatccgcctgctggaggcccagatcgccacgggcggcgtyatcgaccccgtgcacagccaccgcgtgcccgtggacgtggcctaccggcgcggctacttcgacgaggagatgaaccgcgtcctggcggaccccagcgacg

SEQ ID NO: 3783 - DNA, 201 bp, Homo sapiens
acaaggacccctacactggccagcagatctctctcttccaagccatgcagaagggcctcatcgtccgggagcacggcatccgcctgctggaggcccagatsgccacgggcggcgttatcgaccccgtgcacagccaccgcgtgcccgtggacgtggcctaccggcgcggctacttcgacgaggagatgaaccgcgtcctgg

SEQ ID NO: 3784 - DNA, 201 bp, Homo sapiens
cagagatcatccgccagcagggtctggcctcctacgactacgtgcgccgccgcctcacggctgaggacctgttcgaggctcggatcatctctctcgagacytacaacctgctccgggagggcaccaggagcctccgtgaggctctcgaggcggagtccgcctggtgctacctctatggcacgggctccgtggctggtgtct

SEQ ID NO: 3785 - DNA, 201 bp, Homo sapiens
acttccaggccggccgggtgaccaaggaacgcatgatcatcatcatcatcgagatcattgagaagacagagatcatccgccagcagggtctggcctcctaygactacgtgcgccgccgcctcacggctgaggacctgttcgaggctcggatcatctctctcgagacctacaacctgctccgggagggcaccaggagcctcc

SEQ ID NO: 3786 - DNA, 201 bp, Homo sapiens
gcacgaccagctgtcagagcccagcgaggtgcgcagctacgtggacccgtccaccgacgagcgcctcagctacacgcagctgctcaggcggtgccgtcgtsacgacggcaccggccagctgctcctgccactgtcggacgcccgcaagctgaccttccgtggcctgcggaagcagatcaccatggaggagctggtgcgctc

SEQ ID NO: 3787 - DNA, 201 bp, Homo sapiens
aggtggaggaggagatcctggcgctgaaggcgagcttcgagaaggcggccgctggcaaggcggagctggagctggagctgggacgcatccgcagcaacgcrgaggacacgctgcgcagcaaggagcaggccgagctggaggctgcgaggcagcggcagctggcggcggaggaggagcggcggcgccgtgaggctgaggagc

SEQ ID NO: 3788 - DNA, 201 bp, Homo sapiens
gccttctgccactgaaaggggcggagaaggctgaggtggtggagaccacgcaggtgtacactgaggaggagacaagaagggcatttgaagagacacagatygacattcccggcggcggcagccacggcggctccaccatgtccctgtgggaggtgatgcagtcggacctgatccccgaggagcagcgggcccagctgatgg

SEQ ID NO: 3789 - DNA, 201 bp, Homo sapiens
ggcaggcagaggcggctgagcgcagccggctgcgcatcgaggaggagatccgcgtggtgcgcctgcagttggaggccaccgagcgccagcgtggcggggcygagggggagctgcaggcactgcgtgcacgggcggaggaggctgaggcacaaaagcgacaggcgcaggaggaggccgagcgcttgcggaggcaggtgcagg

SEQ ID NO: 3790 - DNA, 201 bp, Homo sapiens
gccggggcctgctgagagccacaacggctgcgctcctgctggaggcgcaggcggccactggcttcctggtggaccccgtgcggaaccagcgcctgtatgtycacgaggccgtgaaggcgggcgtggtgggccccgagcttcacgagcagctgctgtctgccgagaaggccgtcaccggctacagagacccctactcgggca

SEQ ID NO: 3791 - DNA, 201 bp, Homo sapiens; identical to SEQ ID NO: 3714

SEQ ID NO: 3792 - DNA, 201 bp, Homo sapiens; identical to SEQ ID NO: 3716

SEQ ID NO: 3793 - DNA, 201 bp, Homo sapiens; identical to SEQ ID NO: 3715

SEQ ID NO: 3794 - DNA, 201 bp, Homo sapiens; identical to SEQ ID NO: 3717

SEQ ID NO: 3795 - DNA, 201 bp, Homo sapiens; identical to SEQ ID NO: 3718

SEQ ID NO: 3796 - DNA, 201 bp, Homo sapiens
cagccccctttgggcccagggacaccagccaggctctgtgctgaccctcctgttgcacccagccctggtctcagcagcgaccacccctgcctccaccctcygagctttgcatgttccactaaccccgggcgggtggcaggtggaggtgtcaggctgctggcgcctctgcaagggcagaacactaacctgaccgtgggcggg

SEQ ID NO: 3797 - DNA, 201 bp, Homo sapiens; identical to SEQ ID NO: 3720

SEQ ID NO: 3798 - DNA, 201 bp, Homo sapiens; identical to SEQ ID NO: 3721

SEQ ID NO: 3799 - DNA, 201 bp, Homo sapiens; identical to SEQ ID NO: 3722

SEQ ID NO: 3800 - DNA, 201 bp, Homo sapiens; identical to SEQ ID NO: 3723

SEQ ID NO: 3801 - DNA, 201 bp, Homo sapiens; identical to SEQ ID NO: 3724

SEQ ID NO: 3802 - DNA, 201 bp, Homo sapiens; identical to SEQ ID NO: 3725

SEQ ID NO: 3803 - DNA, 201 bp, Homo sapiens; identical to SEQ ID NO: 3727

SEQ ID NO: 3804 - DNA, 201 bp, Homo sapiens; identical to SEQ ID NO: 3726

SEQ ID NO: 3805 - DNA, 201 bp, Homo sapiens; identical to SEQ ID NO: 3728

SEQ ID NO: 3806 - DNA, 201 bp, Homo sapiens; identical to SEQ ID NO: 3729

SEQ ID NO: 3807 - DNA, 201 bp, Homo sapiens; identical to SEQ ID NO: 3730

SEQ ID NO: 3808 - DNA, 201 bp, Homo sapiens; identical to SEQ ID NO: 3731

SEQ ID NO: 3809 - DNA, 201 bp, Homo sapiens; identical to SEQ ID NO: 3732

SEQ ID NO: 3810 - DNA, 201 bp, Homo sapiens; identical to SEQ ID NO: 3733

SEQ ID NO: 3811 - DNA, 201 bp, Homo sapiens; identical to SEQ ID NO: 3734

SEQ ID NO: 3812 - DNA, 201 bp, Homo sapiens; identical to SEQ ID NO: 3735

SEQ ID NO: 3813 - DNA, 201 bp, Homo sapiens; identical to SEQ ID NO: 3736

SEQ ID NO: 3814 - DNA, 201 bp, Homo sapiens; identical to SEQ ID NO: 3738

SEQ ID NO: 3815 - DNA, 201 bp, Homo sapiens; identical to SEQ ID NO: 3737

SEQ ID NO: 3816 - DNA, 201 bp, Homo sapiens; identical to SEQ ID NO: 3740

SEQ ID NO: 3817 - DNA, 201 bp, Homo sapiens; identical to SEQ ID NO: 3739

SEQ ID NO: 3818 - DNA, 201 bp, Homo sapiens; identical to SEQ ID NO: 3741

SEQ ID NO: 3819 - DNA, 201 bp, Homo sapiens; identical to SEQ ID NO: 3742

SEQ ID NO: 3820 - DNA, 201 bp, Homo sapiens; identical to SEQ ID NO: 3743

SEQ ID NO: 3821 - DNA, 201 bp, Homo sapiens; identical to SEQ ID NO: 3744

SEQ ID NO: 3822 - DNA, 201 bp, Homo sapiens; identical to SEQ ID NO: 3745

SEQ ID NO: 3823 - DNA, 201 bp, Homo sapiens; identical to SEQ ID NO: 3746

SEQ ID NO: 3824 - DNA, 201 bp, Homo sapiens; identical to SEQ ID NO: 3747

SEQ ID NO: 3825 - DNA, 201 bp, Homo sapiens; identical to SEQ ID NO: 3748

SEQ ID NO: 3826 - DNA, 201 bp, Homo sapiens; identical to SEQ ID NO: 3749

SEQ ID NO: 3827 - DNA, 201 bp, Homo sapiens; identical to SEQ ID NO: 3750

SEQ ID NO: 3828 - DNA, 201 bp, Homo sapiens; identical to SEQ ID NO: 3751

SEQ ID NO: 3829 - DNA, 201 bp, Homo sapiens; identical to SEQ ID NO: 3752

SEQ ID NO: 3830 - DNA, 201 bp, Homo sapiens; identical to SEQ ID NO: 3753

SEQ ID NO: 3831 - DNA, 201 bp, Homo sapiens; identical to SEQ ID NO: 3754

SEQ ID NO: 3832 - DNA, 201 bp, Homo sapiens; identical to SEQ ID NO: 3755

SEQ ID NO: 3833 - DNA, 201 bp, Homo sapiens; identical to SEQ ID NO: 3756

SEQ ID NO: 3834 - DNA, 201 bp, Homo sapiens; identical to SEQ ID NO: 3758

SEQ ID NO: 3835 - DNA, 201 bp, Homo sapiens; identical to SEQ ID NO: 3757

SEQ ID NO: 3836 - DNA, 201 bp, Homo sapiens; identical to SEQ ID NO: 3759

SEQ ID NO: 3837 - DNA, 201 bp, Homo sapiens; identical to SEQ ID NO: 3760

SEQ ID NO: 3838 - DNA, 201 bp, Homo sapiens; identical to SEQ ID NO: 3762

SEQ ID NO: 3839 - DNA, 201 bp, Homo sapiens; identical to SEQ ID NO: 3761

SEQ ID NO: 3840 - DNA, 201 bp, Homo sapiens; identical to SEQ ID NO: 3763

SEQ ID NO: 3841 - DNA, 201 bp, Homo sapiens; identical to SEQ ID NO: 3764

SEQ ID NO: 3842 - DNA, 201 bp, Homo sapiens; identical to SEQ ID NO: 3765

SEQ ID NO: 3843 - DNA, 201 bp, Homo sapiens; identical to SEQ ID NO: 3766

SEQ ID NO: 3844 - DNA, 201 bp, Homo sapiens; identical to SEQ ID NO: 3767

SEQ ID NO: 3845 - DNA, 201 bp, Homo sapiens; identical to SEQ ID NO: 3768

SEQ ID NO: 3846 - DNA, 201 bp, Homo sapiens; identical to SEQ ID NO: 3770

SEQ ID NO: 3847 - DNA, 201 bp, Homo sapiens; identical to SEQ ID NO: 3769

SEQ ID NO: 3848 - DNA, 201 bp, Homo sapiens; identical to SEQ ID NO: 3771

SEQ ID NO: 3849 - DNA, 201 bp, Homo sapiens; identical to SEQ ID NO: 3772

SEQ ID NO: 3850 - DNA, 201 bp, Homo sapiens; identical to SEQ ID NO: 3773

SEQ ID NO: 3851 - DNA, 201 bp, Homo sapiens; identical to SEQ ID NO: 3774

SEQ ID NO: 3852 - DNA, 201 bp, Homo sapiens; identical to SEQ ID NO: 3775

SEQ ID NO: 3853 - DNA, 201 bp, Homo sapiens; identical to SEQ ID NO: 3776

SEQ ID NO: 3854 - DNA, 201 bp, Homo sapiens; identical to SEQ ID NO: 3777

SEQ ID NO: 3855 - DNA, 201 bp, Homo sapiens; identical to SEQ ID NO: 3779

SEQ ID NO: 3856 - DNA, 201 bp, Homo sapiens; identical to SEQ ID NO: 3778

SEQ ID NO: 3857 - DNA, 201 bp, Homo sapiens; identical to SEQ ID NO: 3780

SEQ ID NO: 3858 - DNA, 201 bp, Homo sapiens; identical to SEQ ID NO: 3781

SEQ ID NO: 3859 - DNA, 201 bp, Homo sapiens; identical to SEQ ID NO: 3782

SEQ ID NO: 3860 - DNA, 201 bp, Homo sapiens; identical to SEQ ID NO: 3783

SEQ ID NO: 3861 - DNA, 201 bp, Homo sapiens; identical to SEQ ID NO: 3784

SEQ ID NO: 3862 - DNA, 201 bp, Homo sapiens; identical to SEQ ID NO: 3785

SEQ ID NO: 3863 - DNA, 201 bp, Homo sapiens; identical to SEQ ID NO: 3786

SEQ ID NO: 3864 - DNA, 201 bp, Homo sapiens; identical to SEQ ID NO: 3787

SEQ ID NO: 3865 - DNA, 201 bp, Homo sapiens; identical to SEQ ID NO: 3788

SEQ ID NO: 3866 - DNA, 201 bp, Homo sapiens; identical to SEQ ID NO: 3789

SEQ ID NO: 3867 - DNA, 201 bp, Homo sapiens; identical to SEQ ID NO: 3790

SEQ ID NO: 3868 - DNA, 201 bp, Homo sapiens; identical to SEQ ID NO: 3714

SEQ ID NO: 3869 - DNA, 201 bp, Homo sapiens; identical to SEQ ID NO: 3715

SEQ ID NO: 3870 - DNA, 201 bp, Homo sapiens; identical to SEQ ID NO: 3716

SEQ ID NO: 3871 - DNA, 201 bp, Homo sapiens; identical to SEQ ID NO: 3717

SEQ ID NO: 3872 - DNA, 201 bp, Homo sapiens
gaggagcagcgggtctaccgtcggaaggagcttgaggaggtgtcacctgagacccctgtggtgcctgctaccacccagcggaccctggccaggccaggccyggagcctgccccagccacagatgagcgggatcgtgtgcagaagaaaaccttcaccaagtgggtcaacaagcacctcatcaaggcccagaggcacatcagt

SEQ ID NO: 3873 - DNA, 201 bp, Homo sapiens; identical to SEQ ID NO: 3718

SEQ ID NO: 3874 - DNA, 201 bp, Homo sapiens; identical to SEQ ID NO: 3719

SEQ ID NO: 3875 - DNA, 201 bp, Homo sapiens; identical to SEQ ID NO: 3720

SEQ ID NO: 3876 - DNA, 201 bp, Homo sapiens; identical to SEQ ID NO: 3721

SEQ ID NO: 3877 - DNA, 201 bp, Homo sapiens; identical to SEQ ID NO: 3722

SEQ ID NO: 3878 - DNA, 201 bp, Homo sapiens; identical to SEQ ID NO: 3723

SEQ ID NO: 3879 - DNA, 201 bp, Homo sapiens; identical to SEQ ID NO: 3724

SEQ ID NO: 3880 - DNA, 201 bp, Homo sapiens; identical to SEQ ID NO: 3725

SEQ ID NO: 3881 - DNA, 201 bp, Homo sapiens; identical to SEQ ID NO: 3726

SEQ ID NO: 3882 - DNA, 201 bp, Homo sapiens; identical to SEQ ID NO: 3727

SEQ ID NO: 3883 - DNA, 201 bp, Homo sapiens; identical to SEQ ID NO: 3728

SEQ ID NO: 3884 - DNA, 201 bp, Homo sapiens; identical to SEQ ID NO: 3729

SEQ ID NO: 3885 - DNA, 201 bp, Homo sapiens; identical to SEQ ID NO: 3730

SEQ ID NO: 3886 - DNA, 201 bp, Homo sapiens; identical to SEQ ID NO: 3731

SEQ ID NO: 3887 - DNA, 201 bp, Homo sapiens; identical to SEQ ID NO: 3732

SEQ ID NO: 3888 - DNA, 201 bp, Homo sapiens; identical to SEQ ID NO: 3733

SEQ ID NO: 3889 - DNA, 201 bp, Homo sapiens; identical to SEQ ID NO: 3734

SEQ ID NO: 3890 - DNA, 201 bp, Homo sapiens; identical to SEQ ID NO: 3735

SEQ ID NO: 3891 - DNA, 201 bp, Homo sapiens; identical to SEQ ID NO: 3736

SEQ ID NO: 3892 - DNA, 201 bp, Homo sapiens; identical to SEQ ID NO: 3737

SEQ ID NO: 3893 - DNA, 201 bp, Homo sapiens; identical to SEQ ID NO: 3738

SEQ ID NO: 3894 - DNA, 201 bp, Homo sapiens; identical to SEQ ID NO: 3739

SEQ ID NO: 3895 - DNA, 201 bp, Homo sapiens; identical to SEQ ID NO: 3740

SEQ ID NO: 3896 - DNA, 201 bp, Homo sapiens; identical to SEQ ID NO: 3741

SEQ ID NO: 3897 - DNA, 201 bp, Homo sapiens; identical to SEQ ID NO: 3742

SEQ ID NO: 3898 - DNA, 201 bp, Homo sapiens; identical to SEQ ID NO: 3743

SEQ ID NO: 3899 - DNA, 201 bp, Homo sapiens; identical to SEQ ID NO: 3744

SEQ ID NO: 3900 - DNA, 201 bp, Homo sapiens; identical to SEQ ID NO: 3745

SEQ ID NO: 3901 - DNA, 201 bp, Homo sapiens; identical to SEQ ID NO: 3746

SEQ ID NO: 3902 - DNA, 201 bp, Homo sapiens; identical to SEQ ID NO: 3747

SEQ ID NO: 3903 - DNA, 201 bp, Homo sapiens; identical to SEQ ID NO: 3748

SEQ ID NO: 3904 - DNA, 201 bp, Homo sapiens; identical to SEQ ID NO: 3749

SEQ ID NO: 3905 - DNA, 201 bp, Homo sapiens; identical to SEQ ID NO: 3750

SEQ ID NO: 3906 - DNA, 201 bp, Homo sapiens; identical to SEQ ID NO: 3751

SEQ ID NO: 3907 - DNA, 201 bp, Homo sapiens; identical to SEQ ID NO: 3752

SEQ ID NO: 3908 - DNA, 201 bp, Homo sapiens; identical to SEQ ID NO: 3753

SEQ ID NO: 3909 - DNA, 201 bp, Homo sapiens; identical to SEQ ID NO: 3754

SEQ ID NO: 3910 - DNA, 201 bp, Homo sapiens; identical to SEQ ID NO: 3755

SEQ ID NO: 3911 - DNA, 201 bp, Homo sapiens; identical to SEQ ID NO: 3756

SEQ ID NO: 3912 - DNA, 201 bp, Homo sapiens; identical to SEQ ID NO: 3757

SEQ ID NO: 3913 - DNA, 201 bp, Homo sapiens; identical to SEQ ID NO: 3758

SEQ ID NO: 3914 - DNA, 201 bp, Homo sapiens; identical to SEQ ID NO: 3759

SEQ ID NO: 3915 - DNA, 201 bp, Homo sapiens; identical to SEQ ID NO: 3760

SEQ ID NO: 3916 - DNA, 201 bp, Homo sapiens; identical to SEQ ID NO: 3761

SEQ ID NO: 3917 - DNA, 201 bp, Homo sapiens; identical to SEQ ID NO: 3762

SEQ ID NO: 3918 - DNA, 201 bp, Homo sapiens; identical to SEQ ID NO: 3763

SEQ ID NO: 3919 - DNA, 201 bp, Homo sapiens; identical to SEQ ID NO: 3764

SEQ ID NO: 3920 - DNA, 201 bp, Homo sapiens; identical to SEQ ID NO: 3765

SEQ ID NO: 3921 - DNA, 201 bp, Homo sapiens; identical to SEQ ID NO: 3766

SEQ ID NO: 3922 - DNA, 201 bp, Homo sapiens; identical to SEQ ID NO: 3767

SEQ ID NO: 3923 - DNA, 201 bp, Homo sapiens; identical to SEQ ID NO: 3768

SEQ ID NO: 3924 - DNA, 201 bp, Homo sapiens; identical to SEQ ID NO: 3769

SEQ ID NO: 3925 - DNA, 201 bp, Homo sapiens; identical to SEQ ID NO: 3770

SEQ ID NO: 3926 - DNA, 201 bp, Homo sapiens; identical to SEQ ID NO: 3771

SEQ ID NO: 3927 - DNA, 201 bp, Homo sapiens; identical to SEQ ID NO: 3772

SEQ ID NO: 3928 - DNA, 201 bp, Homo sapiens; identical to SEQ ID NO: 3773

SEQ ID NO: 3929 - DNA, 201 bp, Homo sapiens; identical to SEQ ID NO: 3774

SEQ ID NO: 3930 - DNA, 201 bp, Homo sapiens; identical to SEQ ID NO: 3775

SEQ ID NO: 3931 - DNA, 201 bp, Homo sapiens; identical to SEQ ID NO: 3776

SEQ ID NO: 3932 - DNA, 201 bp, Homo sapiens; identical to SEQ ID NO: 3777

SEQ ID NO: 3933 - DNA, 201 bp, Homo sapiens; identical to SEQ ID NO: 3779

SEQ ID NO: 3934 - DNA, 201 bp, Homo sapiens; identical to SEQ ID NO: 3778

SEQ ID NO: 3935 - DNA, 201 bp, Homo sapiens; identical to SEQ ID NO: 3780

SEQ ID NO: 3936 - DNA, 201 bp, Homo sapiens
cctggtgccacttttactggtacctcaccaatgaaggcatcgcccacctccgccagtacctgcacctgccgccagagatcgtgcccgcctctctgcagcgygtgcgccgccccgtcgccatggtgatgcccgcacgccgcaccccccacgtgcaggctgtgcagggtcccctgggctccccacccaagcgggggccgctgc

SEQ ID NO: 3937 - DNA, 201 bp, Homo sapiens; identical to SEQ ID NO: 3781

SEQ ID NO: 3938 - DNA, 201 bp, Homo sapiens; identical to SEQ ID NO: 3782

SEQ ID NO: 3939 - DNA, 201 bp, Homo sapiens; identical to SEQ ID NO: 3783

SEQ ID NO: 3940 - DNA, 201 bp, Homo sapiens; identical to SEQ ID NO: 3784

SEQ ID NO: 3941 - DNA, 201 bp, Homo sapiens; identical to SEQ ID NO: 3785

SEQ ID NO: 3942 - DNA, 201 bp, Homo sapiens; identical to SEQ ID NO: 3786

SEQ ID NO: 3943 - DNA, 201 bp, Homo sapiens; identical to SEQ ID NO: 3787

SEQ ID NO: 3944 - DNA, 201 bp, Homo sapiens; identical to SEQ ID NO: 3788

SEQ ID NO: 3945 - DNA, 201 bp, Homo sapiens; identical to SEQ ID NO: 3789

SEQ ID NO: 3946 - DNA, 201 bp, Homo sapiens; identical to SEQ ID NO: 3790

SEQ ID NO: 3947 - DNA, 201 bp, Homo sapiens; identical to SEQ ID NO: 3936

SEQ ID NO: 3948 - DNA, 201 bp, Homo sapiens
gaggagcagcgggtctaccgtcggaaggagcttgaggaggtgtcacctgagacccctgtggtgcctgctaccacccagcggaccctggccaggccaggccyggagcctgccccagccacaggtcagctgcaccctgaccccaagtcatgatgggtggcaagtaggggtctggttgtcgggtcttgggcctgggcctgggct

SEQ ID NO: 3949 - DNA, 201 bp, Homo sapiens; identical to SEQ ID NO: 3756

SEQ ID NO: 3950 - DNA, 201 bp, Homo sapiens; identical to SEQ ID NO: 3757

SEQ ID NO: 3951 - DNA, 201 bp, Homo sapiens; identical to SEQ ID NO: 3760

SEQ ID NO: 3952 - DNA, 201 bp, Homo sapiens; identical to SEQ ID NO: 3779

SEQ ID NO: 3953 - DNA, 201 bp, Homo sapiens; identical to SEQ ID NO: 3780

SEQ ID NO: 3954 - DNA, 201 bp, Homo sapiens; identical to SEQ ID NO: 3781

SEQ ID NO: 3955 - DNA, 201 bp, Homo sapiens; identical to SEQ ID NO: 3716

SEQ ID NO: 3956 - DNA, 201 bp, Homo sapiens; identical to SEQ ID NO: 3717

SEQ ID NO: 3957 - DNA, 201 bp, Homo sapiens; identical to SEQ ID NO: 3718

SEQ ID NO: 3958 - DNA, 201 bp, Homo sapiens; identical to SEQ ID NO: 3720

SEQ ID NO: 3959 - DNA, 201 bp, Homo sapiens; identical to SEQ ID NO: 3732

SEQ ID NO: 3960 - DNA, 201 bp, Homo sapiens; identical to SEQ ID NO: 3733

SEQ ID NO: 3961 - DNA, 201 bp, Homo sapiens; identical to SEQ ID NO: 3735

SEQ ID NO: 3962 - DNA, 201 bp, Homo sapiens; identical to SEQ ID NO: 3736

SEQ ID NO: 3963 - DNA, 201 bp, Homo sapiens
tggagctggcctcgcgcgtgaaggccgagaccgaggcggcgcgcgagaagcagcgggccctgcaggccctggaggagctgcggctgcaggcggaggaggcrgagcggcgcctgcggcaggccgaggtggagcgagcgcggcaggtacaggtggccctggagacggcgcagcgcagtgcagaggcggagctgcagagcaaac

SEQ ID NO: 3964 - DNA, 201 bp, Homo sapiens
tgcagttggaggccaccgagcgccagcgtggcggggctgagggggagctgcaggcactgcgtgcacgggcggaggaggctgaggcacaaaagcgacaggcrcaggaggaggccgagcgcttgcggaggcaggtgcaggacgagagccagcgtaagcggcaggcggaggtggagctggcctcgcgcgtgaaggccgagaccg

SEQ ID NO: 3965 - DNA, 201 bp, Homo sapiens; identical to SEQ ID NO: 3742

SEQ ID NO: 3966 - DNA, 201 bp, Homo sapiens; identical to SEQ ID NO: 3743

SEQ ID NO: 3967 - DNA, 201 bp, Homo sapiens; identical to SEQ ID NO: 3744

SEQ ID NO: 3968 - DNA, 201 bp, Homo sapiens
agatgaaccgcgtcctggcggaccccagcgacgacaccaagggcttctttgaccccaacacgcacgagaacctcacgtacctgcagctactggagcgctgygtggaggaccccgagacgggcctgtgccttctgccactcacggataaggctgccgagggcggggagctggtctacactgactccgaggcccgggacgtct

SEQ ID NO: 3969 - DNA, 201 bp, Homo sapiens; identical to SEQ ID NO: 3762

SEQ ID NO: 3970 - DNA, 201 bp, Homo sapiens; identical to SEQ ID NO: 3763

SEQ ID NO: 3971 - DNA, 201 bp, Homo sapiens; identical to SEQ ID NO: 3764

SEQ ID NO: 3972 - DNA, 201 bp, Homo sapiens; identical to SEQ ID NO: 3765

SEQ ID NO: 3973 - DNA, 201 bp, Homo sapiens; identical to SEQ ID NO: 3771

SEQ ID NO: 3974 - DNA, 201 bp, Homo sapiens; identical to SEQ ID NO: 3777

SEQ ID NO: 3975 - DNA, 201 bp, Homo sapiens; identical to SEQ ID NO: 3778

SEQ ID NO: 3976 - DNA, 201 bp, Homo sapiens; identical to SEQ ID NO: 3782

SEQ ID NO: 3977 - DNA, 201 bp, Homo sapiens; identical to SEQ ID NO: 3783

SEQ ID NO: 3978 - DNA, 201 bp, Homo sapiens
cagagatcatccgccagcagggtctggcctcctatgactacgtgcgccgccgcctcacggctgaggacctgttcgaggctcggatcatctctctcgagacytacaacctgctccgggagggcaccaggagcctccgtgaggctctcgaggcggagtccgcctggtgctacctctatggcacgggctccgtggctggtgtct

SEQ ID NO: 3979 - DNA, 201 bp, Homo sapiens; identical to SEQ ID NO: 3785

SEQ ID NO: 3980 - DNA, 201 bp, Homo sapiens; identical to SEQ ID NO: 3786

SEQ ID NO: 3981 - DNA, 201 bp, Homo sapiens; identical to SEQ ID NO: 3721

SEQ ID NO: 3982 - DNA, 201 bp, Homo sapiens; identical to SEQ ID NO: 3722

SEQ ID NO: 3983 - DNA, 201 bp, Homo sapiens; identical to SEQ ID NO: 3723

SEQ ID NO: 3984 - DNA, 201 bp, Homo sapiens; identical to SEQ ID NO: 3724

SEQ ID NO: 3985 - DNA, 201 bp, Homo sapiens; identical to SEQ ID NO: 3725

SEQ ID NO: 3986 - DNA, 201 bp, Homo sapiens; identical to SEQ ID NO: 3726

SEQ ID NO: 3987 - DNA, 201 bp, Homo sapiens; identical to SEQ ID NO: 3747

SEQ ID NO: 3988 - DNA, 201 bp, Homo sapiens; identical to SEQ ID NO: 3768

SEQ ID NO: 3989 - DNA, 201 bp, Homo sapiens
ggagcggcggcgccgtgaggctgaggagcgcgtgcagaagagcctggcggccgaggaggaggccgcacggcagcggaaggcggcgctggaggaagtcgagyggctgaaagccaacgtggaggaggcgcggcgcctgcgggagcgagcggagcaggagtcggcgcggcagctgcagctggcccaggaggccgcccagaagcg

SEQ ID NO: 3990 - DNA, 201 bp, Homo sapiens
aggtggaggaagagatcctggcgctgaaggcgagcttcgagaaggcggccgctggcaaggcggagctggagctggagctgggacgcatccgcagcaacgcrgaggacacgctgcgcagcaaggagcaggccgagctggaggccgcgaggcagcggcagctggcggcggaggaggagcggcggcgccgtgaggctgaggagc

SEQ ID NO: 3991 - DNA, 201 bp, Homo sapiens; identical to SEQ ID NO: 3788

SEQ ID NO: 3992 - DNA, 201 bp, Homo sapiens; identical to SEQ ID NO: 3789

SEQ ID NO: 3993 - DNA, 201 bp, Homo sapiens; identical to SEQ ID NO: 3748

SEQ ID NO: 3994 - DNA, 201 bp, Homo sapiens; identical to SEQ ID NO: 3749

SEQ ID NO: 3995 - DNA, 201 bp, Homo sapiens; identical to SEQ ID NO: 3750

SEQ ID NO: 3996 - DNA, 201 bp, Homo sapiens; identical to SEQ ID NO: 3751

SEQ ID NO: 3997 - DNA, 201 bp, Homo sapiens; identical to SEQ ID NO: 3752

SEQ ID NO: 3998 - DNA, 201 bp, Homo sapiens; identical to SEQ ID NO: 3753

SEQ ID NO: 3999 - DNA, 201 bp, Homo sapiens
tggaaggcaccagctgcatcgctggtgtcttcgtggacgccaccaaggaacggctctcggtgtaccaggccatgaagaaaggcatcatccgccccggcacrgcctttgagctcctggaggcgcaggcggccaccggttacgtcatcgaccccatcaagggactgaagctgacggtggaggaggctgtgcgtatgggcattg

SEQ ID NO: 4000 - DNA, 201 bp, Homo sapiens; identical to SEQ ID NO: 3755

SEQ ID NO: 4001 - DNA, 201 bp, Homo sapiens; identical to SEQ ID NO: 3758

SEQ ID NO: 4002 - DNA, 201 bp, Homo sapiens; identical to SEQ ID NO: 3759

SEQ ID NO: 4003 - DNA, 201 bp, Homo sapiens; identical to SEQ ID NO: 3773

SEQ ID NO: 4004 - DNA, 201 bp, Homo sapiens; identical to SEQ ID NO: 3774

SEQ ID NO: 4005 - DNA, 201 bp, Homo sapiens; identical to SEQ ID NO: 3790

SEQ ID NO: 4006 - DNA, 201 bp, Homo sapiens; identical to SEQ ID NO: 3731

SEQ ID NO: 4007 - DNA, 201 bp, Homo sapiens; identical to SEQ ID NO: 3734

SEQ ID NO: 4008 - DNA, 201 bp, Homo sapiens; identical to SEQ ID NO: 3714

SEQ ID NO: 4009 - DNA, 201 bp, Homo sapiens; identical to SEQ ID NO: 3715

SEQ ID NO: 4010 - DNA, 201 bp, Homo sapiens; identical to SEQ ID NO: 3727

SEQ ID NO: 4011 - DNA, 201 bp, Homo sapiens
ggatgagctgcggggggcacaggaggtgggggagcgactgcagcagcggcacggggagcgggacttggaggtggagcgctggcgggagcgggtcgcccagytgcttgagcgctggcaggctgtgctggcccagaccgacttgcggcagcgcgagctcgagcaactgggccgccagctgcgttactaccgcgagagtgcaga

SEQ ID NO: 4012 - DNA, 201 bp, Homo sapiens; identical to SEQ ID NO: 3729

SEQ ID NO: 4013 - DNA, 201 bp, Homo sapiens; identical to SEQ ID NO: 3740

SEQ ID NO: 4014 - DNA, 201 bp, Homo sapiens; identical to SEQ ID NO: 3746

SEQ ID NO: 4015 - DNA, 201 bp, Homo sapiens; identical to SEQ ID NO: 3761

SEQ ID NO: 4016 - DNA, 201 bp, Homo sapiens; identical to SEQ ID NO: 3766

SEQ ID NO: 4017 - DNA, 201 bp, Homo sapiens; identical to SEQ ID NO: 3767

SEQ ID NO: 4018 - DNA, 201 bp, Homo sapiens
ccatgcaccggaacctggtggataacatcacggggcagcggctgctggaggcgcaggcctgcaccgggggcatcatcgaccccagcaccggtgagcgcttscctgtcaccgacgccgtcaacaagggcctggtggacaagatcatggtggaccgcatcaacctggcccagaaggccttttgcggcttcgaggacccacgca

SEQ ID NO: 4019 - DNA, 201 bp, Homo sapiens
ggaggatgcgtttccacaagctgcagaatgtccagattgccctggactacctccggcaccgccaggtgaagctggtgaacatcagggatgatgacatcgcygacggcaaccccaagctgacccttggcctcatctggacaatcattctgcacttccagatctcagatatccaggtgagtgggcagtcggaggacatgacgg

SEQ ID NO: 4020 - DNA, 201 bp, Homo sapiens; identical to SEQ ID NO: 3741

SEQ ID NO: 4021 - DNA, 201 bp, Homo sapiens
agctggagctggagctgggacgcatccgcagcaacgcggaggacacgctgcgcagcaaggagcaggccgagctggaggccgcgaggcagcggcagctggcrgcggaggaggagcggcggcgccgtgaggctgaggagcgcgtgcagaagagcctggcggccgaggaggaggccgcacggcagcggaaggcggcgctggagg

SEQ ID NO: 4022 - DNA, 201 bp, Homo sapiens; identical to SEQ ID NO: 3776

SEQ ID NO: 4023 - DNA, 201 bp, Homo sapiens
cagccccctttgggcccagggacaccagccaggctctgtgctgaccctcctgttgcgcccagccctggtctcagcagcgaccacccctgcctccaccctcygagctttgcatgttccactaaccccgggcgggtggcaggtggaggtgtcaggctgctggcgcctctgcaagggcagaacactaacctgaccgtgggcggg

SEQ ID NO: 4024 - DNA, 201 bp, Homo sapiens; identical to SEQ ID NO: 3770

SEQ ID NO: 4025 - DNA, 201 bp, Homo sapiens; identical to SEQ ID NO: 3772

SEQ ID NO: 4026 - DNA, 201 bp, Homo sapiens
caatgagtgaacgggcactcgctcagaaaagactcagtgagaatgcatttgaccttgaagacatgagcatgttaaatagagctcaggaaaggattgatgcytgggctcagctgaactctattcctggccagttcacaggaagtacaggagtacaggttttgacacaagaacagttggccaatactggtgcccaacctggat

SEQ ID NO: 4027 - DNA, 201 bp, Homo sapiens
tacaggagtacaggttttgacacaagaacagttggccaatactggtgcccaacctggattaaaaaggatcagttcttaagagcagccccggtaactggagraacgggagccgttttgatgaggaaaatgggctggagagaaggagaaggattaggaaaaaacaaagaaggcaataaggaacccatcctagttgattttaag

SEQ ID NO: 4028 - DNA, 201 bp, Homo sapiens
gagaatgcatttgaccttgaagacatgagcatgttaaatagagctcaggaaaggattgatgcctgggctcagctgaactctattcctggccagttcacagkaagtacaggagtacaggttttgacacaagaacagttggccaatactggtgcccaacctggattaaaaaggatcagttcttaagagcagccccggtaactg

SEQ ID NO: 4029 - DNA, 201 bp, Homo sapiens
agtcggagtcatactccaagtcgtcgacgaaggtctagttctgtgggtagaagaaggagctttagcctttccccaagccgccggagccacacccccagcckccagagaagatcaaagtctgtggtaagaagacgaagcttcagtatctcaccaatcagattaaggcgatcaagaacacccttgagaagaaggtttagcaga

SEQ ID NO: 4030 - DNA, 201 bp, Homo sapiens
attgatgcctgggctcagctgaactctattcctggccagttcacaggaagtacaggagtacaggttttgacacaagaacagttggccaatactggtgcccracctggattaaaaaggatcagttcttaagagcagccccggtaactggaggaacgggagccgttttgatgaggaaaatgggctggagagaaggagaaggat

SEQ ID NO: 4031 - DNA, 201 bp, Homo sapiens
atctcccatccgtcgtaaaagatccaagtcttctgaacaaggcagaccatccaaacgtctaacagatttggataaggctcaattacttgaaatagctaaarctaatgcagctgccatgtgtgctaaggctggtgtccctttcccgccaaacctaaagcctgcacctccacctactatagaagagaaagttgctaaaaagtc

SEQ ID NO: 4032 - DNA, 201 bp, Homo sapiens
gccaggcaaacatcctgtgtctgctttgatggaaatctgaaataagagaaggtggcaaccacctgaatttctattggtccatgatagtggccctgatcatygcaaacgttttctctttagggtattgagaaatggaagcccttaccagcccacccaactttgccagccttaataagaagcatgctaaagacacagcagcta

SEQ ID NO: 4033 - DNA, 201 bp, Homo sapiens
cgacccccgcgaggctgcttttcttcgcgcccacccgccgcgcggcgccgcttgaggagatggaagccccggccgctgacgccatcatgtcgcccgaagakgagctggacgggtacgagccggagcctctcgggaagcggccggctgtcctgccgctgctggagttggtcggggaatctggtaataacaccagtacggacg

SEQ ID NO: 4034 - DNA, 201 bp, Homo sapiens
gggctctgattgggcaatactcatttgagttccttccatttgacctaatttaactggtgaaatttaaagtgaattcatgggctcatctttaaagcttttamtaaaagattttcagctgaatggaactcattagctgtgtgcatataaaaagatcacatcaggtggatggagagacatttgatcccttgtttgcttaataaa

SEQ ID NO: 4035 - DNA, 201 bp, Homo sapiens
atctttaaagcttttactaaaagattttcagctgaatggaactcattagctgtgtgcatataaaaagatcacatcaggtggatggagagacatttgatccyttgtttgcttaataaattataaaatgatggcttggaaaagcaggctagtctaaccatggtgctattattaggcttgcttgttacacacacaggtctaagc

SEQ ID NO: 4036 - DNA, 201 bp, Homo sapiens
agaccttacgacgggttggggatggcgtgcagcgcaaccacgagacggccttccaaggcatgcttcggaaactggacatcaaaaacgaagacgatgtgaartcgttgtctcgagtgatgatccatgttttcagcgacggcgtaacaaactggggcaggattgtgactctcatttcttttggtgcctttgtggctaaacact

SEQ ID NO: 4037 - DNA, 201 bp, Homo sapiens
ccaagtgctccccattgattgaagagtcactgtctgaaagaagcaaagttcagtttcagcaacaaacaaactttgtttgggaagctatggaggaggacttytagatttagtgaagatggtagggtggaaagacttaatttccttgttgagaacaggaaagtggccagtagccaggcaagtcatagaattgattacccgccg

SEQ ID NO: 4038 - DNA, 201 bp, Homo sapiens
aaggacacaaagccaatgggcaggtctggggccaccagcaggaaggcgctggagaccttacgacgggttggggatggcgtgcagcgcaaccacgagacggycttccaaggcatgcttcggaaactggacatcaaaaacgaagacgatgtgaaatcgttgtctcgagtgatgatccatgttttcagcgacggcgtaacaaac

SEQ ID NO: 4039 - DNA, 201 bp, Homo sapiens
gtctttgggggcaatgtgtcaaaagtcccctcaggaattttcagaggaaagaacattttatgaggctttctctaaagtttcctttgtataggagtatgctyacttaaatttacagaaagaggtgagctgtgttaaacctcagagtttaaaagctactgataaactgaagaaagtgtctatattggaactagggtcatttga

SEQ ID NO: 4040 - DNA, 201 bp, Homo sapiens
ggtcatttgaaagcttcagtctcggaacatgacctttagtctgtggactccatttaaaaataggtatgaataagatgactaagaatgtaatggggaagaaytgccctgcctgcccatctcagagccataaggtcatctttgctagagctatttttacctatgtatttatcgttcttgatcataagccgcttatttatatca

SEQ ID NO: 4041 - DNA, 201 bp, Homo sapiens
ggagaaggaggcctcggcccggcgagagatagggggaggggaggccggcgcggtgattggcggaagcgccggcgcaagccccccgtccaccctcacgccakactcccggagggtcgcgcggccgccgcccattggcgccgaggtccccgacgtcaccgcgacccccgcgaggctgcttttcttcgcgcccacccgccgcgc

SEQ ID NO: 4042 - DNA, 201 bp, Homo sapiens
acagaaagaggtgagctgtgttaaacctcagagtttaaaagctactgataaactgaagaaagtgtctatattggaactagggtcatttgaaagcttcagtytcggaacatgacctttagtctgtggactccatttaaaaataggtatgaataagatgactaagaatgtaatggggaagaactgccctgcctgcccatctca

SEQ ID NO: 4043 - DNA, 201 bp, Homo sapiens
tttttacctatgtatttatcgttcttgatcataagccgcttatttatatcatgtatctctaaggacctaaaagcactttatgtagtttttaattaatcttragatctggttacggtaactaaaaaagcctgtctgccaaatccagtggaaacaagtgcatagatgtgaattggtttttaggggccccacttcccaattcat

SEQ ID NO: 4044 - DNA, 201 bp, Homo sapiens; identical to SEQ ID NO: 4033

SEQ ID NO: 4045 - DNA, 201 bp, Homo sapiens; identical to SEQ ID NO: 4034

SEQ ID NO: 4046 - DNA, 201 bp, Homo sapiens; identical to SEQ ID NO: 4035

SEQ ID NO: 4047 - DNA, 201 bp, Homo sapiens
aagagtgctccccattgattgaagagtcactgtctgaaagaagcaaagttcagtttcagcaacaaacaaactttgtttgggaagctatggaggaggacttytagatttagtgaagatggtagggtggaaagacttaatttccttgttgagaacaggaaagtggccagtagccaggcaagtcatagaattgattacccgccg

SEQ ID NO: 4048 - DNA, 201 bp, Homo sapiens
aaggacacaaagccaatgggcaggtctggggccaccagcaggaaggcgctggagaccttacgacgggttggggatggcgtgcagcgcaaccacgagacggycttccaaggatgggtttgtggagttcttccatgtagaggacctagaaggtggcatcaggaatgtgctgctggcttttgcaggtgttgctggagtaggagc

SEQ ID NO: 4049 - DNA, 201 bp, Homo sapiens; identical to SEQ ID NO: 4039

SEQ ID NO: 4050 - DNA, 201 bp, Homo sapiens; identical to SEQ ID NO: 4040

SEQ ID NO: 4051 - DNA, 201 bp, Homo sapiens; identical to SEQ ID NO: 4041

SEQ ID NO: 4052 - DNA, 201 bp, Homo sapiens; identical to SEQ ID NO: 4042

SEQ ID NO: 4053 - DNA, 201 bp, Homo sapiens
tttttacctatgtatttatcgttcttgatcataagccgcttatttatatcatgtatctctaaggacctaaaagcactttatgtagtttttaattaatcttragatctggttacggtaactaaaaaagggccccacttcccaattcattaggtatgactgtggaaatacagacaaggatcttagttgatattttgggcttgg

SEQ ID NO: 4054 - DNA, 201 bp, Homo sapiens; identical to SEQ ID NO: 4033

SEQ ID NO: 4055 - DNA, 201 bp, Homo sapiens; identical to SEQ ID NO: 4034

SEQ ID NO: 4056 - DNA, 201 bp, Homo sapiens; identical to SEQ ID NO: 4035

SEQ ID NO: 4057 - DNA, 201 bp, Homo sapiens
gactggctacgtagttcgggcaaatcctccaaaagggaaagggaggatttgcttagaaggatggcgctcccagtgactactttttgacttctgtttgtctyacgcttctctcagggaaaaacatgcagtcctctagtgtttcatgtacattctgtggggggtgaacaccttggttctggttaaacagctgtacttttgata

SEQ ID NO: 4058 - DNA, 201 bp, Homo sapiens
tacgtagttcgggcaaatcctccaaaagggaaagggaggatttgcttagaaggatggcgctcccagtgactactttttgacttctgtttgtcttacgcttmtctcagggaaaaacatgcagtcctctagtgtttcatgtacattctgtggggggtgaacaccttggttctggttaaacagctgtacttttgatagctgtgc

SEQ ID NO: 4059 - DNA, 201 bp, Homo sapiens; identical to SEQ ID NO: 4036

SEQ ID NO: 4060 - DNA, 201 bp, Homo sapiens
tcccagtgactactttttgacttctgtttgtcttacgcttctctcagggaaaaacatgcagtcctctagtgtttcatgtacattctgtggggggtgaacaycttggttctggttaaacagctgtacttttgatagctgtgccaggaagggttaggaccaactacaaattaatgttggttgtcaaatgtagtgtgtttccct

SEQ ID NO: 4061 - DNA, 201 bp, Homo sapiens; identical to SEQ ID NO: 4038

SEQ ID NO: 4062 - DNA, 201 bp, Homo sapiens; identical to SEQ ID NO: 4047

SEQ ID NO: 4063 - DNA, 201 bp, Homo sapiens; identical to SEQ ID NO: 4039

SEQ ID NO: 4064 - DNA, 201 bp, Homo sapiens
caaaagggaaagggaggatttgcttagaaggatggcgctcccagtgactactttttgacttctgtttgtcttacgcttctctcagggaaaaacatgcagtsctctagtgtttcatgtacattctgtggggggtgaacaccttggttctggttaaacagctgtacttttgatagctgtgccaggaagggttaggaccaacta

SEQ ID NO: 4065 - DNA, 201 bp, Homo sapiens; identical to SEQ ID NO: 4040

SEQ ID NO: 4066 - DNA, 201 bp, Homo sapiens; identical to SEQ ID NO: 4041

SEQ ID NO: 4067 - DNA, 201 bp, Homo sapiens; identical to SEQ ID NO: 4042

SEQ ID NO: 4068 - DNA, 201 bp, Homo sapiens; identical to SEQ ID NO: 4043

SEQ ID NO: 4069 - DNA, 201 bp, Homo sapiens
agtcttccctgcccaccatccccatcatgggtatcgttgctggcctggttgtccttgcagctgtagtcactggagctgcggtcgctgctgtgctgtggagraagaagagctcagattgaaaaggagggagctactctcaggctgcaagtaagtatgaaggaggctgatccctgagatccttgggatcttgtgtttgggagc

SEQ ID NO: 4070 - DNA, 201 bp, Homo sapiens
gcacagactgacagaatgaacctgcagaccctgcgcggctactacaaccagagcgaggccagttctcacaccctccagtggatgattggctgcgacctggkgtccgacggacgcctcctccgcgggtatgaacagtatgcctacgatggcaaggattacctcgccctgaacgaggacctgcgctcctggaccgcagcggac

SEQ ID NO: 4071 - DNA, 201 bp, Homo sapiens
ccaaggcccacgcacagactgacagaatgaacctgcagaccctgcgcggctactacaaccagagcgaggccagttctcacaccctccagtggatgattggytgcgacctggggtccgacggacgcctcctccgcgggtatgaacagtatgcctacgatggcaaggattacctcgccctgaacgaggacctgcgctcctgga

SEQ ID NO: 4072 - DNA, 201 bp, Homo sapiens
gggcgggctcccactccatgaggtatttcagcgccgccgtgtcccggcccggccgcggggagccccgcttcatcgccatgggctacgtggacgacacgcarttcgtgcggttcgacagcgactcggcgtgtccgaggatggagccgcgggcgccgtgggtggagcaggaggggccggagtattgggaagaggagacacgga

SEQ ID NO: 4073 - DNA, 201 bp, Homo sapiens
gacctgggcgggctcccactccatgaggtatttcagcgccgccgtgtcccggcccggccgcggggagccccgcttcatcgccatgggctacgtggacgacwcgcagttcgtgcggttcgacagcgactcggcgtgtccgaggatggagccgcgggcgccgtgggtggagcaggaggggccggagtattgggaagaggagac

SEQ ID NO: 4074 - DNA, 201 bp, Homo sapiens
acccaggacgtggagctcgtggagaccaggcctgcaggggatggaaccttccagaagtgggcagctgtggtggtgccttctggagaggagcagagatacaygtgccatgtgcagcatgaggggctgccggagcccctcatgctgagatggaagcagtcttccctgcccaccatccccatcatgggtatcgttgctggcctg

SEQ ID NO: 4075 - DNA, 201 bp, Homo sapiens
aaaggagagcctacctggagggcacgtgcgtggagtggctccacagatacctggagaacgggaaggagatgctgcagcgcgcggacccccccaagacacaygtgacccaccaccctgtctttgactatgaggccaccctgaggtgctgggccctgggcttctaccctgcggagatcatactgacctggcagcgggatgggg

SEQ ID NO: 4076 - DNA, 178 bp, Homo sapiens
cagaaaaggggctgggatgtctccgtctctgtctcaaatttgtggtgcactgagctataacttacttctgtattaaaattagaatctgagtataaatttastttttcaaattatttccaagagagattgatgggttaattaaaggagaagattcctgaaatttgagagacaaaataaa

SEQ ID NO: 4077 - DNA, 201 bp, Homo sapiens
tctctcacggcttgtaaatgtgacaccccggggggcctgatgtgtgtgggttgttgaggggaacagtggacatagctgtgctatgaggtttctttgacttsaatgtattgagcatgtgatgggctgtttaaagtgtcacccctcactgtgactgatatgaatttgttcatgaatatttttctgtagtgtgaaacagctgcc

SEQ ID NO: 4078 - DNA, 201 bp, Homo sapiens
cccaggacgtggagctcgtggagaccaggcctgcaggggatggaaccttccagaagtgggcagctgtggtggtgccttctggagaggagcagagatacacrtgccatgtgcagcatgaggggctgccggagcccctcatgctgagatggaagcagtcttccctgcccaccatccccatcatgggtatcgttgctggcctgg

SEQ ID NO: 4079 - DNA, 201 bp, Homo sapiens
tctaggcagtgacagtgcccagggctctaatgtgtctctcacggcttgtaaatgtgacaccccggggggcctgatgtgtgtgggttgttgaggggaacagbggacatagctgtgctatgaggtttctttgacttgaatgtattgagcatgtgatgggctgtttaaagtgtcacccctcactgtgactgatatgaatttgtt

SEQ ID NO: 4080 - DNA, 187 bp, Homo sapiens
ttcctgttccagaaaaggggctgggatgtctccgtctctgtctcaaatttgtggtgcactgagctataacttacttctgtattaaaattagaatctgagtrtaaatttactttttcaaattatttccaagagagattgatgggttaattaaaggagaagattcctgaaatttgagagacaaaataaa

SEQ ID NO: 4081 - DNA, 201 bp, Homo sapiens
gaacctgcagaccctgcgcggctactacaaccagagcgaggccagttctcacaccctccagtggatgattggctgcgacctggggtccgacggacgcctcmtccgcgggtatgaacagtatgcctacgatggcaaggattacctcgccctgaacgaggacctgcgctcctggaccgcagcggacactgcggctcagatctc

SEQ ID NO: 4082 - DNA, 201 bp, Homo sapiens
ttctactctaggcagtgacagtgcccagggctctaatgtgtctctcacggcttgtaaatgtgacaccccggggggcctgatgtgtgtgggttgttgagggvaacagtggacatagctgtgctatgaggtttctttgacttgaatgtattgagcatgtgatgggctgtttaaagtgtcacccctcactgtgactgatatgaa

SEQ ID NO: 4083 - DNA, 201 bp, Homo sapiens
tgaccctcttcctcatgctgaactgcattccttccccaatcacctttcctgttccagaaaaggggctgggatgtctccgtctctgtctcaaatttgtggtscactgagctataacttacttctgtattaaaattagaatctgagtataaatttactttttcaaattatttccaagagagattgatgggttaattaaaggag

SEQ ID NO: 4084 - DNA, 201 bp, Homo sapiens
ccatgggctacgtggacgacacgcagttcgtgcggttcgacagcgactcggcgtgtccgaggatggagccgcgggcgccgtgggtggagcaggaggggccrgagtattgggaagaggagacacggaacaccaaggcccacgcacagactgacagaatgaacctgcagaccctgcgcggctactacaaccagagcgaggcca

SEQ ID NO: 4085 - DNA, 201 bp, Homo sapiens
ctgatatgaatttgttcatgaatatttttctgtagtgtgaaacagctgccctgtgtgggactgagtggcaagtccctttgtgacttcaagaaccctgactyctctttctgcagagaccagcccacccctgtgcccaccatgaccctcttcctcatgctgaactgcattccttccccaatcacctttcctgttccagaaaag

SEQ ID NO: 4086 - DNA, 201 bp, Homo sapiens
gaatttgttcatgaatatttttctgtagtgtgaaacagctgccctgtgtgggactgagtggcaagtccctttgtgacttcaagaaccctgacttctctttstgcagagaccagcccacccctgtgcccaccatgaccctcttcctcatgctgaactgcattccttccccaatcacctttcctgttccagaaaaggggctgg

SEQ ID NO: 4087 - DNA, 201 bp, Homo sapiens
agtatgcctacgatggcaaggattacctcgccctgaacgaggacctgcgctcctggaccgcagcggacactgcggctcagatctccaagcgcaagtgtgargcggccaatgtggctgaacaaaggagagcctacctggagggcacgtgcgtggagtggctccacagatacctggagaacgggaaggagatgctgcagcgcg

SEQ ID NO: 4088 - DNA, 149 bp, Homo sapiens
cccattaggtgacaggtttttagagaagccaatcagcgtcgccgcggtyctggttctaaagtcctcgctcacccacccggactcattctccccagacgccaaggatggtggtcatggcgccccgaaccctcttcctgctgctctcgggg

SEQ ID NO: 4089 - DNA, 201 bp, Homo sapiens
cgccgcggtcctggttctaaagtcctcgctcacccacccggactcattctccccagacgccaaggatggtggtcatggcgccccgaaccctcttcctgctrctctcgggggccctgaccctgaccgagacctgggcgggctcccactccatgaggtatttcagcgccgccgtgtcccggcccggccgcggggagccccgct

SEQ ID NO: 4090 - DNA, 201 bp, Homo sapiens
ggcctgcaggggatggaaccttccagaagtgggcagctgtggtggtgccttctggagaggagcagagatacacgtgccatgtgcagcatgaggggctgccrgagcccctcatgctgagatggaagcagtcttccctgcccaccatccccatcatgggtatcgttgctggcctggttgtccttgcagctgtagtcactggag

SEQ ID NO: 4091 - DNA, 201 bp, Homo sapiens
tttagagaagccaatcagcgtcgccgcggtcctggttctaaagtcctcgctcacccacccggactcattctccccagacgccaaggatggtggtcatggcrccccgaaccctcttcctgctgctctcgggggccctgaccctgaccgagacctgggcgggctcccactccatgaggtatttcagcgccgccgtgtcccggc

SEQ ID NO: 4092 - DNA, 201 bp, Homo sapiens
acagaatgaacctgcagaccctgcgcggctactacaaccagagcgaggccagttctcacaccctccagtggatgattggctgcgacctggggtccgacggwcgcctcctccgcgggtatgaacagtatgcctacgatggcaaggattacctcgccctgaacgaggacctgcgctcctggaccgcagcggacactgcggctc

SEQ ID NO: 4093 - DNA, 201 bp, Homo sapiens
gggaagaggagacacggaacaccaaggcccacgcacagactgacagaatgaacctgcagaccctgcgcggctactacaaccagagcgaggccagttctcayaccctccagtggatgattggctgcgacctggggtccgacggacgcctcctccgcgggtatgaacagtatgcctacgatggcaaggattacctcgccctga

SEQ ID NO: 4094 - DNA, 201 bp, Homo sapiens
aaaggagggagctactctcaggctgcaatgtgaaacagctgccctgtgtgggactgagtggcaagtccctttgtgacttcaagaaccctgacttctctttstgcagagaccagcccacccctgtgcccaccatgaccctcttcctcatgctgaactgcattccttccccaatcacctttcctgttccagaaaaggggctgg

SEQ ID NO: 4095 - DNA, 201 bp, Homo sapiens
agtcttccctgcccaccatccccatcatgggtatcgttgctggcctggttgtccttgcagctgtagtcactggagctgcggtcgctgctgtgctgtggagraagaagagctcagattgaaaaggagggagctactctcaggctgcaatgtgaaacagctgccctgtgtgggactgagtggcaagtccctttgtgacttcaa

SEQ ID NO: 4096 - DNA, 166 bp, Homo sapiens
gccgtgtcccggcccggccgcggggagccccgcttcatcgccatgggctacgtggacgacacgcarttcgtgcggttcgacagcgactcggcgtgtccgaggatggagccgcgggcgccgtgggtggagcaggaggggccggagtattgggaagaggagacacgga

SEQ ID NO: 4097 - DNA, 161 bp, Homo sapiens
gccgtgtcccggcccggccgcggggagccccgcttcatcgccatgggctacgtggacgacwcgcagttcgtgcggttcgacagcgactcggcgtgtccgaggatggagccgcgggcgccgtgggtggagcaggaggggccggagtattgggaagaggagac

SEQ ID NO: 4098 - DNA, 201 bp, Homo sapiens; identical to SEQ ID NO: 4090

SEQ ID NO: 4099 - DNA, 201 bp, Homo sapiens; identical to SEQ ID NO: 4074

SEQ ID NO: 4100 - DNA, 199 bp, Homo sapiens
cagaaaaggggctgggatgtctccgtctctgtctcaaatttgtggtgcactgagctataacttacttctgtattaaaattagaatctgagtataaatttastttttcaaattatttccaagagagattgatgggttaattaaaggagaagattcctgaaatttgagagacaaaataaatggaagacatgagaactttcc

SEQ ID NO: 4101 - DNA, 201 bp, Homo sapiens; identical to SEQ ID NO: 4078

SEQ ID NO: 4102 - DNA, 201 bp, Homo sapiens
ttcctgttccagaaaaggggctgggatgtctccgtctctgtctcaaatttgtggtgcactgagctataacttacttctgtattaaaattagaatctgagtrtaaatttactttttcaaattatttccaagagagattgatgggttaattaaaggagaagattcctgaaatttgagagacaaaataaatggaagacatgaga

SEQ ID NO: 4103 - DNA, 201 bp, Homo sapiens; identical to SEQ ID NO: 4083

SEQ ID NO: 4104 - DNA, 201 bp, Homo sapiens
agattgaaaaggagggagctactctcaggctgcaatgtgaaacagctgccctgtgtgggactgagtggcaagtccctttgtgacttcaagaaccctgactyctctttctgcagagaccagcccacccctgtgcccaccatgaccctcttcctcatgctgaactgcattccttccccaatcacctttcctgttccagaaaag

SEQ ID NO: 4105 - DNA, 201 bp, Homo sapiens; identical to SEQ ID NO: 4084

SEQ ID NO: 4106 - DNA, 184 bp, Homo sapiens
attaggagatgtcctggactcacacagaaactcagggctatggaatgaagggcaagctcactctctggcaacaagctccctggrgtgatttttcttctagaagagtccacggggacagggtttctcttctccctctcccaacctgtgtcgggtccttcttcctggatactcaccaggctgcccc

SEQ ID NO: 4107 - DNA, 201 bp, Homo sapiens
caggatggagccggaggggccggaatattgggaagaggagacagggaccgccaaggccaaagcacagttttaccgagtgaacctgcggaccctgagcggcyactacaaccagagtgaggcctgtgagtgacaccggccgggggcgcagatcactacccctctacatcccccacggaccgcccgggtctccccgagtctctg

SEQ ID NO: 4108 - DNA, 201 bp, Homo sapiens
cggcccggccgcgcggatccccgcttcctctccgtgggcgacgtggacgacacgcagtgcgtgcggctcgacagcgacgccacgagtcccaggatggagcmggaggggccggaatattgggaagaggagacagggaccgccaaggccaaagcacagttttaccgagtgaacctgcggaccctgagcggctactacaaccag

SEQ ID NO: 4109 - DNA, 201 bp, Homo sapiens
gagtgaacctgcggaccctgagcggctactacaaccagagtgaggcctgtgagtgacaccggccgggggcgcagatcactacccctctacatcccccacgraccgcccgggtctccccgagtctctgggtccgagatccacgccgaggcagcggaacctggagaccctttacccgggagaggcccaggagccgttacccgg

SEQ ID NO: 4110 - DNA, 201 bp, Homo sapiens
aaagcacagttttaccgagtgaacctgcggaccctgagcggctactacaaccagagtgaggcctgtgagtgacaccggccgggggcgcagatcactacccstctacatcccccacggaccgcccgggtctccccgagtctctgggtccgagatccacgccgaggcagcggaacctggagaccctttacccgggagaggccc

SEQ ID NO: 4111 - DNA, 201 bp, Homo sapiens
cgccaaggccaaagcacagttttaccgagtgaacctgcggaccctgagcggctactacaaccagagtgaggcctgtgagtgacaccggccgggggcgcagrtcactacccctctacatcccccacggaccgcccgggtctccccgagtctctgggtccgagatccacgccgaggcagcggaacctggagaccctttacccg

SEQ ID NO: 4112 - DNA, 201 bp, Homo sapiens
gcacagttttaccgagtgaacctgcggaccctgagcggctactacaaccagagtgaggcctgtgagtgacaccggccgggggcgcagatcactacccctcyacatcccccacggaccgcccgggtctccccgagtctctgggtccgagatccacgccgaggcagcggaacctggagaccctttacccgggagaggcccagg

SEQ ID NO: 4113 - DNA, 201 bp, Homo sapiens
tccactccttgaggtatttccacaccaccatgtcccggcccggccgcgcggatccccgcttcctctccgtgggcgacgtggacgacacgcagtgcgtgcgsctcgacagcgacgccacgagtcccaggatggagccggaggggccggaatattgggaagaggagacagggaccgccaaggccaaagcacagttttaccgag

SEQ ID NO: 4114 - DNA, 201 bp, Homo sapiens; identical to SEQ ID NO: 4087

SEQ ID NO: 4115 - DNA, 201 bp, Homo sapiens; identical to SEQ ID NO: 4070

SEQ ID NO: 4116 - DNA, 201 bp, Homo sapiens; identical to SEQ ID NO: 4071

SEQ ID NO: 4117 - DNA, 201 bp, Homo sapiens
gggcaggctcccactccatgaggtatttcagcgccgccgtgtcccggcccggccgcggggagccccgcttcatcgccatgggctacgtggacgacacgcarttcgtgcggttcgacagcgactcggcgtgtccgaggatggagccgcgggcgccgtgggtggagcaggaggggccggagtattgggaagaggagacacgga

SEQ ID NO: 4118 - DNA, 201 bp, Homo sapiens
gacctgggcaggctcccactccatgaggtatttcagcgccgccgtgtcccggcccggccgcggggagccccgcttcatcgccatgggctacgtggacgacwcgcagttcgtgcggttcgacagcgactcggcgtgtccgaggatggagccgcgggcgccgtgggtggagcaggaggggccggagtattgggaagaggagac

SEQ ID NO: 4119 - DNA, 176 bp, Homo sapiens
gcgtggagtggctccacagatacctggagaacgggaaggagatgctgcagcgcgcggggccatcttcccagcccacattcctcatcatgggcatcgttacygtcctggttgttctaggtgctgtggtcactgctgtgatgtggaagaataagaccccaggtaggaaaggggtgagt

SEQ ID NO: 4120 - DNA, 201 bp, Homo sapiens; identical to SEQ ID NO: 4092

SEQ ID NO: 4121 - DNA, 182 bp, Homo sapiens
gcacgtgcgtggagtggctccacagatacctggagaacgggaaggagatgctgcagcgcgcggggccatcttcccagcccacattcctcatcatgggcatygttaccgtcctggttgttctaggtgctgtggtcactgctgtgatgtggaagaataagaccccaggtaggaaaggggtgagt

SEQ ID NO: 4122 - DNA, 190 bp, Homo sapiens
cctggagggcacgtgcgtggagtggctccacagatacctggagaacgggaaggagatgctgcagcgcgcggggccatcttcccagcccacattcctcatcrtgggcatcgttaccgtcctggttgttctaggtgctgtggtcactgctgtgatgtggaagaataagaccccaggtaggaaaggggtgagt

SEQ ID NO: 4123 - DNA, 195 bp, Homo sapiens
gcctacctggagggcacgtgcgtggagtggctccacagatacctggagaacgggaaggagatgctgcagcgcgcggggccatcttcccagcccacattccycatcatgggcatcgttaccgtcctggttgttctaggtgctgtggtcactgctgtgatgtggaagaataagaccccaggtaggaaaggggtgagt

SEQ ID NO: 4124 - DNA, 201 bp, Homo sapiens; identical to SEQ ID NO: 4081

SEQ ID NO: 4125 - DNA, 201 bp, Homo sapiens; identical to SEQ ID NO: 4093

SEQ ID NO: 4126 - DNA, 201 bp, Homo sapiens; identical to SEQ ID NO: 4084

SEQ ID NO: 4127 - DNA, 201 bp, Homo sapiens; identical to SEQ ID NO: 4095

SEQ ID NO: 4128 - DNA, 201 bp, Homo sapiens; identical to SEQ ID NO: 4070

SEQ ID NO: 4129 - DNA, 201 bp, Homo sapiens; identical to SEQ ID NO: 4071

SEQ ID NO: 4130 - DNA, 201 bp, Homo sapiens; identical to SEQ ID NO: 4072

SEQ ID NO: 4131 - DNA, 201 bp, Homo sapiens; identical to SEQ ID NO: 4073

SEQ ID NO: 4132 - DNA, 201 bp, Homo sapiens; identical to SEQ ID NO: 4074

SEQ ID NO: 4133 - DNA, 201 bp, Homo sapiens; identical to SEQ ID NO: 4075

SEQ ID NO: 4134 - DNA, 199 bp, Homo sapiens; identical to SEQ ID NO: 4100

SEQ ID NO: 4135 - DNA, 201 bp, Homo sapiens; identical to SEQ ID NO: 4078

SEQ ID NO: 4136 - DNA, 201 bp, Homo sapiens; identical to SEQ ID NO: 4102

SEQ ID NO: 4137 - DNA, 201 bp, Homo sapiens; identical to SEQ ID NO: 4081

SEQ ID NO: 4138 - DNA, 201 bp, Homo sapiens; identical to SEQ ID NO: 4083

SEQ ID NO: 4139 - DNA, 201 bp, Homo sapiens; identical to SEQ ID NO: 4084

SEQ ID NO: 4140 - DNA, 201 bp, Homo sapiens; identical to SEQ ID NO: 4104

SEQ ID NO: 4141 - DNA, 201 bp, Homo sapiens; identical to SEQ ID NO: 4094

SEQ ID NO: 4142 - DNA, 149 bp, Homo sapiens; identical to SEQ ID NO: 4088

SEQ ID NO: 4143 - DNA, 201 bp, Homo sapiens; identical to SEQ ID NO: 4087

SEQ ID NO: 4144 - DNA, 201 bp, Homo sapiens; identical to SEQ ID NO: 4089

SEQ ID NO: 4145 - DNA, 201 bp, Homo sapiens; identical to SEQ ID NO: 4090

SEQ ID NO: 4146 - DNA, 201 bp, Homo sapiens; identical to SEQ ID NO: 4091

SEQ ID NO: 4147 - DNA, 201 bp, Homo sapiens; identical to SEQ ID NO: 4092

SEQ ID NO: 4148 - DNA, 201 bp, Homo sapiens; identical to SEQ ID NO: 4093

SEQ ID NO: 4149 - DNA, 201 bp, Homo sapiens; identical to SEQ ID NO: 4095

SEQ ID NO: 4150 - DNA, 201 bp, Homo sapiens; identical to SEQ ID NO: 4070

SEQ ID NO: 4151 - DNA, 201 bp, Homo sapiens; identical to SEQ ID NO: 4071

SEQ ID NO: 4152 - DNA, 201 bp, Homo sapiens; identical to SEQ ID NO: 4072

SEQ ID NO: 4153 - DNA, 201 bp, Homo sapiens; identical to SEQ ID NO: 4073

SEQ ID NO: 4154 - DNA, 201 bp, Homo sapiens; identical to SEQ ID NO: 4074

SEQ ID NO: 4155 - DNA, 201 bp, Homo sapiens; identical to SEQ ID NO: 4075

SEQ ID NO: 4156 - DNA, 199 bp, Homo sapiens; identical to SEQ ID NO: 4100

SEQ ID NO: 4157 - DNA, 201 bp, Homo sapiens; identical to SEQ ID NO: 4078

SEQ ID NO: 4158 - DNA, 201 bp, Homo sapiens; identical to SEQ ID NO: 4102

SEQ ID NO: 4159 - DNA, 201 bp, Homo sapiens; identical to SEQ ID NO: 4081

SEQ ID NO: 4160 - DNA, 201 bp, Homo sapiens; identical to SEQ ID NO: 4083

SEQ ID NO: 4161 - DNA, 201 bp, Homo sapiens; identical to SEQ ID NO: 4084

SEQ ID NO: 4162 - DNA, 201 bp, Homo sapiens; identical to SEQ ID NO: 4104

SEQ ID NO: 4163 - DNA, 201 bp, Homo sapiens; identical to SEQ ID NO: 4094

SEQ ID NO: 4164 - DNA, 201 bp, Homo sapiens; identical to SEQ ID NO: 4087

SEQ ID NO: 4165 - DNA, 201 bp, Homo sapiens
tttgtcttgaggagatgtcctggactcacacggaaacttagggctacggaatgaagacgccaaggatggtggtcatggcgccccgaaccctcttcctgctrctctcgggggccctgaccctgaccgagacctgggcgggctcccactccatgaggtatttcagcgccgccgtgtcccggcccggccgcggggagccccgct

SEQ ID NO: 4166 - DNA, 201 bp, Homo sapiens; identical to SEQ ID NO: 4090

SEQ ID NO: 4167 - DNA, 201 bp, Homo sapiens
tatagtaacatagtgtggtactttgtcttgaggagatgtcctggactcacacggaaacttagggctacggaatgaagacgccaaggatggtggtcatggcrccccgaaccctcttcctgctgctctcgggggccctgaccctgaccgagacctgggcgggctcccactccatgaggtatttcagcgccgccgtgtcccggc

SEQ ID NO: 4168 - DNA, 201 bp, Homo sapiens; identical to SEQ ID NO: 4092

SEQ ID NO: 4169 - DNA, 201 bp, Homo sapiens; identical to SEQ ID NO: 4093

SEQ ID NO: 4170 - DNA, 201 bp, Homo sapiens; identical to SEQ ID NO: 4165

SEQ ID NO: 4171 - DNA, 201 bp, Homo sapiens; identical to SEQ ID NO: 4073

SEQ ID NO: 4172 - DNA, 201 bp, Homo sapiens; identical to SEQ ID NO: 4167

SEQ ID NO: 4173 - DNA, 113 bp, Homo sapiens
agtcttccctgcccaccatccccatcatgggtatcgttgctggcctggttgtccttgcagctgtagtcactggagctgcggtcgctgctgtgctgtggagraagaagagctca

SEQ ID NO: 4174 - DNA, 201 bp, Homo sapiens; identical to SEQ ID NO: 4084

SEQ ID NO: 4175 - DNA, 201 bp, Homo sapiens; identical to SEQ ID NO: 4072

SEQ ID NO: 4176 - DNA, 161 bp, Homo sapiens; identical to SEQ ID NO: 4097

SEQ ID NO: 4177 - DNA, 113 bp, Homo sapiens; identical to SEQ ID NO: 4173

SEQ ID NO: 4178 - DNA, 201 bp, Homo sapiens; identical to SEQ ID NO: 4084

SEQ ID NO: 4179 - DNA, 166 bp, Homo sapiens; identical to SEQ ID NO: 4096

SEQ ID NO: 4180 - DNA, 201 bp, Homo sapiens; identical to SEQ ID NO: 4094

SEQ ID NO: 4181 - DNA, 201 bp, Homo sapiens; identical to SEQ ID NO: 4095

SEQ ID NO: 4182 - DNA, 201 bp, Homo sapiens; identical to SEQ ID NO: 4072

SEQ ID NO: 4183 - DNA, 201 bp, Homo sapiens; identical to SEQ ID NO: 4165

SEQ ID NO: 4184 - DNA, 201 bp, Homo sapiens; identical to SEQ ID NO: 4073

SEQ ID NO: 4185 - DNA, 201 bp, Homo sapiens; identical to SEQ ID NO: 4090

SEQ ID NO: 4186 - DNA, 201 bp, Homo sapiens; identical to SEQ ID NO: 4167

SEQ ID NO: 4187 - DNA, 201 bp, Homo sapiens; identical to SEQ ID NO: 4074

SEQ ID NO: 4188 - DNA, 201 bp, Homo sapiens
agacacggaacaccaaggcccacgcacagactgacagaatgaacctgcagaccctgcgcggctactacaaccagagcgaggccaacccccccaagacacaygtgacccaccaccctgtctttgactatgaggccaccctgaggtgctgggccctgggcttctaccctgcggagatcatactgacctggcagcgggatgggg

SEQ ID NO: 4189 - DNA, 199 bp, Homo sapiens; identical to SEQ ID NO: 4100

SEQ ID NO: 4190 - DNA, 201 bp, Homo sapiens; identical to SEQ ID NO: 4078

SEQ ID NO: 4191 - DNA, 201 bp, Homo sapiens; identical to SEQ ID NO: 4102

SEQ ID NO: 4192 - DNA, 201 bp, Homo sapiens; identical to SEQ ID NO: 4083

SEQ ID NO: 4193 - DNA, 201 bp, Homo sapiens; identical to SEQ ID NO: 4084

SEQ ID NO: 4194 - DNA, 201 bp, Homo sapiens; identical to SEQ ID NO: 4104

SEQ ID NO: 4195 - DNA, 201 bp, Homo sapiens; identical to SEQ ID NO: 4094

SEQ ID NO: 4196 - DNA, 201 bp, Homo sapiens; identical to SEQ ID NO: 4095

SEQ ID NO: 4197 - DNA, 166 bp, Homo sapiens; identical to SEQ ID NO: 4096

SEQ ID NO: 4198 - DNA, 161 bp, Homo sapiens; identical to SEQ ID NO: 4097

SEQ ID NO: 4199 - DNA, 201 bp, Homo sapiens; identical to SEQ ID NO: 4090

SEQ ID NO: 4200 - DNA, 201 bp, Homo sapiens; identical to SEQ ID NO: 4074

SEQ ID NO: 4201 - DNA, 201 bp, Homo sapiens; identical to SEQ ID NO: 4188

SEQ ID NO: 4202 - DNA, 201 bp, Homo sapiens; identical to SEQ ID NO: 4078

SEQ ID NO: 4203 - DNA, 199 bp, Homo sapiens; identical to SEQ ID NO: 4100

SEQ ID NO: 4204 - DNA, 201 bp, Homo sapiens; identical to SEQ ID NO: 4102

SEQ ID NO: 4205 - DNA, 201 bp, Homo sapiens; identical to SEQ ID NO: 4083

SEQ ID NO: 4206 - DNA, 201 bp, Homo sapiens; identical to SEQ ID NO: 4084

SEQ ID NO: 4207 - DNA, 201 bp, Homo sapiens; identical to SEQ ID NO: 4104

SEQ ID NO: 4208 - DNA, 201 bp, Homo sapiens
tcaggttcttccccaatccaggtctccggaggctgaagcaggccatagagaagagggatcacatcgtggagatgcagctgaggcagcacaaggagagcctsgtggcaggccagtggagggacatgatggactacatgctccaaggggtggcgcagccgagcatggaagagggctctggacagctcctggaagggcacgtgc

SEQ ID NO: 4209 - DNA, 201 bp, Homo sapiens
cacatcgtggagatgcagctgaggcagcacaaggagagcctcgtggcaggccagtggagggacatgatggactacatgctccaaggggtggcgcagccgascatggaagagggctctggacagctcctggaagggcacgtgcacatggctgcagtggacctcctgatcggtggcactgagaccacagcaaacaccctctcc

SEQ ID NO: 4210 - DNA, 201 bp, Homo sapiens
cctcgtggcaggccagtggagggacatgatggactacatgctccaaggggtggcgcagccgagcatggaagagggctctggacagctcctggaagggcacktgcacatggctgcagtggacctcctgatcggtggcactgagaccacagcaaacaccctctcctgggccgtggtttttttgcttcaccaccctgagattca

SEQ ID NO: 4211 - DNA, 109 bp, Homo sapiens
tgggaaggyacctgagggtggggtcaagggaggccccaaaacagtctacacagcaggagggatggctggggctcttgagctataagtggcacctcagggccctgacggg

SEQ ID NO: 4212 - DNA, 201 bp, Homo sapiens
cggagacaagatcaaggacgacaacttaatgcctgcctattacaaatgtatccaggaggtgttaaaaacctggagccactggtccatccaaattgtggacrtgattccctttctcaggttcttccccaatccaggtctccggaggctgaagcaggccatagagaagagggatcacatcgtggagatgcagctgaggcagca

SEQ ID NO: 4213 - DNA, 201 bp, Homo sapiens
  misc_feature (1)...(201): n = A,T,C or G, or insertion/deletion polymorphism (see Tables 1-2)
ccacgaactgggccctggtgcctccagctcccgggtcccctacaaggaccgtgcacggctgcccttgctcaatgccaccatcgccgaggtgctgcgcctgnggcccgttgtgcccttagccttgccccaccgcaccacacggcccagcagcatctccggctacgacatccctgagggcacagtcatcattccgaacctcca

SEQ ID NO: 4214 - DNA, 201 bp, Homo sapiens
gatcacatcgtggagatgcagctgaggcagcacaaggagagcctcgtggcaggccagtggagggacatgatggactacatgctccaaggggtggcgcagcygagcatggaagagggctctggacagctcctggaagggcacgtgcacatggctgcagtggacctcctgatcggtggcactgagaccacagcaaacaccctc

SEQ ID NO: 4215 - DNA, 201 bp, Homo sapiens
cgtcttgccatgctgctcctgggcctgctgctgctgctgcccctgctggctggcgcccgcctgctgtggaactggtggaagctccggagcctccacctccygcctcttgccccgggcttcttgcacctgctgcagcccgacctccccatctatctgcttggcctgactcagaaattcgggcccatctacaggctccacctt

SEQ ID NO: 4216 - DNA, 201 bp, Homo sapiens
ctgctgcagcccgacctccccatctatctgcttggcctgactcagaaattcgggcccatctacaggctccaccttgggctgcaagacaagctggtgtctargaactacccggacctgtccttgggagactactccctgctctggaaagcccacaagaagctcacccgctcagccctgctgctgggcatccgtgactccatg

SEQ ID NO: 4217 - DNA, 201 bp, Homo sapiens
gctgcagccccgggggatgggggcccacagcccgggccagagccagtgatggggcaggaccgatgccagccgggtacctcagtttctcctttattgctccygtacgaacccctcccctcccccctgtaaacacagtgctgcgagatcgctggcagagaaggcttcctccagcggctgggtggtgaaggaccctggctcttc

SEQ ID NO: 4218 - DNA, 201 bp, Homo sapiens
ggcaccgagaactcgaagcccttccagtggtaccagctcactccctgggaaaggggttgtcaagagagagtcaaagccggatgtcccatctgctcttcccyttccccttaaggaggtagctcccagcactcaaccaacctccccgcagagctcccttcctgaccctccgctgcagaggattgaggcttaattctgagctgg

SEQ ID NO: 4219 - DNA, 201 bp, Homo sapiens
agggtggggtcaagggaggccccaaaacagtctacacagcaggagggatggctggggctcttgagctataagtggcacctcagggccctgacgggcgtctygccatgctgctcctgggcctgctgctgctgctgcccctgctggctggcgcccgcctgctgtggaactggtggaagctccggagcctccacctcccgcctc

SEQ ID NO: 4220 - DNA, 201 bp, Homo sapiens
ccgacctccccatctatctgcttggcctgactcagaaattcgggcccatctacaggctccaccttgggctgcaagacaagctggtgtctaggaactacccsgacctgtccttgggagactactccctgctctggaaagcccacaagaagctcacccgctcagccctgctgctgggcatccgtgactccatggagccagtgg

SEQ ID NO: 4221 - DNA, 201 bp, Homo sapiens
ctgctcctgggcctgctgctgctgctgcccctgctggctggcgcccgcctgctgtggaactggtggaagctccggagcctccacctcccgcctcttgcccygggcttcttgcacctgctgcagcccgacctccccatctatctgcttggcctgactcagaaattcgggcccatctacaggctccaccttgggctgcaagac

SEQ ID NO: 4222 - DNA, 201 bp, Homo sapiens
tccccatctatctgcttggcctgactcagaaattcgggcccatctacaggctccaccttgggctgcaagacaagctggtgtctaggaactacccggacctktccttgggagactactccctgctctggaaagcccacaagaagctcacccgctcagccctgctgctgggcatccgtgactccatggagccagtggtggagc

SEQ ID NO: 4223 - DNA, 201 bp, Homo sapiens
ctcccgcctcttgccccgggcttcttgcacctgctgcagcccgacctccccatctatctgcttggcctgactcagaaattcgggcccatctacaggctccwccttgggctgcaagacaagctggtgtctaggaactacccggacctgtccttgggagactactccctgctctggaaagcccacaagaagctcacccgctca

SEQ ID NO: 4224 - DNA, 201 bp, Homo sapiens
atgtatccaggaggtgttaaaaacctggagccactggtccatccaaattgtggacgtgattccctttctcaggttcttccccaatccaggtctccggaggytgaagcaggccatagagaagagggatcacatcgtggagatgcagctgaggcagcacaaggagagcctcgtggcaggccagtggagggacatgatggacta

SEQ ID NO: 4225 - DNA, 201 bp, Homo sapiens
ggctggggctcttgagctataagtggcacctcagggccctgacgggcgtcttgccatgctgctcctgggcctgctgctgctgctgcccctgctggctggcrcccgcctgctgtggaactggtggaagctccggagcctccacctcccgcctcttgccccgggcttcttgcacctgctgcagcccgacctccccatctatct

SEQ ID NO: 4226 - DNA, 201 bp, Homo sapiens
ccctgccctccctgcagcccctgccccactgcagtgtcatcctcaagatgcagcctttccaagtgcggctgcagccccgggggatgggggcccacagcccrggccagagccagtgatggggcaggaccgatgccagccgggtacctcagtttctcctttattgctcccgtacgaacccctcccctcccccctgtaaacaca

SEQ ID NO: 4227 - DNA, 201 bp, Homo sapiens
gtggagcagctgacccaggagttctgtgagcgcatgagagcccagcccggcacccctgtggccattgaggaggaattctctctcctcacctgcagcatcawctgttacctcaccttcggagacaagatcaaggacgacaacttaatgcctgcctattacaaatgtatccaggaggtgttaaaaacctggagccactggtcc

SEQ ID NO: 4228 - DNA, 201 bp, Homo sapiens
tccctgcagcccctgccccactgcagtgtcatcctcaagatgcagcctttccaagtgcggctgcagccccgggggatgggggcccacagcccgggccagarccagtgatggggcaggaccgatgccagccgggtacctcagtttctcctttattgctcccgtacgaacccctcccctcccccctgtaaacacagtgctgcg

SEQ ID NO: 4229 - DNA, 201 bp, Homo sapiens
ggagccactggtccatccaaattgtggacgtgattccctttctcaggttcttccccaatccaggtctccggaggctgaagcaggccatagagaagagggaycacatcgtggagatgcagctgaggcagcacaaggagagcctcgtggcaggccagtggagggacatgatggactacatgctccaaggggtggcgcagccga

SEQ ID NO: 4230 - DNA, 201 bp, Homo sapiens
agctgaggcagcacaaggagagcctcgtggcaggccagtggagggacatgatggactacatgctccaaggggtggcgcagccgagcatggaagagggctcyggacagctcctggaagggcacgtgcacatggctgcagtggacctcctgatcggtggcactgagaccacagcaaacaccctctcctgggccgtggtttttt

SEQ ID NO: 4231 - DNA, 201 bp, Homo sapiens
tgcagtggacctcctgatcggtggcactgagaccacagcaaacaccctctcctgggccgtggtttttttgcttcaccaccctgagattcagcagcgactgraggaggagctagaccacgaactgggccctggtgcctccagctcccgggtcccctacaaggaccgtgcacggctgcccttgctcaatgccaccatcgccga

SEQ ID NO: 4232 - DNA, 201 bp, Homo sapiens
ggccttcggctgcggtgcccgcgtgtgcctgggcgagccgctggcgcgcctggagctcttcgtggtgctgacccgactgctgcaggccttcacgctgctgycctccggggacgccctgccctccctgcagcccctgccccactgcagtgtcatcctcaagatgcagcctttccaagtgcggctgcagccccgggggatggg

SEQ ID NO: 4233 - DNA, 201 bp, Homo sapiens
atccaaattgtggacgtgattccctttctcaggttcttccccaatccaggtctccggaggctgaagcaggccatagagaagagggatcacatcgtggagawgcagctgaggcagcacaaggagagcctcgtggcaggccagtggagggacatgatggactacatgctccaaggggtggcgcagccgagcatggaagagggc

SEQ ID NO: 4234 - DNA, 201 bp, Homo sapiens
tggtccatccaaattgtggacgtgattccctttctcaggttcttccccaatccaggtctccggaggctgaagcaggccatagagaagagggatcacatcgwggagatgcagctgaggcagcacaaggagagcctcgtggcaggccagtggagggacatgatggactacatgctccaaggggtggcgcagccgagcatggaa

SEQ ID NO: 4235 - DNA, 135 bp, Homo sapiens
  misc_feature (1)...(135): n = A,T,C or G, or insertion/deletion polymorphism (see Tables 1-2)
ttccccttaaggaggtagctcccagcactcaaccaacctccccgcagagctcccttcctgaccctccgctgcagaggattgaggcttaattctgagctggncctttccagccaataaatcaactccagctccctc

SEQ ID NO: 4236 - DNA, 201 bp, Homo sapiens
tgagagcccagcccggcacccctgtggccattgaggaggaattctctctcctcacctgcagcatcatctgttacctcaccttcggagacaagatcaaggasgacaacttaatgcctgcctattacaaatgtatccaggaggtgttaaaaacctggagccactggtccatccaaattgtggacgtgattccctttctcaggt

SEQ ID NO: 4237 - DNA, 201 bp, Homo sapiens
gctgctgctgctgcccctgctggctggcgcccgcctgctgtggaactggtggaagctccggagcctccacctcccgcctcttgccccgggcttcttgcacytgctgcagcccgacctccccatctatctgcttggcctgactcagaaattcgggcccatctacaggctccaccttgggctgcaagacaagctggtgtctag

SEQ ID NO: 4238 - DNA, 201 bp, Homo sapiens
tggctggcgcccgcctgctgtggaactggtggaagctccggagcctccacctcccgcctcttgccccgggcttcttgcacctgctgcagcccgacctcccmatctatctgcttggcctgactcagaaattcgggcccatctacaggctccaccttgggctgcaagacaagctggtgtctaggaactacccggacctgtcct

SEQ ID NO: 4239 - DNA, 201 bp, Homo sapiens
ggctgcccttgctcaatgccaccatcgccgaggtgctgcgcctgcggcccgttgtgcccttagccttgccccaccgcaccacacggcccagcagcatctcyggctacgacatccctgagggcacagtcatcattccgaacctccaaggcgcccacctggatgagacggtctgggagaggccacatgagttctggcctgatc

SEQ ID NO: 4240 - DNA, 201 bp, Homo sapiens
actgcagtgtcatcctcaagatgcagcctttccaagtgcggctgcagccccgggggatgggggcccacagcccgggccagagccagtgatggggcaggacygatgccagccgggtacctcagtttctcctttattgctcccgtacgaacccctcccctcccccctgtaaacacagtgctgcgagatcgctggcagagaagg

SEQ ID NO: 4241 - DNA, 201 bp, Homo sapiens
gacggtctgggagaggccacatgagttctggcctgatcgcttcctggagccaggcaagaactccagagctctggccttcggctgcggtgcccgcgtgtgcytgggcgagccgctggcgcgcctggagctcttcgtggtgctgacccgactgctgcaggccttcacgctgctgccctccggggacgccctgccctccctgca

SEQ ID NO: 4242 - DNA, 201 bp, Homo sapiens; identical to SEQ ID NO: 4208

SEQ ID NO: 4243 - DNA, 201 bp, Homo sapiens; identical to SEQ ID NO: 4209

SEQ ID NO: 4244 - DNA, 201 bp, Homo sapiens; identical to SEQ ID NO: 4210

SEQ ID NO: 4245 - DNA, 109 bp, Homo sapiens; identical to SEQ ID NO: 4211

SEQ ID NO: 4246 - DNA, 201 bp, Homo sapiens; identical to SEQ ID NO: 4212

SEQ ID NO: 4247 - DNA, 201 bp, Homo sapiens; identical to SEQ ID NO: 4213
  misc_feature (1)...(201): n = A,T,C or G, or insertion/deletion polymorphism (see Tables 1-2)

SEQ ID NO: 4248 - DNA, 201 bp, Homo sapiens; identical to SEQ ID NO: 4214

SEQ ID NO: 4249 - DNA, 201 bp, Homo sapiens; identical to SEQ ID NO: 4215

SEQ ID NO: 4250 - DNA, 201 bp, Homo sapiens
gtggtgctgaactccaagaggaccattgaggaagccatggtcaaaaagtgggcagactttgctggcagacctgagccacttacctacaagctggtgtctargaactacccggacctgtccttgggagactactccctgctctggaaagcccacaagaagctcacccgctcagccctgctgctgggcatccgtgactccatg

SEQ ID NO: 4251 - DNA, 201 bp, Homo sapiens; identical to SEQ ID NO: 4217

SEQ ID NO: 4252 - DNA, 201 bp, Homo sapiens; identical to SEQ ID NO: 4218

SEQ ID NO: 4253 - DNA, 201 bp, Homo sapiens; identical to SEQ ID NO: 4219

SEQ ID NO: 4254 - DNA, 201 bp, Homo sapiens
actccaagaggaccattgaggaagccatggtcaaaaagtgggcagactttgctggcagacctgagccacttacctacaagctggtgtctaggaactacccsgacctgtccttgggagactactccctgctctggaaagcccacaagaagctcacccgctcagccctgctgctgggcatccgtgactccatggagccagtgg

SEQ ID NO: 4255 - DNA, 201 bp, Homo sapiens
ctgctcctgggcctgctgctgctgctgcccctgctggctggcgcccgcctgctgtggaactggtggaagctccggagcctccacctcccgcctcttgcccygggcttcttgcacctgctgcagcccgacctccccatctatctgcttggcctgactcagaaattcgggcccatctacaggctccaccttgggctgcaagat

SEQ ID NO: 4256 - DNA, 201 bp, Homo sapiens
agaggaccattgaggaagccatggtcaaaaagtgggcagactttgctggcagacctgagccacttacctacaagctggtgtctaggaactacccggacctktccttgggagactactccctgctctggaaagcccacaagaagctcacccgctcagccctgctgctgggcatccgtgactccatggagccagtggtggagc

SEQ ID NO: 4257 - DNA, 201 bp, Homo sapiens
ctcccgcctcttgccccgggcttcttgcacctgctgcagcccgacctccccatctatctgcttggcctgactcagaaattcgggcccatctacaggctccwccttgggctgcaagatgtggtggtgctgaactccaagaggaccattgaggaagccatggtcaaaaagtgggcagactttgctggcagacctgagccactt

SEQ ID NO: 4258 - DNA, 201 bp, Homo sapiens; identical to SEQ ID NO: 4224

SEQ ID NO: 4259 - DNA, 201 bp, Homo sapiens; identical to SEQ ID NO: 4225

SEQ ID NO: 4260 - DNA, 201 bp, Homo sapiens; identical to SEQ ID NO: 4226

SEQ ID NO: 4261 - DNA, 201 bp, Homo sapiens; identical to SEQ ID NO: 4227

SEQ ID NO: 4262 - DNA, 201 bp, Homo sapiens; identical to SEQ ID NO: 4228

SEQ ID NO: 4263 - DNA, 201 bp, Homo sapiens; identical to SEQ ID NO: 4229

SEQ ID NO: 4264 - DNA, 201 bp, Homo sapiens; identical to SEQ ID NO: 4230

SEQ ID NO: 4265 - DNA, 201 bp, Homo sapiens; identical to SEQ ID NO: 4231

SEQ ID NO: 4266 - DNA, 201 bp, Homo sapiens; identical to SEQ ID NO: 4232

SEQ ID NO: 4267 - DNA, 201 bp, Homo sapiens; identical to SEQ ID NO: 4233

SEQ ID NO: 4268 - DNA, 201 bp, Homo sapiens; identical to SEQ ID NO: 4234

SEQ ID NO: 4269 - DNA, 135 bp, Homo sapiens; identical to SEQ ID NO: 4235
  misc_feature (1)...(135): n = A,T,C or G, or insertion/deletion polymorphism (see Tables 1-2)

SEQ ID NO: 4270 - DNA, 201 bp, Homo sapiens; identical to SEQ ID NO: 4236

SEQ ID NO: 4271 - DNA, 201 bp, Homo sapiens
gctgctgctgctgcccctgctggctggcgcccgcctgctgtggaactggtggaagctccggagcctccacctcccgcctcttgccccgggcttcttgcacytgctgcagcccgacctccccatctatctgcttggcctgactcagaaattcgggcccatctacaggctccaccttgggctgcaagatgtggtggtgctgaa

SEQ ID NO: 4272 - DNA, 201 bp, Homo sapiens
tggctggcgcccgcctgctgtggaactggtggaagctccggagcctccacctcccgcctcttgccccgggcttcttgcacctgctgcagcccgacctcccmatctatctgcttggcctgactcagaaattcgggcccatctacaggctccaccttgggctgcaagatgtggtggtgctgaactccaagaggaccattgagg

SEQ ID NO: 4273 - DNA, 201 bp, Homo sapiens; identical to SEQ ID NO: 4239

SEQ ID NO: 4274 - DNA, 201 bp, Homo sapiens; identical to SEQ ID NO: 4240

SEQ ID NO: 4275 - DNA, 201 bp, Homo sapiens; identical to SEQ ID NO: 4241

SEQ ID NO: 4276 - DNA, 201 bp, Homo sapiens
ttatcccccatttttagtagagacggggttttagtagagacttggcctcccagaacccccttcctctgctcctccatgaatgacaattccaggcctccccsacctcatgtcctctcatttgggggattgctccgtgctgtccctttctctcaaggccgaagttgggaagtgagaaaccatgtttttaacttgtggctgctt

SEQ ID NO: 4277 - DNA, 201 bp, Homo sapiens
atgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgagacacaccccgggactgtg

SEQ ID NO: 4278 - DNA, 201 bp, Homo sapiens
tctcatttgggggattgctccgtgctgtccctttctctcaaggccgaagttgggaagtgagaaaccatgtttttaacttgtggctgcttttgctgctgctrctcctccgtatctggctgtatgggtggagaacccaccccctgcccaccacaggggtctccttccaggccactcaggacatttttagcttctctcctcccc

SEQ ID NO: 4279 - DNA, 201 bp, Homo sapiens
ccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtgga

SEQ ID NO: 4280 - DNA, 201 bp, Homo sapiens
atttttagcttctctcctccccatgttcccttttttctctaaagtcccctgacatcagccctcccaactcctaagagggactacccatgagagtggggttmtgaggctcccctatggggacagttccgttcttgaagtgtcagtgttggggaatatctgtggcctatgaggcccatctcaggtttggggatcccccagtcc

SEQ ID NO: 4281 - DNA, 201 bp, Homo sapiens; identical to SEQ ID NO: 4276

SEQ ID NO: 4282 - DNA, 201 bp, Homo sapiens; identical to SEQ ID NO: 4277

SEQ ID NO: 4283 - DNA, 201 bp, Homo sapiens; identical to SEQ ID NO: 4278

SEQ ID NO: 4284 - DNA, 201 bp, Homo sapiens; identical to SEQ ID NO: 4280

SEQ ID NO: 4285 - DNA, 201 bp, Homo sapiens
ggcaagggcaggcatgagacctctgaattagaagggtccagcccccactgacaggaggctacactgggagggaaggtgaaggtgctgaggaaagctcccakgatgagcctgggagtgcttcaggtatcagcttccagccagagggcgagaagtcctcctcacaaatggatgagtccattgaatccatggactttggagtgg

SEQ ID NO: 4286 - DNA, 201 bp, Homo sapiens
cttgggagcgcgtgggtgggtgaagggagcgaggataggaagtctatggagatttacaccagtttttttttttttttaaacaaaaacacagccagataatyattattcttcccttacgtccccccagcccccacctggggcagtcgctctcccggctgcgtcccttttcgtccatgtcctagcagagactacagagcagta

SEQ ID NO: 4287 - DNA, 201 bp, Homo sapiens
tacagccaaccagtgtacaagccctacctgaccttgtgcgctgggaggcgcatctgcagcacttacaggaccatgtaccgcgttatgtggcgggaggtgargcgggaggttcagcagacccatgcagtgtgctgccagggctggaagaagcggcacccgggggcgctcacctgtgaagccatctgcgccaagccttgcctg

SEQ ID NO: 4288 - DNA, 201 bp, Homo sapiens
atgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgagggggccttgtgtgccggg

SEQ ID NO: 4289 - DNA, 201 bp, Homo sapiens
ccccatgacctagtgctaggcgtggacgggcgcacctgcatggaggggtccccagagcccccaaccagtgccagcatactcagcgtggccgttcgggaggmggaaaaagatgagcgcgctctgaagcaggagattcacgagctgcgagggcgcctggagcggctggagcagtgggccggtcaggctggggcctgggtcaga

SEQ ID NO: 4290 - DNA, 201 bp, Homo sapiens
cccatgacctagtgctaggcgtggacgggcgcacctgcatggaggggtccccagagcccccaaccagtgccagcatactcagcgtggccgttcgggaggcrgaaaaagatgagcgcgctctgaagcaggagattcacgagctgcgagggcgcctggagcggctggagcagtgggccggtcaggctggggcctgggtcagag

SEQ ID NO: 4291 - DNA, 201 bp, Homo sapiens
gttgcctgggcaagaactgcttcttcaattccttaacaaatgcaaccaccaacacccagatctctctctctctttattttcagtttttttgctgttatccrgataattaataaaaaccaaccacgcaaaactgggtcccaccctctccttttgctcccagcctacctccccagttgtgggaacaggtctggagtgagaggc

SEQ ID NO: 4292 - DNA, 201 bp, Homo sapiens
agagtggagactgcaccgaggcaagagtccatggatggggccaagagggggcaggagtggcgctgtatccacattcacttcagaagttgaagattccaaakaggagaataagtggggagaggggagacaaggaagagggtttggccctgcttcagggcccactgggtgggtaggtgtggggaggaagatggggacagatgg

SEQ ID NO: 4293 - DNA, 200 bp, Homo sapiens
gtacagcgttattagtctttttatttgcttattgcatcttgggagcgcgtgggtgggtgaagggagcgaggataggaagtctatggagatttacaccagtttttttttttttttaaacaaaaacacagccagataatcattattcttcccttacgtccccccagcccccacctggggcagtcgctctcccggctgcgtcc

SEQ ID NO: 4294 - DNA, 201 bp, Homo sapiens
gcctgaagagctgcagccagaacaggtggctgagctgtggggccggggtgaccggatcgaatctctcagcgaccaggtgctgctgctggaggagaggctakgtgcctgctcctgtgaggacaacagcctgggcctcggcgtcaatcatcgataagaagcctctacagcacccctgccccctaatttatacagaaaccggac

SEQ ID NO: 4295 - DNA, 201 bp, Homo sapiens; identical to SEQ ID NO: 4285

SEQ ID NO: 4296 - DNA, 201 bp, Homo sapiens; identical to SEQ ID NO: 4287

SEQ ID NO: 4297 - DNA, 201 bp, Homo sapiens; identical to SEQ ID NO: 4286

SEQ ID NO: 4298 - DNA, 201 bp, Homo sapiens; identical to SEQ ID NO: 4277

SEQ ID NO: 4299 - DNA, 201 bp, Homo sapiens; identical to SEQ ID NO: 4289

SEQ ID NO: 4300 - DNA, 201 bp, Homo sapiens; identical to SEQ ID NO: 4290

SEQ ID NO: 4301 - DNA, 201 bp, Homo sapiens; identical to SEQ ID NO: 4291

SEQ ID NO: 4302 - DNA, 201 bp, Homo sapiens; identical to SEQ ID NO: 4292

SEQ ID NO: 4303 - DNA, 200 bp, Homo sapiens; identical to SEQ ID NO: 4293

SEQ ID NO: 4304 - DNA, 201 bp, Homo sapiens; identical to SEQ ID NO: 4294

SEQ ID NO: 4305 - DNA, 201 bp, Homo sapiens; identical to SEQ ID NO: 4276

SEQ ID NO: 4306 - DNA, 201 bp, Homo sapiens; identical to SEQ ID NO: 4286

SEQ ID NO: 4307 - DNA, 201 bp, Homo sapiens; identical to SEQ ID NO: 4278

SEQ ID NO: 4308 - DNA, 201 bp, Homo sapiens; identical to SEQ ID NO: 4277

SEQ ID NO: 4309 - DNA, 201 bp, Homo sapiens; identical to SEQ ID NO: 4279

SEQ ID NO: 4310 - DNA, 201 bp, Homo sapiens; identical to SEQ ID NO: 4280

SEQ ID NO: 4311 - DNA, 200 bp, Homo sapiens; identical to SEQ ID NO: 4293

SEQ ID NO: 4312 - DNA, 201 bp, Homo sapiens; identical to SEQ ID NO: 4276

SEQ ID NO: 4313 - DNA, 201 bp, Homo sapiens; identical to SEQ ID NO: 4286

SEQ ID NO: 4314 - DNA, 201 bp, Homo sapiens; identical to SEQ ID NO: 4277

SEQ ID NO: 4315 - DNA, 201 bp, Homo sapiens; identical to SEQ ID NO: 4278

SEQ ID NO: 4316 - DNA, 201 bp, Homo sapiens; identical to SEQ ID NO: 4280

SEQ ID NO: 4317 - DNA, 200 bp, Homo sapiens; identical to SEQ ID NO: 4293

SEQ ID NO: 4318 - DNA, 201 bp, Homo sapiens; identical to SEQ ID NO: 4286

SEQ ID NO: 4319 - DNA, 201 bp, Homo sapiens; identical to SEQ ID NO: 4287

SEQ ID NO: 4320 - DNA, 201 bp, Homo sapiens; identical to SEQ ID NO: 4277

SEQ ID NO: 4321 - DNA, 201 bp, Homo sapiens; identical to SEQ ID NO: 4289

SEQ ID NO: 4322 - DNA, 201 bp, Homo sapiens; identical to SEQ ID NO: 4290

SEQ ID NO: 4323 - DNA, 201 bp, Homo sapiens; identical to SEQ ID NO: 4291

SEQ ID NO: 4324 - DNA, 200 bp, Homo sapiens; identical to SEQ ID NO: 4293

SEQ ID NO: 4325 - DNA, 201 bp, Homo sapiens; identical to SEQ ID NO: 4294

SEQ ID NO: 4326 - DNA, 201 bp, Homo sapiens; identical to SEQ ID NO: 4291

SEQ ID NO: 4327 - DNA, 201 bp, Homo sapiens; identical to SEQ ID NO: 4285

SEQ ID NO: 4328 - DNA, 201 bp, Homo sapiens; identical to SEQ ID NO: 4292

SEQ ID NO: 4329 - DNA, 201 bp, Homo sapiens; identical to SEQ ID NO: 4287

SEQ ID NO: 4330 - DNA, 201 bp, Homo sapiens; identical to SEQ ID NO: 4289

SEQ ID NO: 4331 - DNA, 201 bp, Homo sapiens; identical to SEQ ID NO: 4290

SEQ ID NO: 4332 - DNA, 201 bp, Homo sapiens; identical to SEQ ID NO: 4294

SEQ ID NO: 4333 - DNA, 201 bp, Homo sapiens; identical to SEQ ID NO: 4285

SEQ ID NO: 4334 - DNA, 201 bp, Homo sapiens; identical to SEQ ID NO: 4286

SEQ ID NO: 4335 - DNA, 201 bp, Homo sapiens; identical to SEQ ID NO: 4287

SEQ ID NO: 4336 - DNA, 201 bp, Homo sapiens; identical to SEQ ID NO: 4288

SEQ ID NO: 4337 - DNA, 201 bp, Homo sapiens; identical to SEQ ID NO: 4289

SEQ ID NO: 4338 - DNA, 201 bp, Homo sapiens; identical to SEQ ID NO: 4290

SEQ ID NO: 4339 - DNA, 201 bp, Homo sapiens; identical to SEQ ID NO: 4291

SEQ ID NO: 4340 - DNA, 201 bp, Homo sapiens; identical to SEQ ID NO: 4292

SEQ ID NO: 4341 - DNA, 200 bp, Homo sapiens; identical to SEQ ID NO: 4293

SEQ ID NO: 4342 - DNA, 201 bp, Homo sapiens; identical to SEQ ID NO: 4294

SEQ ID NO: 4343 - DNA, 201 bp, Homo sapiens; identical to SEQ ID NO: 4291

SEQ ID NO: 4344 - DNA, 201 bp, Homo sapiens; identical to SEQ ID NO: 4285

SEQ ID NO: 4345 - DNA, 201 bp, Homo sapiens; identical to SEQ ID NO: 4292

SEQ ID NO: 4346 - DNA, 201 bp, Homo sapiens; identical to SEQ ID NO: 4287

SEQ ID NO: 4347 - DNA, 201 bp, Homo sapiens; identical to SEQ ID NO: 4289

SEQ ID NO: 4348 - DNA, 201 bp, Homo sapiens; identical to SEQ ID NO: 4290

SEQ ID NO: 4349 - DNA, 201 bp, Homo sapiens; identical to SEQ ID NO: 4294

SEQ ID NO: 4350 - DNA, 201 bp, Homo sapiens; identical to SEQ ID NO: 4276

SEQ ID NO: 4351 - DNA, 201 bp, Homo sapiens; identical to SEQ ID NO: 4286

SEQ ID NO: 4352 - DNA, 201 bp, Homo sapiens; identical to SEQ ID NO: 4277

SEQ ID NO: 4353 - DNA, 201 bp, Homo sapiens; identical to SEQ ID NO: 4278

SEQ ID NO: 4354 - DNA, 201 bp, Homo sapiens
atttttagcttctctcctccccatgttcccttttttctctaaagtcccctgacatcagccctcccaactcctaagagggactacccatgagagtggggttmtgaggctcccctatggggacagttccgttcttgaagtgtcagtgttggggaagcctagtttctttgaggccccaggccctcttttaactacctttgaata

SEQ ID NO: 4355 - DNA, 200 bp, Homo sapiens; identical to SEQ ID NO: 4293

SEQ ID NO: 4356 - DNA, 109 bp, Homo sapiens
attttccgkcaagttttagccaatgagttgatttggagccatacgctccaaagtccaatagcaatccggacattctctaaaagaggaagcgaaggaaagaaaggggctt

SEQ ID NO: 4357 - DNA, 180 bp, Homo sapiens
attttccgtcaagttttagccaatgagttgatttggagccatacgctccaaagtccaatagcaatccggacattctctaraagaggaagcgaaggaaagaaaggggcttatagtgggcgaggtctataggtagtcccgagcaaattgcttatggctttggttatgactgacaactactca

SEQ ID NO: 4358 - DNA, 201 bp, Homo sapiens
gcagagagaaggttgtcccgctttatgggcgagggagccagaagccccaggatcccagattaaaaactccaccccgcccccagggccagagaccagctccrgagagcagagggggattccagccatttggtgataccgggggcttccacttctcatttggtgttggtgcttttccctttggctttttcaccaccgtcttca

SEQ ID NO: 4359 - DNA, 201 bp, Homo sapiens
ctgtggtcagtgtgtgtggccacctgtactgttggccatgtcttcatcagtggctggagacacggccagaacggcaagagtgtccagtatgtaaagctggkatcagcagagagaaggttgtcccgctttatgggcgagggagccagaagccccaggatcccagattaaaaactccaccccgcccccagggccagagaccag

SEQ ID NO: 4360 - DNA, 201 bp, Homo sapiens
ctccagccagagaagaatcagtattgagggggaaggaggatggattgagagaatgtctttctcctctcctaagtctttgctttccctgatttcttgatttsatcttcaaaggtgggcaaagttccctctgactcttcccccactccccatcttactgatttaatttaatttttcactccccagagtctaatatggattctg

SEQ ID NO: 4361 - DNA, 201 bp, Homo sapiens
cagaacggcaagagtgtccagtatgtaaagctgggatcagcagagagaaggttgtcccgctttatgggcgagggagccagaagccccaggatcccagattraaaactccaccccgcccccagggccagagaccagctccggagagcagagggggattccagccatttggtgataccgggggcttccacttctcatttggtg

SEQ ID NO: 4362 - DNA, 201 bp, Homo sapiens
ttggtgttggtgcttttccctttggctttttcaccaccgtcttcaatgcccatgagcctttccgccggggtacaggtgtggatctgggacagggtcacccrgcctccagctggcaggattccctcttcctgtttctcgccatcttcttctttttttggctgctcagtatttgagctatgtctgcttcctgcccacctccag

SEQ ID NO: 4363 - DNA, 201 bp, Homo sapiens
gtgggcgaggtctataggtagtcccgagcaaattgcttatggctttggttatgactgacaactactcagacgaataaagccctccttggccaggcgacagsgtgtagcgagttattaccaatcccttggcattgcacattgacttagaccgtatcagccaatagccattgtgcgaaggcaggactgcactaaccttttccc

SEQ ID NO: 4364 - DNA, 201 bp, Homo sapiens
cttatagtgggcgaggtctataggtagtcccgagcaaattgcttatggctttggttatgactgacaactactcagacgaataaagccctccttggccaggsgacagcgtgtagcgagttattaccaatcccttggcattgcacattgacttagaccgtatcagccaatagccattgtgcgaaggcaggactgcactaacct

SEQ ID NO: 4365 - DNA, 109 bp, Homo sapiens; identical to SEQ ID NO: 4356

SEQ ID NO: 4366 - DNA, 180 bp, Homo sapiens; identical to SEQ ID NO: 4357

SEQ ID NO: 4367 - DNA, 201 bp, Homo sapiens; identical to SEQ ID NO: 4358

SEQ ID NO: 4368 - DNA, 201 bp, Homo sapiens; identical to SEQ ID NO: 4359

SEQ ID NO: 4369 - DNA, 201 bp, Homo sapiens
tcagtaacgttgtttaattctctgccctggggaaggaggatggattgagagaatgtctttctcctctcctaagtctttgctttccctgatttcttgatttsatcttcaaaggtgggcaaagttccctctgactcttcccccactccccatcttactgatttaatttaatttttcactccccagagtctaatatggattctg

SEQ ID NO: 4370 - DNA, 201 bp, Homo sapiens; identical to SEQ ID NO: 4361

SEQ ID NO: 4371 - DNA, 201 bp, Homo sapiens; identical to SEQ ID NO: 4362

SEQ ID NO: 4372 - DNA, 201 bp, Homo sapiens; identical to SEQ ID NO: 4363

SEQ ID NO: 4373 - DNA, 201 bp, Homo sapiens; identical to SEQ ID NO: 4364

SEQ ID NO: 4374 - DNA, 109 bp, Homo sapiens; identical to SEQ ID NO: 4356

SEQ ID NO: 4375 - DNA, 180 bp, Homo sapiens; identical to SEQ ID NO: 4357

SEQ ID NO: 4376 - DNA, 201 bp, Homo sapiens
ggaagctgtggtcagtgtgtgtggccacctgtactggtgagaatccccagtggctggagacacggccagaacggcaagagtgtccagtatgtaaagctggkatcagcagagagaaggttgtcccgctttatgggcgagggagccagaagccccaggatcccagattaaaaactccaccccgcccccagggccagagaccag

SEQ ID NO: 4377 - DNA, 201 bp, Homo sapiens; identical to SEQ ID NO: 4358

SEQ ID NO: 4378 - DNA, 201 bp, Homo sapiens; identical to SEQ ID NO: 4361

SEQ ID NO: 4379 - DNA, 201 bp, Homo sapiens; identical to SEQ ID NO: 4369

SEQ ID NO: 4380 - DNA, 201 bp, Homo sapiens; identical to SEQ ID NO: 4362

SEQ ID NO: 4381 - DNA, 201 bp, Homo sapiens; identical to SEQ ID NO: 4363

SEQ ID NO: 4382 - DNA, 201 bp, Homo sapiens; identical to SEQ ID NO: 4364

SEQ ID NO: 4383 - DNA, 201 bp, Homo sapiens; identical to SEQ ID NO: 3709

SEQ ID NO: 4384 - DNA, 201 bp, Homo sapiens
cacctggctgagcaatgggcactcagtcacagaaggtgtttctgagaccagcttcctctccaagagtgatcattccttcttcaagatcagttacctcaccytcctcccttctgctgatgagatttatgactgcaaggtggagcactggggcctggacgagcctcttctgaaacactgggagcctgagattccagcccctat

SEQ ID NO: 4385 - DNA, 201 bp, Homo sapiens
caatgggcactcagtcacagaaggtgtttctgagaccagcttcctctccaagagtgatcattccttcttcaagatcagttacctcaccttcctcccttctkctgatgagatttatgactgcaaggtggagcactggggcctggacgagcctcttctgaaacactgggagcctgagattccagcccctatgtcagagctcac

SEQ ID NO: 4386 - DNA, 201 bp, Homo sapiens; identical to SEQ ID NO: 3712

SEQ ID NO: 4387 - DNA, 201 bp, Homo sapiens
ctccaagagtgatcattccttcttcaagatcagttacctcaccttcctcccttctgctgatgagatttatgactgcaaggtggagcactggggcctggacsagcctcttctgaaacactgggagcctgagattccagcccctatgtcagagctcacagagactttggtctgcgccctggggttgtctgtgggcctcatggg

SEQ ID NO: 4388 - DNA, 201 bp, Homo sapiens
tgaagacattgtggctgaccatgttgcctcctatggtgtgaacttctaccagtctcacggtccctctggccagtacacccatgaatttgatggagacgagsagttctacgtggacctggagacgaaagagactgtctggcagttgcctatgtttagcaaatttataagttttgacccgcagagtgcactgagaaatatggc

SEQ ID NO: 4389 - DNA, 201 bp, Homo sapiens; identical to SEQ ID NO: 3713

SEQ ID NO: 4390 - DNA, 201 bp, Homo sapiens
gaattcatgatgagacagtccaactctaccgctgccaccaatgaggttcctgaggtcacagtgttttccaagtttcctgtgacgctgggtcagcccaacaycctcatctgtcttgtggacaacatctttcctcctgtggtcaacatcacctggctgagcaatgggcactcagtcacagaaggtgtttctgagaccagcttc

SEQ ID NO: 4391 - DNA, 201 bp, Homo sapiens
tgatgagacagtccaactctaccgctgccaccaatgaggttcctgaggtcacagtgttttccaagtttcctgtgacgctgggtcagcccaacaccctcatytgtcttgtggacaacatctttcctcctgtggtcaacatcacctggctgagcaatgggcactcagtcacagaaggtgtttctgagaccagcttcctctcca

SEQ ID NO: 4392 - DNA, 107 bp, Homo sapiens
tatattccctcagagctcacaaatgcctttcaattctttccctgacctcctttcctgaatttttttattttctcaaatgttacctactaagggatgcctgrgtaagc

SEQ ID NO: 4393 - DNA, 201 bp, Homo sapiens
gaggtgaagacattgtggctgaccatgttgcctcctatggtgtgaacttctaccagtctcacggtccctctggccagtacacccatgaatttgatggagaygaggagttctacgtggacctggagacgaaagagactgtctggcagttgcctatgtttagcaaatttataagttttgacccgcagagtgcactgagaaata

SEQ ID NO: 4394 - DNA, 201 bp, Homo sapiens; identical to SEQ ID NO: 3710

SEQ ID NO: 4395 - DNA, 201 bp, Homo sapiens
ggacgagcctcttctgaaacactgggagcctgagattccagcccctatgtcagagctcacagagactttggtctgcgccctggggttgtctgtgggcctcrtgggcattgtggtgggcactgtcttcatcatccaaggcctgcgttcagttggtgcttccagacaccaagggctcttatgaatctcatcctgaaaggaagg

SEQ ID NO: 4396 - DNA, 201 bp, Homo sapiens
gtgcttccagacaccaagggctcttatgaatctcatcctgaaaggaaggtgcatcaccatctacaggagaagaagaatggacttgctaaatgacctagcaytattctctggcctgatttatcatatcccttttctcctccaaatgtttcttctctcacctcttctctgggacttaaggtgctatattccctcagagctcac

SEQ ID NO: 4397 - DNA, 201 bp, Homo sapiens
gttgtctgtgggcctcatgggcattgtggtgggcactgtcttcatcatccaaggcctgcgttcagttggtgcttccagacaccaagggctcttatgaatcycatcctgaaaggaaggtgcatcaccatctacaggagaagaagaatggacttgctaaatgacctagcactattctctggcctgatttatcatatccctttt

SEQ ID NO: 4398 - DNA, 201 bp, Homo sapiens
caagtttcctgtgacgctgggtcagcccaacaccctcatctgtcttgtggacaacatctttcctcctgtggtcaacatcacctggctgagcaatgggcackcagtcacagaaggtgtttctgagaccagcttcctctccaagagtgatcattccttcttcaagatcagttacctcaccttcctcccttctgctgatgagat

SEQ ID NO: 4399 - DNA, 201 bp, Homo sapiens
tccagacaccaagggctcttatgaatctcatcctgaaaggaaggtgcatcaccatctacaggagaagaagaatggacttgctaaatgacctagcactattytctggcctgatttatcatatcccttttctcctccaaatgtttcttctctcacctcttctctgggacttaaggtgctatattccctcagagctcacaaatg

SEQ ID NO: 4400 - DNA, 201 bp, Homo sapiens
gagctcacagagactttggtctgcgccctggggttgtctgtgggcctcatgggcattgtggtgggcactgtcttcatcatccaaggcctgcgttcagttgrtgcttccagacaccaagggctcttatgaatctcatcctgaaaggaaggtgcatcaccatctacaggagaagaagaatggacttgctaaatgacctagcac

SEQ ID NO: 4401 - DNA, 138 bp, Homo sapiens
cacaattgctctacagctcagagcagcaactgctgagsctgccttgggaagaagatgatcctaaacaaagctctgctgctgggggccctcgccctgactgccgtgatgagcccctgtggaggtgaagacattgtggct

SEQ ID NO: 4402 - DNA, 201 bp, Homo sapiens
tgggcctcatgggcattgtggtgggcactgtcttcatcatccaaggcctgcgttcagttggtgcttccagacaccaagggctcttatgaatctcatcctgaaaggaaggtgcatcaccatctacaggagaagaagaatggacttgctaaatgacctagcactattctctggcctgatttatcatatcccttttctcctcca

SEQ ID NO: 4403 - DNA, 201 bp, Homo sapiens
ttgtggctgaccatgttgcctcctatggtgtgaacttctaccagtctcacggtccctctggccagtacacccatgaatttgatggagacgaggagttctaygtggacctggagacgaaagagactgtctggcagttgcctatgtttagcaaatttataagttttgacccgcagagtgcactgagaaatatggctgtgggaa

SEQ ID NO: 4404 - DNA, 116 bp, Homo sapiens
gttgtctgtgggcctcatgggcattgtggtgggcactgtcttcatcatccaaggcctgcgttcagttggtgcttccagacaccaagggctcttatgaatcycatcctgaaaggaag

SEQ ID NO: 4405 - DNA, 201 bp, Homo sapiens; identical to SEQ ID NO: 4398

SEQ ID NO: 4406 - DNA, 201 bp, Homo sapiens; identical to SEQ ID NO: 3709

SEQ ID NO: 4407 - DNA, 201 bp, Homo sapiens; identical to SEQ ID NO: 4384

SEQ ID NO: 4408 - DNA, 201 bp, Homo sapiens; identical to SEQ ID NO: 4385

SEQ ID NO: 4409 - DNA, 148 bp, Homo sapiens
gagctcacagagactttggtctgcgccctggggttgtctgtgggcctcatgggcattgtggtgggcactgtcttcatcatccaaggcctgcgttcagttgrtgcttccagacaccaagggctcttatgaatctcatcctgaaaggaag

SEQ ID NO: 4410 - DNA, 201 bp, Homo sapiens; identical to SEQ ID NO: 3712

SEQ ID NO: 4411 - DNA, 138 bp, Homo sapiens; identical to SEQ ID NO: 4401

SEQ ID NO: 4412 - DNA, 108 bp, Homo sapiens
tgggcctcatgggcattgtggtgggcactgtcttcatcatccaaggcctgcgttcagttggtgcttccagacaccaagggctcttatgaatctcatcctgaaaggaag

SEQ ID NO: 4413 - DNA, 201 bp, Homo sapiens; identical to SEQ ID NO: 4387

SEQ ID NO: 4414 - DNA, 201 bp, Homo sapiens; identical to SEQ ID NO: 4388

SEQ ID NO: 4415 - DNA, 201 bp, Homo sapiens; identical to SEQ ID NO: 3713

SEQ ID NO: 4416 - DNA, 201 bp, Homo sapiens; identical to SEQ ID NO: 4390

SEQ ID NO: 4417 - DNA, 201 bp, Homo sapiens; identical to SEQ ID NO: 4403

SEQ ID NO: 4418 - DNA, 201 bp, Homo sapiens; identical to SEQ ID NO: 4391

SEQ ID NO: 4419 - DNA, 201 bp, Homo sapiens; identical to SEQ ID NO: 4393

SEQ ID NO: 4420 - DNA, 201 bp, Homo sapiens; identical to SEQ ID NO: 3710

SEQ ID NO: 4421 - DNA, 200 bp, Homo sapiens
ggacgagcctcttctgaaacactgggagcctgagattccagcccctatgtcagagctcacagagactttggtctgcgccctggggttgtctgtgggcctcrtgggcattgtggtgggcactgtcttcatcatccaaggcctgcgttcagttggtgcttccagacaccaagggctcttatgaatctcatcctgaaaggaag

SEQ ID NO: 4422 - DNA, 201 bp, Homo sapiens; identical to SEQ ID NO: 3709

SEQ ID NO: 4423 - DNA, 201 bp, Homo sapiens; identical to SEQ ID NO: 4384

SEQ ID NO: 4424 - DNA, 201 bp, Homo sapiens; identical to SEQ ID NO: 4385

SEQ ID NO: 4425 - DNA, 201 bp, Homo sapiens; identical to SEQ ID NO: 3712

SEQ ID NO: 4426 - DNA, 164 bp, Homo sapiens
acaggagcaaccaagtacagtgtatcctgataatttgttgatttcttaactggtgttaatatttctttcttccttttgttcctacccttggccactgccasccacccctcaattcaggtaccaacgaaccctctgcccttggctcagaatggttatagcagaaa

SEQ ID NO: 4427 - DNA, 201 bp, Homo sapiens; identical to SEQ ID NO: 4387

SEQ ID NO: 4428 - DNA, 201 bp, Homo sapiens; identical to SEQ ID NO: 4388

SEQ ID NO: 4429 - DNA, 201 bp, Homo sapiens; identical to SEQ ID NO: 4390

SEQ ID NO: 4430 - DNA, 201 bp, Homo sapiens; identical to SEQ ID NO: 3713

SEQ ID NO: 4431 - DNA, 201 bp, Homo sapiens
tttcccatctttcatctcagggctgactgagagcataacttagaatgggtgactcttatgttttaggccaatttcatgtcattccccagatcatatttcawgtccagtaacacaggagcaaccaagtacagtgtatcctgataatttgttgatttcttaactggtgttaatatttctttcttccttttgttcctacccttg

SEQ ID NO: 4432 - DNA, 201 bp, Homo sapiens; identical to SEQ ID NO: 4391

SEQ ID NO: 4433 - DNA, 201 bp, Homo sapiens
tatattccctcagagctcacaaatgcctttcaattctttccctgacctcctttcctgaatttttttattttctcaaatgttacctactaagggatgcctgrgtaagccactcagctacctaattcctcaatgacctttatctaaaatctccatggaagcaataaattcccttttgatgcctctattgaatttttcccatct

SEQ ID NO: 4434 - DNA, 201 bp, Homo sapiens
ccttttgatgcctctattgaatttttcccatctttcatctcagggctgactgagagcataacttagaatgggtgactcttatgttttaggccaatttcatrtcattccccagatcatatttcatgtccagtaacacaggagcaaccaagtacagtgtatcctgataatttgttgatttcttaactggtgttaatatttctt

SEQ ID NO: 4435 - DNA, 201 bp, Homo sapiens; identical to SEQ ID NO: 4393

SEQ ID NO: 4436 - DNA, 201 bp, Homo sapiens; identical to SEQ ID NO: 3710

SEQ ID NO: 4437 - DNA, 201 bp, Homo sapiens
ggacgagcctcttctgaaacactgggagcctgagattccagcccctatgtcagagctcacagagactttggtctgcgccctggggttgtctgtgggcctcrtgggcattgtggtgggcactgtcttcatcatccaaggcctgcgttcagttggtgcttccagacaccaagggctcttatgagtgcatcaccatctacagga

SEQ ID NO: 4438 - DNA, 201 bp, Homo sapiens
ctaaaatctccatggaagcaataaattcccttttgatgcctctattgaatttttcccatctttcatctcagggctgactgagagcataacttagaatgggygactcttatgttttaggccaatttcatgtcattccccagatcatatttcatgtccagtaacacaggagcaaccaagtacagtgtatcctgataatttgtt

SEQ ID NO: 4439 - DNA, 201 bp, Homo sapiens
caaggcctgcgttcagttggtgcttccagacaccaagggctcttatgagtgcatcaccatctacaggagaagaagaatggacttgctaaatgacctagcaytattctctggcctgatttatcatatcccttttctcctccaaatgtttcttctctcacctcttctctgggacttaaggtgctatattccctcagagctcac

SEQ ID NO: 4440 - DNA, 201 bp, Homo sapiens; identical to SEQ ID NO: 4398

SEQ ID NO: 4441 - DNA, 201 bp, Homo sapiens
cctgcgttcagttggtgcttccagacaccaagggctcttatgagtgcatcaccatctacaggagaagaagaatggacttgctaaatgacctagcactattytctggcctgatttatcatatcccttttctcctccaaatgtttcttctctcacctcttctctgggacttaaggtgctatattccctcagagctcacaaatg

SEQ ID NO: 4442 - DNA, 201 bp, Homo sapiens
gagctcacagagactttggtctgcgccctggggttgtctgtgggcctcatgggcattgtggtgggcactgtcttcatcatccaaggcctgcgttcagttgrtgcttccagacaccaagggctcttatgagtgcatcaccatctacaggagaagaagaatggacttgctaaatgacctagcactattctctggcctgattta

SEQ ID NO: 4443 - DNA, 138 bp, Homo sapiens; identical to SEQ ID NO: 4401

SEQ ID NO: 4444 - DNA, 201 bp, Homo sapiens; identical to SEQ ID NO: 4403

SEQ ID NO: 4445 - DNA, 201 bp, Homo sapiens
cgctgagggacatctggatggtcagcccttcctgcgctatgacaggcagaaacgcagggcaaagccccagggacagtgggcagaagatgtcctgggagctragacctgggacacagagaccgaggacttgacagagaatgggcaagacctcaggaggaccctgactcatatcaaggaccagaaaggaggcttgcattccct

SEQ ID NO: 4446 - DNA, 201 bp, Homo sapiens
gcagtcagggtttctcgctgagggacatctggatggtcagcccttcctgcgctatgacaggcagaaacgcagggcaaagccccagggacagtgggcagaaratgtcctgggagctgagacctgggacacagagaccgaggacttgacagagaatgggcaagacctcaggaggaccctgactcatatcaaggaccagaaagg

SEQ ID NO: 4447 - DNA, 130 bp, Homo sapiens
gtcggggccatggggctgggcccggtcttyctgcttctggctggcatcttcccttttgcacctccgggagctgctgctgagccccacagtcttcgttacaacctcatggtgctgtcccaggatggatctg

SEQ ID NO: 4448 - DNA, 201 bp, Homo sapiens
tgcctgatgggaatggaacctaccagacctgggtggccaccaggattcgccaaggagaggagcagaggttcacctgctacatggaacacagcgggaatcayggcactcaccctgtgccctctgggaaggcgctggtgcttcagagtcaacggacagactttccatatgtttctgctgctatgccatgttttgttattatta

SEQ ID NO: 4449 - DNA, 201 bp, Homo sapiens
ggatcaacacccagttgggacaggagaccacagggatgcagcacagctgggatttcagcctctgatgtcagctactgggtccactggttccactgagggcrcctagactctacagccaggcggccaggattcaactccctgcctggatctcaccagcactttccctctgtttcctgacctatgaaacagaaaataacatca

SEQ ID NO: 4450 - DNA, 201 bp, Homo sapiens
gcctgatgggaatggaacctaccagacctgggtggccaccaggattcgccaaggagaggagcagaggttcacctgctacatggaacacagcgggaatcacrgcactcaccctgtgccctctgggaaggcgctggtgcttcagagtcaacggacagactttccatatgtttctgctgctatgccatgttttgttattattat

SEQ ID NO: 4451 - DNA, 201 bp, Homo sapiens
acttgacagagaatgggcaagacctcaggaggaccctgactcatatcaaggaccagaaaggaggcttgcattccctccaggagattagggtctgtgagatscatgaagacagcagcaccaggggctcccggcatttctactacaatggggagctcttcctctcccaaaacctggagactcaagaatcgacagtgccccagt

SEQ ID NO: 4452 - DNA, 201 bp, Homo sapiens
tatcaaggaccagaaaggaggcttgcattccctccaggagattagggtctgtgagatccatgaagacagcagcaccaggggctcccggcatttctactacratggggagctcttcctctcccaaaacctggagactcaagaatcgacagtgccccagtcctccagagctcagaccttggctatgaacgtcacaaatttctg

SEQ ID NO: 4453 - DNA, 201 bp, Homo sapiens
tgacctggcgtcaggatggggtatctttgagccacgacacccagcagtggggggatgtcctgcctgatgggaatggaacctaccagacctgggtggccacyaggatttgccgaggagaggagcagaggttcacctgctacatggaacacagcgggaatcacagcactcaccctgtgccctctgggaaagtgctggtgcttc

SEQ ID NO: 4454 - DNA, 201 bp, Homo sapiens
gaatggaacctaccagacctgggtggccaccaggatttgccgaggagaggagcagaggttcacctgctacatggaacacagcgggaatcacagcactcacsctgtgccctctgggaaagtgctggtgcttcagagtcattggcagacattccatgtttctgctgttgctgctggctgctgctatttttgttattattattt

SEQ ID NO: 4455 - DNA, 201 bp, Homo sapiens
acgctatgcatgcagactgcctgcaggaactacggcgatatctagaatccggcgtagtcctgaggagaacagtgccccccatggtgaatgtcacccgcagygaggcctcagagggcaacatcaccgtgacatgcagggcttccagcttctatccccggaatatcatactgacctggcgtcaggatggggtatctttgagcc

SEQ ID NO: 4456 - DNA, 201 bp, Homo sapiens
gctgctgctgagccccacagtcttcgttataacctcacggtgctgtcctgggatggatctgtgcagtcagggtttcttgctgaggtacatctggatggtcwgcccttcctgcgctatgacaggcagaaatgcagggcaaagccccagggacagtgggcagaagatgtcctgggaaataagacatgggacagagagaccagg

SEQ ID NO: 4457 - DNA, 201 bp, Homo sapiens
agaacagtgccccccatggtgaatgtcacccgcagcgaggcctcagagggcaacatcaccgtgacatgcagggcttccagcttctatccccggaatatcayactgacctggcgtcaggatggggtatctttgagccacgacacccagcagtggggggatgtcctgcctgatgggaatggaacctaccagacctgggtggcc

SEQ ID NO: 4458 - DNA, 201 bp, Homo sapiens
gggcccggtcttcctgcttctggctggcatcttcccttttgcacctccgggagctgctgctgagccccacagtcttcgttataacctcacggtgctgtcckgggatggatctgtgcagtcagggtttcttgctgaggtacatctggatggtcagcccttcctgcgctatgacaggcagaaatgcagggcaaagccccaggg

SEQ ID NO: 4459 - DNA, 201 bp, Homo sapiens
gtgctgtcctgggatggatctgtgcagtcagggtttcttgctgaggtacatctggatggtcagcccttcctgcgctatgacaggcagaaatgcagggcaargccccagggacagtgggcagaagatgtcctgggaaataagacatgggacagagagaccagggacttgacagggaacggaaaggacctcaggatgaccctg

SEQ ID NO: 4460 - DNA, 201 bp, Homo sapiens
catgaacgtcaggaatttcttgaaggaagatgccatgaagaccaagacacactatcacgctatgcatgcagactgcctgcaggaactacggcgatatctaraatccggcgtagtcctgaggagaacagtgccccccatggtgaatgtcacccgcagcgaggcctcagagggcaacatcaccgtgacatgcagggcttccag

SEQ ID NO: 4461 - DNA, 201 bp, Homo sapiens
gccctctgggaaagtgctggtgcttcagagtcattggcagacattccatgtttctgctgttgctgctggctgctgctatttttgttattattattttctaygtccgttgttgtaagaagaaaacatcagctgcagagggtccagagctcgtgagcctgcaggtcctggatcaacacccagttgggacgagtgaccacaggg

SEQ ID NO: 4462 - DNA, 201 bp, Homo sapiens
gtgccccccatggtgaatgtcacccgcagcgaggcctcagagggcaacatcaccgtgacatgcagggcttccagcttctatccccggaatatcatactgasctggcgtcaggatggggtatctttgagccacgacacccagcagtggggggatgtcctgcctgatgggaatggaacctaccagacctgggtggccaccagg

SEQ ID NO: 4463 - DNA, 201 bp, Homo sapiens
ggatcaacacccagttgggacgagtgaccacagggatgccacacagctcggatttcagcctctgatgtcagctcttgggtccactggctccactgagggcrcctagactctacagccaggcggctggaattgaattccctgcctggatctcacaagcactttccctcttggtgcctcagtttcctgacctatgaaacagag

SEQ ID NO: 4464 - DNA, 201 bp, Homo sapiens
ttccctccaggagattagggtctgtgagatccatgaagacaacagcaccaggagctcccagcatttctactacgatggggagctcttcctctcccaaaacstggagactgaggaatggacagtgccccagtcctccagagctcagaccttggccatgaacgtcaggaatttcttgaaggaagatgccatgaagaccaagac

SEQ ID NO: 4465 - DNA, 201 bp, Homo sapiens
tgcaggaactacggcgatatctagaatccggcgtagtcctgaggagaacagtgccccccatggtgaatgtcacccgcagcgaggcctcagagggcaacatyaccgtgacatgcagggcttccagcttctatccccggaatatcatactgacctggcgtcaggatggggtatctttgagccacgacacccagcagtgggggg

SEQ ID NO: 4466 - DNA, 201 bp, Homo sapiens
ggagattagggtctgtgagatccatgaagacaacagcaccaggagctcccagcatttctactacgatggggagctcttcctctcccaaaacctggagactraggaatggacagtgccccagtcctccagagctcagaccttggccatgaacgtcaggaatttcttgaaggaagatgccatgaagaccaagacacactatca

SEQ ID NO: 4467 - DNA, 201 bp, Homo sapiens
caaggaccagaaagaaggcttgcattccctccaggagattagggtctgtgagatccatgaagacaacagcaccaggagctcccagcatttctactacgatrgggagctcttcctctcccaaaacctggagactgaggaatggacagtgccccagtcctccagagctcagaccttggccatgaacgtcaggaatttcttgaa

SEQ ID NO: 4468 - DNA, 201 bp, Homo sapiens
agtcctgaggagaacagtgccccccatggtgaatgtcacccgcagcgaggcctcagagggcaacatcaccgtgacatgcagggcttccagcttctatcccyggaatatcatactgacctggcgtcaggatggggtatctttgagccacgacacccagcagtggggggatgtcctgcctgatgggaatggaacctaccagac

SEQ ID NO: 4469 - DNA, 201 bp, Homo sapiens
ctggatggtcagcccttcctgcgctatgacaggcagaaatgcagggcaaagccccagggacagtgggcagaagatgtcctgggaaataagacatgggacasagagaccagggacttgacagggaacggaaaggacctcaggatgaccctggctcatatcaaggaccagaaagaaggcttgcattccctccaggagattagg

SEQ ID NO: 4470 - DNA, 201 bp, Homo sapiens
tgtcacccgcagcgaggcctcagagggcaacatcaccgtgacatgcagggcttccagcttctatccccggaatatcatactgacctggcgtcaggatgggstatctttgagccacgacacccagcagtggggggatgtcctgcctgatgggaatggaacctaccagacctgggtggccaccaggatttgccgaggagagga

SEQ ID NO: 4471 - DNA, 201 bp, Homo sapiens
cctctcccaaaacctggagactgaggaatggacagtgccccagtcctccagagctcagaccttggccatgaacgtcaggaatttcttgaaggaagatgccrtgaagaccaagacacactatcacgctatgcatgcagactgcctgcaggaactacggcgatatctagaatccggcgtagtcctgaggagaacagtgccccc

SEQ ID NO: 4472 - DNA, 201 bp, Homo sapiens
tagaatccggcgtagtcctgaggagaacagtgccccccatggtgaatgtcacccgcagcgaggcctcagagggcaacatcaccgtgacatgcagggcttcyagcttctatccccggaatatcatactgacctggcgtcaggatggggtatctttgagccacgacacccagcagtggggggatgtcctgcctgatgggaatg

SEQ ID NO: 4473 - DNA, 201 bp, Homo sapiens
atatcaaggaccagaaagaaggcttgcattccctccaggagattagggtctgtgagatccatgaagacaacagcaccaggagctcccagcatttctactaygatggggagctcttcctctcccaaaacctggagactgaggaatggacagtgccccagtcctccagagctcagaccttggccatgaacgtcaggaatttct

SEQ ID NO: 4474 - DNA, 201 bp, Homo sapiens
caggatggggtatctttgagccacgacacccagcagtggggggatgtcctgcctgatgggaatggaacctaccagacctgggtggccaccaggatttgccraggagaggagcagaggttcacctgctacatggaacacagcgggaatcacagcactcaccctgtgccctctgggaaagtgctggtgcttcagagtcattgg

SEQ ID NO: 4475 - DNA, 201 bp, Homo sapiens
agaatccggcgtagtcctgaggagaacagtgccccccatggtgaatgtcacccgcagcgaggcctcagagggcaacatcaccgtgacatgcagggcttccrgcttctatccccggaatatcatactgacctggcgtcaggatggggtatctttgagccacgacacccagcagtggggggatgtcctgcctgatgggaatgg

SEQ ID NO: 4476 - DNA, 201 bp, Homo sapiens
ctggctccactgagggcacctagactctacagccaggcggctggaattgaattccctgcctggatctcacaagcactttccctcttggtgcctcagtttcmtgacctatgaaacagagaaaataaaagcacttatttattgttgttggaggctgcaaaatgttagtagatatgaggcatttgcagctgtgccatattaatt

SEQ ID NO: 4477 - DNA, 201 bp, Homo sapiens
tctgggaaagtgctggtgcttcagagtcattggcagacattccatgtttctgctgttgctgctggctgctgctatttttgttattattattttctatgtcygttgttgtaagaagaaaacatcagctgcagagggtccagagctcgtgagcctgcaggtcctggatcaacacccagttgggacgagtgaccacagggatgc

SEQ ID NO: 4478 - DNA, 201 bp, Homo sapiens
cgggccaggtgactaagtttccgcggcgccttctccccggccactgcttgagccgctgagagggtggcgacgtcggggccatggggctgggcccggtcttyctgcttctggctggcatcttcccttttgcacctccgggagctgctgctgagccccacagtcttcgttataacctcacggtgctgtcctgggatggatctg

SEQ ID NO: 4479 - DNA, 201 bp, Homo sapiens
gtggccccgccctctccgctcgtgattggccctaagttccgggccccagtttcattggatgagcggtcgggggaccgggccaggtgactaagtttccgcgrcgccttctccccggccactgcttgagccgctgagagggtggcgacgtcggggccatggggctgggcccggtcttcctgcttctggctggcatcttccctt

SEQ ID NO: 4480 - DNA, 201 bp, Homo sapiens
gaccttggccatgaacgtcaggaatttcttgaaggaagatgccatgaagaccaagacacactatcacgctatgcatgcagactgcctgcaggaactacggygatatctagaatccggcgtagtcctgaggagaacagtgccccccatggtgaatgtcacccgcagcgaggcctcagagggcaacatcaccgtgacatgcag

SEQ ID NO: 4481 - DNA, 201 bp, Homo sapiens
tcttcccttttgcacctccgggagctgctgctgagccccacagtcttcgttataacctcacggtgctgtcctgggatggatctgtgcagtcagggtttctygctgaggtacatctggatggtcagcccttcctgcgctatgacaggcagaaatgcagggcaaagccccagggacagtgggcagaagatgtcctgggaaata

SEQ ID NO: 4482 - DNA, 201 bp, Homo sapiens
ctgtgagatccatgaagacaacagcaccaggagctcccagcatttctactacgatggggagctcttcctctcccaaaacctggagactgaggaatggacartgccccagtcctccagagctcagaccttggccatgaacgtcaggaatttcttgaaggaagatgccatgaagaccaagacacactatcacgctatgcatgc

SEQ ID NO: 4483 - DNA, 201 bp, Homo sapiens
cgtcaggaatttcttgaaggaagatgccatgaagaccaagacacactatcacgctatgcatgcagactgcctgcaggaactacggcgatatctagaatccrgcgtagtcctgaggagaacagtgccccccatggtgaatgtcacccgcagcgaggcctcagagggcaacatcaccgtgacatgcagggcttccagcttcta

SEQ ID NO: 4484 - DNA, 201 bp, Homo sapiens
cttcccttttgcacctccgggagctgctgctgagccccacagtcttcgttataacctcacggtgctgtcctgggatggatctgtgcagtcagggtttcttrctgaggtacatctggatggtcagcccttcctgcgctatgacaggcagaaatgcagggcaaagccccagggacagtgggcagaagatgtcctgggaaataa

SEQ ID NO: 4485 - DNA, 201 bp, Homo sapiens
gaagatgccatgaagaccaagacacactatcacgctatgcatgcagactgcctgcaggaactacggcgatatctagaatccggcgtagtcctgaggagaasagtgccccccatggtgaatgtcacccgcagcgaggcctcagagggcaacatcaccgtgacatgcagggcttccagcttctatccccggaatatcatactg

SEQ ID NO: 4486 - DNA, 201 bp, Homo sapiens
cacagtcttcgttataacctcacggtgctgtcctgggatggatctgtgcagtcagggtttcttgctgaggtacatctggatggtcagcccttcctgcgctrtgacaggcagaaatgcagggcaaagccccagggacagtgggcagaagatgtcctgggaaataagacatgggacagagagaccagggacttgacagggaac

SEQ ID NO: 4487 - DNA, 201 bp, Homo sapiens
ggcgacgtcggggccatggggctgggcccggtcttcctgcttctggctggcatcttcccttttgcacctccgggagctgctgctgagccccacagtcttcsttataacctcacggtgctgtcctgggatggatctgtgcagtcagggtttcttgctgaggtacatctggatggtcagcccttcctgcgctatgacaggcag

SEQ ID NO: 4488 - DNA, 201 bp, Homo sapiens; identical to SEQ ID NO: 4445

SEQ ID NO: 4489 - DNA, 201 bp, Homo sapiens; identical to SEQ ID NO: 4446

SEQ ID NO: 4490 - DNA, 201 bp, Homo sapiens; identical to SEQ ID NO: 4448

SEQ ID NO: 4491 - DNA, 201 bp, Homo sapiens; identical to SEQ ID NO: 4449

SEQ ID NO: 4492 - DNA, 201 bp, Homo sapiens; identical to SEQ ID NO: 4450

SEQ ID NO: 4493 - DNA, 201 bp, Homo sapiens; identical to SEQ ID NO: 4452

SEQ ID NO: 4494 - DNA, 201 bp, Homo sapiens; identical to SEQ ID NO: 4451

SEQ ID NO: 4495 - DNA, 201 bp, Homo sapiens; identical to SEQ ID NO: 4453

SEQ ID NO: 4496 - DNA, 201 bp, Homo sapiens; identical to SEQ ID NO: 4454

SEQ ID NO: 4497 - DNA, 201 bp, Homo sapiens; identical to SEQ ID NO: 4455

SEQ ID NO: 4498 - DNA, 201 bp, Homo sapiens; identical to SEQ ID NO: 4456

SEQ ID NO: 4499 - DNA, 201 bp, Homo sapiens; identical to SEQ ID NO: 4457

SEQ ID NO: 4500 - DNA, 201 bp, Homo sapiens; identical to SEQ ID NO: 4458

SEQ ID NO: 4501 - DNA, 201 bp, Homo sapiens; identical to SEQ ID NO: 4459

SEQ ID NO: 4502 - DNA, 201 bp, Homo sapiens; identical to SEQ ID NO: 4460

SEQ ID NO: 4503 - DNA, 201 bp, Homo sapiens; identical to SEQ ID NO: 4461

SEQ ID NO: 4504 - DNA, 201 bp, Homo sapiens; identical to SEQ ID NO: 4462

SEQ ID NO: 4505 - DNA, 201 bp, Homo sapiens; identical to SEQ ID NO: 4463

SEQ ID NO: 4506 - DNA, 201 bp, Homo sapiens; identical to SEQ ID NO: 4464

SEQ ID NO: 4507 - DNA, 201 bp, Homo sapiens; identical to SEQ ID NO: 4465

SEQ ID NO: 4508 - DNA, 201 bp, Homo sapiens; identical to SEQ ID NO: 4466

SEQ ID NO: 4509 - DNA, 201 bp, Homo sapiens; identical to SEQ ID NO: 4467

SEQ ID NO: 4510 - DNA, 201 bp, Homo sapiens; identical to SEQ ID NO: 4468

SEQ ID NO: 4511 - DNA, 201 bp, Homo sapiens; identical to SEQ ID NO: 4469

SEQ ID NO: 4512 - DNA, 201 bp, Homo sapiens; identical to SEQ ID NO: 4470

SEQ ID NO: 4513 - DNA, 201 bp, Homo sapiens; identical to SEQ ID NO: 4471

SEQ ID NO: 4514 - DNA, 201 bp, Homo sapiens; identical to SEQ ID NO: 4472

SEQ ID NO: 4515 - DNA, 201 bp, Homo sapiens; identical to SEQ ID NO: 4473

SEQ ID NO: 4516 - DNA, 201 bp, Homo sapiens; identical to SEQ ID NO: 4474

SEQ ID NO: 4517 - DNA, 201 bp, Homo sapiens; identical to SEQ ID NO: 4475

SEQ ID NO: 4518 - DNA, 201 bp, Homo sapiens; identical to SEQ ID NO: 4476

SEQ ID NO: 4519 - DNA, 201 bp, Homo sapiens; identical to SEQ ID NO: 4477

SEQ ID NO: 4520 - DNA, 201 bp, Homo sapiens; identical to SEQ ID NO: 4478

SEQ ID NO: 4521 - DNA, 201 bp, Homo sapiens; identical to SEQ ID NO: 4479

SEQ ID NO: 4522 - DNA, 201 bp, Homo sapiens; identical to SEQ ID NO: 4480

SEQ ID NO: 4523 - DNA, 201 bp, Homo sapiens; identical to SEQ ID NO: 4481

SEQ ID NO: 4524 - DNA, 201 bp, Homo sapiens; identical to SEQ ID NO: 4482

SEQ ID NO: 4525 - DNA, 201 bp, Homo sapiens; identical to SEQ ID NO: 4483

SEQ ID NO: 4526 - DNA, 201 bp, Homo sapiens; identical to SEQ ID NO: 4484

SEQ ID NO: 4527 - DNA, 201 bp, Homo sapiens; identical to SEQ ID NO: 4485

SEQ ID NO: 4528 - DNA, 201 bp, Homo sapiens; identical to SEQ ID NO: 4486

SEQ ID NO: 4529 - DNA, 175 bp, Homo sapiens
ggctagtcaagtgaaacagtgggagtgaagaagaaacaaagacatctataactggttgtgatcaattagttgtamacactgcactcagaccagcctgggaagattttaaggatatggtgtggtctgatgggttccaaggcagaggttacaatagcctggaagagggagactgctt

SEQ ID NO: 4530 - DNA, 201 bp, Homo sapiens; identical to SEQ ID NO: 4487

SEQ ID NO: 4531 - DNA, 201 bp, Homo sapiens; identical to SEQ ID NO: 4453

SEQ ID NO: 4532 - DNA, 201 bp, Homo sapiens; identical to SEQ ID NO: 4454

SEQ ID NO: 4533 - DNA, 201 bp, Homo sapiens; identical to SEQ ID NO: 4455

SEQ ID NO: 4534 - DNA, 201 bp, Homo sapiens
tataaggcaaagccccacagtcttcgttataacctcacggtgctgtcctgggatggatctgtgcagtcagggtttcttgctgaggtacatctggatggtcwgcccttcctgcgctatgacaggcagaaatgcagggcaaagccccagggacagtgggcagaagatgtcctgggaaataagacatgggacagagagaccagg

SEQ ID NO: 4535 - DNA, 185 bp, Homo sapiens
ggcggagcggagccccgccctgggttatgtaagcgaccgcgctgggccgtttctctttcttttccggaccctgcagtggcgcctraagtctgagagagggaagtcgcctctgtgctcgtgagtgcatggggtataaggcaaagccccacagtcttcgttataacctcacggtgctgtcctgggat

SEQ ID NO: 4536 - DNA, 201 bp, Homo sapiens; identical to SEQ ID NO: 4457

SEQ ID NO: 4537 - DNA, 201 bp, Homo sapiens
cgcctaaagtctgagagagggaagtcgcctctgtgctcgtgagtgcatggggtataaggcaaagccccacagtcttcgttataacctcacggtgctgtcckgggatggatctgtgcagtcagggtttcttgctgaggtacatctggatggtcagcccttcctgcgctatgacaggcagaaatgcagggcaaagccccaggg

SEQ ID NO: 4538 - DNA, 201 bp, Homo sapiens; identical to SEQ ID NO: 4459

SEQ ID NO: 4539 - DNA, 201 bp, Homo sapiens; identical to SEQ ID NO: 4460

SEQ ID NO: 4540 - DNA, 201 bp, Homo sapiens
gccctctgggaaagtgctggtgcttcagagtcattggcagacattccatgtttctgctgttgctgctggctgctgctatttttgttattattattttctaygtccgttgttgtaagaagaaaacatcagctgcagagggtccaggtgagaaaactcgtgagcctgcaggtcctggatcaacacccagttgggacgagtgac

SEQ ID NO: 4541 - DNA, 201 bp, Homo sapiens; identical to SEQ ID NO: 4462

SEQ ID NO: 4542 - DNA, 201 bp, Homo sapiens; identical to SEQ ID NO: 4463

SEQ ID NO: 4543 - DNA, 201 bp, Homo sapiens; identical to SEQ ID NO: 4464

SEQ ID NO: 4544 - DNA, 201 bp, Homo sapiens; identical to SEQ ID NO: 4465

SEQ ID NO: 4545 - DNA, 201 bp, Homo sapiens; identical to SEQ ID NO: 4466

SEQ ID NO: 4546 - DNA, 201 bp, Homo sapiens
gccctgggttatgtaagcgaccgcgctgggccgtttctctttcttttccggaccctgcagtggcgcctaaagtctgagagagggaagtcgcctctgtgctsgtgagtgcatggggtataaggcaaagccccacagtcttcgttataacctcacggtgctgtcctgggatggatctgtgcagtcagggtttcttgctgaggt

SEQ ID NO: 4547 - DNA, 201 bp, Homo sapiens; identical to SEQ ID NO: 4467

SEQ ID NO: 4548 - DNA, 201 bp, Homo sapiens; identical to SEQ ID NO: 4468

SEQ ID NO: 4549 - DNA, 201 bp, Homo sapiens; identical to SEQ ID NO: 4469

SEQ ID NO: 4550 - DNA, 201 bp, Homo sapiens; identical to SEQ ID NO: 4470

SEQ ID NO: 4551 - DNA, 201 bp, Homo sapiens; identical to SEQ ID NO: 4471

SEQ ID NO: 4552 - DNA, 201 bp, Homo sapiens; identical to SEQ ID NO: 4472

SEQ ID NO: 4553 - DNA, 201 bp, Homo sapiens; identical to SEQ ID NO: 4473

SEQ ID NO: 4554 - DNA, 201 bp, Homo sapiens; identical to SEQ ID NO: 4474

SEQ ID NO: 4555 - DNA, 201 bp, Homo sapiens; identical to SEQ ID NO: 4475

SEQ ID NO: 4556 - DNA, 115 bp, Homo sapiens
ggcggagcggagccmcgccctgggttatgtaagcgaccgcgctgggccgtttctctttcttttccggaccctgcagtggcgcctaaagtctgagagagggaagtcgcctctgtgc

SEQ ID NO: 4557 - DNA, 201 bp, Homo sapiens; identical to SEQ ID NO: 4476

SEQ ID NO: 4558 - DNA, 201 bp, Homo sapiens
tctgggaaagtgctggtgcttcagagtcattggcagacattccatgtttctgctgttgctgctggctgctgctatttttgttattattattttctatgtcygttgttgtaagaagaaaacatcagctgcagagggtccaggtgagaaaactcgtgagcctgcaggtcctggatcaacacccagttgggacgagtgaccaca

SEQ ID NO: 4559 - DNA, 201 bp, Homo sapiens; identical to SEQ ID NO: 4480

SEQ ID NO: 4560 - DNA, 201 bp, Homo sapiens
tctgtgctcgtgagtgcatggggtataaggcaaagccccacagtcttcgttataacctcacggtgctgtcctgggatggatctgtgcagtcagggtttctygctgaggtacatctggatggtcagcccttcctgcgctatgacaggcagaaatgcagggcaaagccccagggacagtgggcagaagatgtcctgggaaata

SEQ ID NO: 4561 - DNA, 201 bp, Homo sapiens; identical to SEQ ID NO: 4482

SEQ ID NO: 4562 - DNA, 201 bp, Homo sapiens; identical to SEQ ID NO: 4483

SEQ ID NO: 4563 - DNA, 201 bp, Homo sapiens
ctgtgctcgtgagtgcatggggtataaggcaaagccccacagtcttcgttataacctcacggtgctgtcctgggatggatctgtgcagtcagggtttcttrctgaggtacatctggatggtcagcccttcctgcgctatgacaggcagaaatgcagggcaaagccccagggacagtgggcagaagatgtcctgggaaataa

SEQ ID NO: 4564 - DNA, 201 bp, Homo sapiens; identical to SEQ ID NO: 4485

SEQ ID NO: 4565 - DNA, 201 bp, Homo sapiens; identical to SEQ ID NO: 4486

SEQ ID NO: 4566 - DNA, 201 bp, Homo sapiens
ttcttttccggaccctgcagtggcgcctaaagtctgagagagggaagtcgcctctgtgctcgtgagtgcatggggtataaggcaaagccccacagtcttcsttataacctcacggtgctgtcctgggatggatctgtgcagtcagggtttcttgctgaggtacatctggatggtcagcccttcctgcgctatgacaggcag

SEQ ID NO: 4567 - DNA, 201 bp, Homo sapiens; identical to SEQ ID NO: 4453

SEQ ID NO: 4568 - DNA, 201 bp, Homo sapiens; identical to SEQ ID NO: 4454

SEQ ID NO: 4569 - DNA, 201 bp, Homo sapiens; identical to SEQ ID NO: 4455

SEQ ID NO: 4570 - DNA, 201 bp, Homo sapiens; identical to SEQ ID NO: 4456

SEQ ID NO: 4571 - DNA, 201 bp, Homo sapiens; identical to SEQ ID NO: 4457

SEQ ID NO: 4572 - DNA, 201 bp, Homo sapiens; identical to SEQ ID NO: 4458

SEQ ID NO: 4573 - DNA, 201 bp, Homo sapiens; identical to SEQ ID NO: 4459

SEQ ID NO: 4574 - DNA, 201 bp, Homo sapiens; identical to SEQ ID NO: 4460

SEQ ID NO: 4575 - DNA, 201 bp, Homo sapiens; identical to SEQ ID NO: 4540

SEQ ID NO: 4576 - DNA, 201 bp, Homo sapiens; identical to SEQ ID NO: 4462

SEQ ID NO: 4577 - DNA, 201 bp, Homo sapiens; identical to SEQ ID NO: 4463

SEQ ID NO: 4578 - DNA, 201 bp, Homo sapiens; identical to SEQ ID NO: 4464

SEQ ID NO: 4579 - DNA, 201 bp, Homo sapiens; identical to SEQ ID NO: 4465

SEQ ID NO: 4580 - DNA, 201 bp, Homo sapiens; identical to SEQ ID NO: 4466

SEQ ID NO: 4581 - DNA, 201 bp, Homo sapiens; identical to SEQ ID NO: 4467

SEQ ID NO: 4582 - DNA, 201 bp, Homo sapiens; identical to SEQ ID NO: 4468

SEQ ID NO: 4583 - DNA, 201 bp, Homo sapiens; identical to SEQ ID NO: 4469

SEQ ID NO: 4584 - DNA, 201 bp, Homo sapiens; identical to SEQ ID NO: 4470

SEQ ID NO: 4585 - DNA, 201 bp, Homo sapiens; identical to SEQ ID NO: 4471

SEQ ID NO: 4586 - DNA, 201 bp, Homo sapiens; identical to SEQ ID NO: 4472

SEQ ID NO: 4587 - DNA, 201 bp, Homo sapiens; identical to SEQ ID NO: 4473

SEQ ID NO: 4588 - DNA, 201 bp, Homo sapiens; identical to SEQ ID NO: 4474

SEQ ID NO: 4589 - DNA, 201 bp, Homo sapiens; identical to SEQ ID NO: 4475

SEQ ID NO: 4590 - DNA, 201 bp, Homo sapiens; identical to SEQ ID NO: 4476

SEQ ID NO: 4591 - DNA, 201 bp, Homo sapiens; identical to SEQ ID NO: 4558

SEQ ID NO: 4592 - DNA, 201 bp, Homo sapiens; identical to SEQ ID NO: 4478

SEQ ID NO: 4593 - DNA, 201 bp, Homo sapiens; identical to SEQ ID NO: 4479

SEQ ID NO: 4594 - DNA, 201 bp, Homo sapiens; identical to SEQ ID NO: 4480

SEQ ID NO: 4595 - DNA, 201 bp, Homo sapiens; identical to SEQ ID NO: 4481

SEQ ID NO: 4596 - DNA, 201 bp, Homo sapiens; identical to SEQ ID NO: 4482

SEQ ID NO: 4597 - DNA, 201 bp, Homo sapiens; identical to SEQ ID NO: 4483

SEQ ID NO: 4598 - DNA, 201 bp, Homo sapiens; identical to SEQ ID NO: 4484

SEQ ID NO: 4599 - DNA, 201 bp, Homo sapiens; identical to SEQ ID NO: 4485

SEQ ID NO: 4600 - DNA, 201 bp, Homo sapiens; identical to SEQ ID NO: 4486

SEQ ID NO: 4601 - DNA, 175 bp, Homo sapiens; identical to SEQ ID NO: 4529

SEQ ID NO: 4602 - DNA, 201 bp, Homo sapiens; identical to SEQ ID NO: 4487

SEQ ID NO: 4603 - DNA, 201 bp, Homo sapiens; identical to SEQ ID NO: 4453

SEQ ID NO: 4604 - DNA, 201 bp, Homo sapiens; identical to SEQ ID NO: 4454

SEQ ID NO: 4605 - DNA, 201 bp, Homo sapiens
gtatatgaaatcctcgttcttgtccctttgcccgtgtgcatttcctgccccaggaaggttgggacagcagacctgtgtgttaaacatcaatgtgaagttayttccaggaagaagtttcacctgtgatttcctcttccccagagccccacagtcttcgttataacctcacggtgctgtcctgggatggatctgtgcagtcag

SEQ ID NO: 4606 - DNA, 201 bp, Homo sapiens; identical to SEQ ID NO: 4455

SEQ ID NO: 4607 - DNA, 201 bp, Homo sapiens
tcttccccagagccccacagtcttcgttataacctcacggtgctgtcctgggatggatctgtgcagtcagggtttcttgctgaggtacatctggatggtcwgcccttcctgcgctatgacaggcagaaatgcagggcaaagccccagggacagtgggcagaagatgtcctgggaaataagacatgggacagagagaccagg

SEQ ID NO: 4608 - DNA, 201 bp, Homo sapiens; identical to SEQ ID NO: 4457

SEQ ID NO: 4609 - DNA, 201 bp, Homo sapiens
ttaaacatcaatgtgaagttacttccaggaagaagtttcacctgtgatttcctcttccccagagccccacagtcttcgttataacctcacggtgctgtcckgggatggatctgtgcagtcagggtttcttgctgaggtacatctggatggtcagcccttcctgcgctatgacaggcagaaatgcagggcaaagccccaggg

SEQ ID NO: 4610 - DNA, 201 bp, Homo sapiens; identical to SEQ ID NO: 4459

SEQ ID NO: 4611 - DNA, 201 bp, Homo sapiens; identical to SEQ ID NO: 4460

SEQ ID NO: 4612 - DNA, 201 bp, Homo sapiens
aacttctctggggctacaaccttcctaccctttgtgcctcatgaccaccccctcccttgtccccgccatgcccatgatgagtctcttctcgaggcagctcsccttgcctccatctcaccctcagcctatgcaccacagccacactggacatgggtccctctgagcctgagtcccttcccattcccaccatcccctctggca

SEQ ID NO: 4613 - DNA, 201 bp, Homo sapiens
ctcgaggcagctccccttgcctccatctcaccctcagcctatgcaccacagccacactggacatgggtccctctgagcctgagtcccttcccattcccacyatcccctctggcaagaccttccttccaccaccttcatgctcctcccttgcccctgcagggcagcctctccccttggcccctattcccttagggggcttgt

SEQ ID NO: 4614 - DNA, 201 bp, Homo sapiens
aggcagctccccttgcctccatctcaccctcagcctatgcaccacagccacactggacatgggtccctctgagcctgagtcccttcccattcccaccatcycctctggcaagaccttccttccaccaccttcatgctcctcccttgcccctgcagggcagcctctccccttggcccctattcccttagggggcttgtggcc

SEQ ID NO: 4615 - DNA, 201 bp, Homo sapiens; identical to SEQ ID NO: 4461

SEQ ID NO: 4616 - DNA, 201 bp, Homo sapiens
cttctgttcatcagccccctcctctatcctcccaccctcacagttttctttgtatatgaaatcctcgttcttgtccctttgcccgtgtgcatttcctgccycaggaaggttgggacagcagacctgtgtgttaaacatcaatgtgaagttacttccaggaagaagtttcacctgtgatttcctcttccccagagccccaca

SEQ ID NO: 4617 - DNA, 201 bp, Homo sapiens
tcttcccactggatctggctcaggctgggggtgaggaatgggggtcagtggaactcagcagggaggtgagccggcactcagcccacacagggaggcatggrggagggccagggaggcataccccctgggctgagttcctcacttgggtggaaaggtgatgggttcgggaatggagaagtcactgctgggtgggggcaggct

SEQ ID NO: 4618 - DNA, 201 bp, Homo sapiens; identical to SEQ ID NO: 4462

SEQ ID NO: 4619 - DNA, 201 bp, Homo sapiens
gctcaggctgggggtgaggaatgggggtcagtggaactcagcagggaggtgagccggcactcagcccacacagggaggcatggaggagggccagggaggcrtaccccctgggctgagttcctcacttgggtggaaaggtgatgggttcgggaatggagaagtcactgctgggtgggggcaggcttgcattccctccaggag

SEQ ID NO: 4620 - DNA, 201 bp, Homo sapiens; identical to SEQ ID NO: 4463

SEQ ID NO: 4621 - DNA, 201 bp, Homo sapiens; identical to SEQ ID NO: 4464

SEQ ID NO: 4622 - DNA, 201 bp, Homo sapiens; identical to SEQ ID NO: 4465

SEQ ID NO: 4623 - DNA, 201 bp, Homo sapiens; identical to SEQ ID NO: 4466

SEQ ID NO: 4624 - DNA, 201 bp, Homo sapiens
tccctttgcccgtgtgcatttcctgccccaggaaggttgggacagcagacctgtgtgttaaacatcaatgtgaagttacttccaggaagaagtttcacctrtgatttcctcttccccagagccccacagtcttcgttataacctcacggtgctgtcctgggatggatctgtgcagtcagggtttcttgctgaggtacatct

SEQ ID NO: 4625 - DNA, 201 bp, Homo sapiens
ctgctgggtgggggcaggcttgcattccctccaggagattagggtctgtgagatccatgaagacaacagcaccaggagctcccagcatttctactacgatrgggagctcttcctctcccaaaacctggagactgaggaatggacagtgccccagtcctccagagctcagaccttggccatgaacgtcaggaatttcttgaa

SEQ ID NO: 4626 - DNA, 201 bp, Homo sapiens; identical to SEQ ID NO: 4468

SEQ ID NO: 4627 - DNA, 201 bp, Homo sapiens
ctggatggtcagcccttcctgcgctatgacaggcagaaatgcagggcaaagccccagggacagtgggcagaagatgtcctgggaaataagacatgggacasagagaccagggacttgacagggaacggaaaggacctcaggatgaccctggctcatatcaaggaccagaaagaaggtgagagtcggcaggggcaagagtga

SEQ ID NO: 4628 - DNA, 201 bp, Homo sapiens; identical to SEQ ID NO: 4470

SEQ ID NO: 4629 - DNA, 201 bp, Homo sapiens; identical to SEQ ID NO: 4471

SEQ ID NO: 4630 - DNA, 201 bp, Homo sapiens
gtcactgctgggtgggggcaggcttgcattccctccaggagattagggtctgtgagatccatgaagacaacagcaccaggagctcccagcatttctactaygatggggagctcttcctctcccaaaacctggagactgaggaatggacagtgccccagtcctccagagctcagaccttggccatgaacgtcaggaatttct

SEQ ID NO: 4631 - DNA, 201 bp, Homo sapiens; identical to SEQ ID NO: 4472

SEQ ID NO: 4632 - DNA, 201 bp, Homo sapiens; identical to SEQ ID NO: 4474

SEQ ID NO: 4633 - DNA, 201 bp, Homo sapiens; identical to SEQ ID NO: 4475

SEQ ID NO: 4634 - DNA, 201 bp, Homo sapiens; identical to SEQ ID NO: 4476

SEQ ID NO: 4635 - DNA, 201 bp, Homo sapiens; identical to SEQ ID NO: 4477

SEQ ID NO: 4636 - DNA, 201 bp, Homo sapiens
ttgtccctttgcccgtgtgcatttcctgccccaggaaggttgggacagcagacctgtgtgttaaacatcaatgtgaagttacttccaggaagaagtttcayctgtgatttcctcttccccagagccccacagtcttcgttataacctcacggtgctgtcctgggatggatctgtgcagtcagggtttcttgctgaggtaca

SEQ ID NO: 4637 - DNA, 201 bp, Homo sapiens; identical to SEQ ID NO: 4480

SEQ ID NO: 4638 - DNA, 201 bp, Homo sapiens
aagaagtttcacctgtgatttcctcttccccagagccccacagtcttcgttataacctcacggtgctgtcctgggatggatctgtgcagtcagggtttctygctgaggtacatctggatggtcagcccttcctgcgctatgacaggcagaaatgcagggcaaagccccagggacagtgggcagaagatgtcctgggaaata

SEQ ID NO: 4639 - DNA, 201 bp, Homo sapiens
gctgtcctggggccttgtcatgctactcttccactttgaacccaagcccacaccgttcgttgctcccctctgggatactgaccccactataaacttctctrgggctacaaccttcctaccctttgtgcctcatgaccaccccctcccttgtccccgccatgcccatgatgagtctcttctcgaggcagctccccttgcctc

SEQ ID NO: 4640 - DNA, 201 bp, Homo sapiens
gctactcttccactttgaacccaagcccacaccgttcgttgctcccctctgggatactgaccccactataaacttctctggggctacaaccttcctacccyttgtgcctcatgaccaccccctcccttgtccccgccatgcccatgatgagtctcttctcgaggcagctccccttgcctccatctcaccctcagcctatgc

SEQ ID NO: 4641 - DNA, 201 bp, Homo sapiens
ccccactataaacttctctggggctacaaccttcctaccctttgtgcctcatgaccaccccctcccttgtccccgccatgcccatgatgagtctcttctcraggcagctccccttgcctccatctcaccctcagcctatgcaccacagccacactggacatgggtccctctgagcctgagtcccttcccattcccaccatc

SEQ ID NO: 4642 - DNA, 201 bp, Homo sapiens; identical to SEQ ID NO: 4482

SEQ ID NO: 4643 - DNA, 201 bp, Homo sapiens; identical to SEQ ID NO: 4483

SEQ ID NO: 4644 - DNA, 201 bp, Homo sapiens
agaagtttcacctgtgatttcctcttccccagagccccacagtcttcgttataacctcacggtgctgtcctgggatggatctgtgcagtcagggtttcttrctgaggtacatctggatggtcagcccttcctgcgctatgacaggcagaaatgcagggcaaagccccagggacagtgggcagaagatgtcctgggaaataa

SEQ ID NO: 4645 - DNA, 201 bp, Homo sapiens; identical to SEQ ID NO: 4485

SEQ ID NO: 4646 - DNA, 201 bp, Homo sapiens; identical to SEQ ID NO: 4486

SEQ ID NO: 4647 - DNA, 201 bp, Homo sapiens
ggttgggacagcagacctgtgtgttaaacatcaatgtgaagttacttccaggaagaagtttcacctgtgatttcctcttccccagagccccacagtcttcsttataacctcacggtgctgtcctgggatggatctgtgcagtcagggtttcttgctgaggtacatctggatggtcagcccttcctgcgctatgacaggcag

SEQ ID NO: 4648 - DNA, 201 bp, Homo sapiens; identical to SEQ ID NO: 4453

SEQ ID NO: 4649 - DNA, 201 bp, Homo sapiens; identical to SEQ ID NO: 4454

SEQ ID NO: 4650 - DNA, 201 bp, Homo sapiens; identical to SEQ ID NO: 4455

SEQ ID NO: 4651 - DNA, 201 bp, Homo sapiens
gctgaagcagagccccacagtcttcgttataacctcacggtgctgtcctgggatggatctgtgcagtcagggtttcttgctgaggtacatctggatggtcwgcccttcctgcgctatgacaggcagaaatgcagggcaaagccccagggacagtgggcagaagatgtcctgggaaataagacatgggacagagagaccagg

SEQ ID NO: 4652 - DNA, 201 bp, Homo sapiens; identical to SEQ ID NO: 4457

SEQ ID NO: 4653 - DNA, 201 bp, Homo sapiens
tgaggttcggtgggcacagtggctcacgcctggatttccagcactttgggaggctgaagcagagccccacagtcttcgttataacctcacggtgctgtcckgggatggatctgtgcagtcagggtttcttgctgaggtacatctggatggtcagcccttcctgcgctatgacaggcagaaatgcagggcaaagccccaggg

SEQ ID NO: 4654 - DNA, 201 bp, Homo sapiens; identical to SEQ ID NO: 4459

SEQ ID NO: 4655 - DNA, 201 bp, Homo sapiens; identical to SEQ ID NO: 4460

SEQ ID NO: 4656 - DNA, 201 bp, Homo sapiens; identical to SEQ ID NO: 4540

SEQ ID NO: 4657 - DNA, 201 bp, Homo sapiens; identical to SEQ ID NO: 4462

SEQ ID NO: 4658 - DNA, 201 bp, Homo sapiens; identical to SEQ ID NO: 4463

SEQ ID NO: 4659 - DNA, 201 bp, Homo sapiens; identical to SEQ ID NO: 4464

SEQ ID NO: 4660 - DNA, 201 bp, Homo sapiens; identical to SEQ ID NO: 4465

SEQ ID NO: 4661 - DNA, 201 bp, Homo sapiens; identical to SEQ ID NO: 4466

SEQ ID NO: 4662 - DNA, 201 bp, Homo sapiens; identical to SEQ ID NO: 4467

SEQ ID NO: 4663 - DNA, 201 bp, Homo sapiens; identical to SEQ ID NO: 4468

SEQ ID NO: 4664 - DNA, 201 bp, Homo sapiens; identical to SEQ ID NO: 4469

SEQ ID NO: 4665 - DNA, 201 bp, Homo sapiens; identical to SEQ ID NO: 4470

SEQ ID NO: 4666 - DNA, 201 bp, Homo sapiens; identical to SEQ ID NO: 4471

SEQ ID NO: 4667 - DNA, 201 bp, Homo sapiens; identical to SEQ ID NO: 4472

SEQ ID NO: 4668 - DNA, 201 bp, Homo sapiens; identical to SEQ ID NO: 4473

SEQ ID NO: 4669 - DNA, 201 bp, Homo sapiens; identical to SEQ ID NO: 4474

SEQ ID NO: 4670 - DNA, 201 bp, Homo sapiens; identical to SEQ ID NO: 4475

SEQ ID NO: 4671 - DNA, 201 bp, Homo sapiens; identical to SEQ ID NO: 4476

SEQ ID NO: 4672 - DNA, 201 bp, Homo sapiens; identical to SEQ ID NO: 4558

SEQ ID NO: 4673 - DNA, 201 bp, Homo sapiens; identical to SEQ ID NO: 4480

SEQ ID NO: 4674 - DNA, 201 bp, Homo sapiens
ctggatttccagcactttgggaggctgaagcagagccccacagtcttcgttataacctcacggtgctgtcctgggatggatctgtgcagtcagggtttctygctgaggtacatctggatggtcagcccttcctgcgctatgacaggcagaaatgcagggcaaagccccagggacagtgggcagaagatgtcctgggaaata

SEQ ID NO: 4675 - DNA, 201 bp, Homo sapiens; identical to SEQ ID NO: 4482

SEQ ID NO: 4676 - DNA, 201 bp, Homo sapiens; identical to SEQ ID NO: 4483

SEQ ID NO: 4677 - DNA, 201 bp, Homo sapiens
tggatttccagcactttgggaggctgaagcagagccccacagtcttcgttataacctcacggtgctgtcctgggatggatctgtgcagtcagggtttcttrctgaggtacatctggatggtcagcccttcctgcgctatgacaggcagaaatgcagggcaaagccccagggacagtgggcagaagatgtcctgggaaataa

SEQ ID NO: 4678 - DNA, 201 bp, Homo sapiens; identical to SEQ ID NO: 4485

SEQ ID NO: 4679 - DNA, 201 bp, Homo sapiens; identical to SEQ ID NO: 4486

SEQ ID NO: 4680 - DNA, 201 bp, Homo sapiens
gcttatttcacttataatatttttgaggttcggtgggcacagtggctcacgcctggatttccagcactttgggaggctgaagcagagccccacagtcttcsttataacctcacggtgctgtcctgggatggatctgtgcagtcagggtttcttgctgaggtacatctggatggtcagcccttcctgcgctatgacaggcag

SEQ ID NO: 4681 - DNA, 201 bp, Homo sapiens; identical to SEQ ID NO: 4445

SEQ ID NO: 4682 - DNA, 201 bp, Homo sapiens; identical to SEQ ID NO: 4446

SEQ ID NO: 4683 - DNA, 121 bp, Homo sapiens
atggggctgggcccggtcttyctgcttctggctggcatcttcccttttgcacctccgggagctgctgctgagccccacagtcttcgttacaacctcatggtgctgtcccaggatggatctg

SEQ ID NO: 4684 - DNA, 201 bp, Homo sapiens; identical to SEQ ID NO: 4448

SEQ ID NO: 4685 - DNA, 201 bp, Homo sapiens; identical to SEQ ID NO: 4449

SEQ ID NO: 4686 - DNA, 201 bp, Homo sapiens; identical to SEQ ID NO: 4450

SEQ ID NO: 4687 - DNA, 201 bp, Homo sapiens; identical to SEQ ID NO: 4451

SEQ ID NO: 4688 - DNA, 201 bp, Homo sapiens; identical to SEQ ID NO: 4452

SEQ ID NO: 4689 - DNA, 201 bp, Homo sapiens
gccctctgggaaagtgctggtgcttcagagtcattggcagacattccatgtttctgctgttgctgctgctgctatttttgttattattattttctatgtcygttgttgtaagaagaaaacatcagctgcagagggtccagagctcgtgagcctgcaggtcctggatcaacacccagttgggacgagtgaccacagggatgc

SEQ ID NO: 4690 - DNA, 201 bp, Homo sapiens
agaacagtgccccccatggtgaatgtcacccgcagcgaggcctcagagggcaacattaccgtgacatgcagggcttctggcttctatccctggaatatcayactgagctggcgtcaggatggggtatctttgagccacgacacccagcagtggggggatgtcctgcctgatgggaatggaacctaccagacctgggtggcc

SEQ ID NO: 4691 - DNA, 201 bp, Homo sapiens; identical to SEQ ID NO: 4474

SEQ ID NO: 4692 - DNA, 201 bp, Homo sapiens
ggcgacgtcggggccatggggctgggcccggtcttcctgcttctggctggcatcttcccttttgcacctccgggagctgctgctgagccccacagtcttcsttataacctcacggtgctgtcctgggatggatctgtgcagtcagggtttctcactgaggtacatctggatggtcagcccttcctgcgctgtgacaggcag

SEQ ID NO: 4693 - DNA, 201 bp, Homo sapiens
ctggatggtcagcccttcctgcgctgtgacaggcagaaatgcagggcaaagccccagggacagtgggcagaagatgtcctgggaaataagacatgggacasagagaccagagacttgacagggaacggaaaggacctcaggatgaccctggctcatatcaaggaccagaaagaaggcttgcattccctccaggagattagg

SEQ ID NO: 4694 - DNA, 201 bp, Homo sapiens
tctgggaaagtgctggtgcttcagagtcattggcagacattccatgtttctgctgttgctgctgctgctatttttgttattattattttctatgtccgttyttgtaagaagaaaacatcagctgcagagggtccagagctcgtgagcctgcaggtcctggatcaacacccagttgggacgagtgaccacagggatgccaca

SEQ ID NO: 4695 - DNA, 201 bp, Homo sapiens
gaccttggccatgaacgtcaggaatttcttgaaggaagatgccatgaagaccaagacacactatcacgctatgcatgcagactgcctgcaggaactacggygatatctaaaatccggcgtagtcctgaggagaacagtgccccccatggtgaatgtcacccgcagcgaggcctcagagggcaacattaccgtgacatgcag

SEQ ID NO: 4696 - DNA, 201 bp, Homo sapiens
gtgccccccatggtgaatgtcacccgcagcgaggcctcagagggcaacattaccgtgacatgcagggcttctggcttctatccctggaatatcacactgasctggcgtcaggatggggtatctttgagccacgacacccagcagtggggggatgtcctgcctgatgggaatggaacctaccagacctgggtggccaccagg

SEQ ID NO: 4697 - DNA, 201 bp, Homo sapiens
tcttcccttttgcacctccgggagctgctgctgagccccacagtcttcgttataacctcacggtgctgtcctgggatggatctgtgcagtcagggtttctyactgaggtacatctggatggtcagcccttcctgcgctgtgacaggcagaaatgcagggcaaagccccagggacagtgggcagaagatgtcctgggaaata

SEQ ID NO: 4698 - DNA, 201 bp, Homo sapiens
cttcccttttgcacctccgggagctgctgctgagccccacagtcttcgttataacctcacggtgctgtcctgggatggatctgtgcagtcagggtttctcrctgaggtacatctggatggtcagcccttcctgcgctgtgacaggcagaaatgcagggcaaagccccagggacagtgggcagaagatgtcctgggaaataa

SEQ ID NO: 4699 - DNA, 201 bp, Homo sapiens
cacagtcttcgttataacctcacggtgctgtcctgggatggatctgtgcagtcagggtttctcactgaggtacatctggatggtcagcccttcctgcgctrtgacaggcagaaatgcagggcaaagccccagggacagtgggcagaagatgtcctgggaaataagacatgggacagagagaccagagacttgacagggaac

SEQ ID NO: 4700 - DNA, 201 bp, Homo sapiens
ttccctccaggagattagggtctgtgagatccatgaagacaacagcaccaggagctcccagcatttctactacgatggggagctcttcctctcccaaaacstggagactaaggaatggacaatgccccagtcctccagagctcagaccttggccatgaacgtcaggaatttcttgaaggaagatgccatgaagaccaagac

SEQ ID NO: 4701 - DNA, 201 bp, Homo sapiens
ggagattagggtctgtgagatccatgaagacaacagcaccaggagctcccagcatttctactacgatggggagctcttcctctcccaaaacctggagactraggaatggacaatgccccagtcctccagagctcagaccttggccatgaacgtcaggaatttcttgaaggaagatgccatgaagaccaagacacactatca

SEQ ID NO: 4702 - DNA, 201 bp, Homo sapiens
ctgtgagatccatgaagacaacagcaccaggagctcccagcatttctactacgatggggagctcttcctctcccaaaacctggagactaaggaatggacartgccccagtcctccagagctcagaccttggccatgaacgtcaggaatttcttgaaggaagatgccatgaagaccaagacacactatcacgctatgcatgc

SEQ ID NO: 4703 - DNA, 201 bp, Homo sapiens
cgtcaggaatttcttgaaggaagatgccatgaagaccaagacacactatcacgctatgcatgcagactgcctgcaggaactacggcgatatctaaaatccrgcgtagtcctgaggagaacagtgccccccatggtgaatgtcacccgcagcgaggcctcagagggcaacattaccgtgacatgcagggcttctggcttcta

SEQ ID NO: 4704 - DNA, 201 bp, Homo sapiens
gggcccggtcttcctgcttctggctggcatcttcccttttgcacctccgggagctgctgctgagccccacagtcttcgttataacctcacggtgctgtcckgggatggatctgtgcagtcagggtttctcactgaggtacatctggatggtcagcccttcctgcgctgtgacaggcagaaatgcagggcaaagccccaggg

SEQ ID NO: 4705 - DNA, 201 bp, Homo sapiens
catgaacgtcaggaatttcttgaaggaagatgccatgaagaccaagacacactatcacgctatgcatgcagactgcctgcaggaactacggcgatatctaraatccggcgtagtcctgaggagaacagtgccccccatggtgaatgtcacccgcagcgaggcctcagagggcaacattaccgtgacatgcagggcttctgg

SEQ ID NO: 4706 - DNA, 201 bp, Homo sapiens
ggatcaacacccagttgggacgagtgaccacagggatgccacacagctcggatttcagcctctgatgtcagatcttgggtccactggctccactgagggcrcctagactctacagccaggcagctgggattcaattccctgcctggatctcacgagcactttccctcttggtgcctcagtttcctgacctatgaaacagag

SEQ ID NO: 4707 - DNA, 201 bp, Homo sapiens
caaggaccagaaagaaggcttgcattccctccaggagattagggtctgtgagatccatgaagacaacagcaccaggagctcccagcatttctactacgatrgggagctcttcctctcccaaaacctggagactaaggaatggacaatgccccagtcctccagagctcagaccttggccatgaacgtcaggaatttcttgaa

SEQ ID NO: 4708 - DNA, 201 bp, Homo sapiens
agtcctgaggagaacagtgccccccatggtgaatgtcacccgcagcgaggcctcagagggcaacattaccgtgacatgcagggcttctggcttctatcccyggaatatcacactgagctggcgtcaggatggggtatctttgagccacgacacccagcagtggggggatgtcctgcctgatgggaatggaacctaccagac

SEQ ID NO: 4709 - DNA, 201 bp, Homo sapiens
tgagctggcgtcaggatggggtatctttgagccacgacacccagcagtggggggatgtcctgcctgatgggaatggaacctaccagacctgggtggccacyaggatttgccaaggagaggagcagaggttcacctgctacatggaacacagcgggaatcacagcactcaccctgtgccctctgggaaagtgctggtgcttc

SEQ ID NO: 4710 - DNA, 201 bp, Homo sapiens
gaatggaacctaccagacctgggtggccaccaggatttgccaaggagaggagcagaggttcacctgctacatggaacacagcgggaatcacagcactcacsctgtgccctctgggaaagtgctggtgcttcagagtcattggcagacattccatgtttctgctgttgctgctgctgctatttttgttattattattttcta

SEQ ID NO: 4711 - DNA, 201 bp, Homo sapiens
gctgctgctgagccccacagtcttcgttataacctcacggtgctgtcctgggatggatctgtgcagtcagggtttctcactgaggtacatctggatggtcwgcccttcctgcgctgtgacaggcagaaatgcagggcaaagccccagggacagtgggcagaagatgtcctgggaaataagacatgggacagagagaccaga

SEQ ID NO: 4712 - DNA, 201 bp, Homo sapiens
gtgctgtcctgggatggatctgtgcagtcagggtttctcactgaggtacatctggatggtcagcccttcctgcgctgtgacaggcagaaatgcagggcaargccccagggacagtgggcagaagatgtcctgggaaataagacatgggacagagagaccagagacttgacagggaacggaaaggacctcaggatgaccctg

SEQ ID NO: 4713 - DNA, 201 bp, Homo sapiens
cctctcccaaaacctggagactaaggaatggacaatgccccagtcctccagagctcagaccttggccatgaacgtcaggaatttcttgaaggaagatgccrtgaagaccaagacacactatcacgctatgcatgcagactgcctgcaggaactacggcgatatctaaaatccggcgtagtcctgaggagaacagtgccccc

SEQ ID NO: 4714 - DNA, 201 bp, Homo sapiens
atatcaaggaccagaaagaaggcttgcattccctccaggagattagggtctgtgagatccatgaagacaacagcaccaggagctcccagcatttctactaygatggggagctcttcctctcccaaaacctggagactaaggaatggacaatgccccagtcctccagagctcagaccttggccatgaacgtcaggaatttct

SEQ ID NO: 4715 - DNA, 201 bp, Homo sapiens
gcctctcactccagacctgttcccacaactggggaggtaggctgggagcaaaaggagagggtgggacccagttttgcgtggttggtttttattaattatcyggataacagcaaaaaaactgaaaataaagagagagagagatctgggtgttggtggttgcatttgttaaggaattgaagaagcagttcttgcccaggcaac

SEQ ID NO: 4716 - DNA, 201 bp, Homo sapiens
ccactccaaagtccatggattcaatggactcatccatttgtgaggaggacttctcgccctctggctggaagctgatacctgaagcactcccaggctcatcmtgggagctttcctcagcaccttcaccttccctcccagtgtagcctcctgtcagtgggggctggacccttctaattcagaggtctcatgcctgcccttgcc

SEQ ID NO: 4717 - DNA, 201 bp, Homo sapiens
ccatctgtccccatcttcctccccacacctacccacccagtgggccctgaagcagggccaaaccctcttccttgtctcccctctccccacttattctcctmtttggaatcttcaacttctgaagtgaatgtggatacagcgccactcctgccccctcttggccccatccatggactcttgcctcggtgcagtctccactct

SEQ ID NO: 4718 - DNA, 201 bp, Homo sapiens
gggtgtttcctgagggaacgagaaaccacaatggctccatgctgcccttcaaacgtggcgccttccatcttgcagtgcaggcccaggttcccattgtcccyatagtcatgtcctcctaccaagacttctactgcaagaaggagcgtcgcttcacctcgggacaatgtcaggtgcgggtgctgcccccagtgcccacggaag

SEQ ID NO: 4719 - DNA, 201 bp, Homo sapiens
tgaggtggccagaatggatttgtggccaggggcatggatgctgctgctgctgctcttcctgctgctgctcttcctgctgcccaccctgtggttctgcagcyccagtgccaagtacttcttcaagatggccttctacaatggctggatcctcttcctggctgtgctcgccatccctgtgtgtgccgtgcgaggacgcaacgt

SEQ ID NO: 4720 - DNA, 201 bp, Homo sapiens
ccgccgccccgcccccgccggcgccagcccagactgcccaggcccctggcttcgtggtgcccacgcacgcggggactgtgggcacgctgccgctggggggytacgtagcgcccggataccccctgcagctgcagccttgcactgcttacgtgccggtctacccggtgggcacgccatatgcaggcgggaccccggggggaa

SEQ ID NO: 4721 - DNA, 201 bp, Homo sapiens
agtgtgcccctggcttcctgggtgagacgtgccagtttcctgacccctgccagaacgcccagctctgccaaaatggaggcagctgccaagccctgcttccygctcccctagggctccccagctctccctctccattgacacccagcttcttgtgcacttgcctccctggcttcactggcgagagatgccaggccaagcttg

SEQ ID NO: 4722 - DNA, 201 bp, Homo sapiens
tccacaacgggcactgtgagaaaggctgcaacactgcagagtgtggctgggatggaggtgactgcaggcctgaagatggggacccagagtgggggccctcyctggccctgctggtggtactgagccccccagccctagaccagcagctgtttgccctggcccgggtgctgtccctgactctgagggtaggactctgggtaa

SEQ ID NO: 4723 - DNA, 201 bp, Homo sapiens
tttcccagaaccctgtgccaatggaggcacctgcctgagcctgtctctgggacaagggacctgccagtgtgcccctggcttcctgggtgagacgtgccagwttcctgacccctgccagaacgcccagctctgccaaaatggaggcagctgccaagccctgcttcccgctcccctagggctccccagctctccctctccatt

SEQ ID NO: 4724 - DNA, 201 bp, Homo sapiens
gcccaccgggcttcgagggccatgcctgtgaacgtgatgtcaacgagtgcttccaggacccaggaccctgccccaaaggcacctcctgccataacaccctrggctccttccagtgcctctgccctgtggggcaggagggtccacgttgtgagctgcgggcaggaccctgccctcctaggggctgttcgaatgggggcacct

SEQ ID NO: 4725 - DNA, 201 bp, Homo sapiens
taggaggaactcgggaccccacctatcaggagagagcagcccctcaaacgcagcccctgggcaaggagaccgactccctcagtgctgggtttgtggtggtmatgggtgtggatttgtcccgctgtggccctgaccacccggcatcccgctgtccctgggaccctgggcttctactccgcttccttgctgcgatggctgcag

SEQ ID NO: 4726 - DNA, 201 bp, Homo sapiens
tgtctggccacatacccccagatccagtgccactgcccaccgggcttcgagggccatgcctgtgaacgtgatgtcaacgagtgcttccaggacccaggacyctgccccaaaggcacctcctgccataacaccctgggctccttccagtgcctctgccctgtggggcaggagggtccacgttgtgagctgcgggcaggaccc

SEQ ID NO: 4727 - DNA, 201 bp, Homo sapiens
agtgccagcttcgggacttctgttcagccaacccatgtgttaatggaggggtgtgtctggccacatacccccagatccagtgccactgcccaccgggcttygagggccatgcctgtgaacgtgatgtcaacgagtgcttccaggacccaggaccctgccccaaaggcacctcctgccataacaccctgggctccttccagt

SEQ ID NO: 4728 - DNA, 201 bp, Homo sapiens
cagggaccgcaccccctgccaaccagcttccctggcctgtgctgtgctccccagtggccggggtgattctcctggccctaggggctcttctcgtcctccarctcatccggcgtcgacgccgagagcatggagctctctggctgccccctggtttcactcgacggcctcggactcagtcagctccccaccgacgccggcccc

SEQ ID NO: 4729 - DNA, 123 bp, Homo sapiens
agacgtgaggcttgcagcaggcygaggaggaagaagaggggcagtgggagcagaggaggtggctcctgccccagtgagagctctgagggtccctgcctgaagagggacagggaccggggcttg

SEQ ID NO: 4730 - DNA, 201 bp, Homo sapiens
ttgatgaggatggagttgtgatgtgctcaggccctgaggagggagaggaggtgggccaggtgaaagggctggggcaagaatggtctggaggtgatggaagsgatgaaagggcaaatcaaccttcactgatccttgctgttacccaaaggctgaagaaacaggcccaccctccacgtgccagctctggtctctgagtggtgg

SEQ ID NO: 4731 - DNA, 201 bp, Homo sapiens
gggcagaagtggagatggggcctgcgatgctggctgcagtggcccgggaggaaactgggatggaggggactgctctctgggagtcccagacccctggaagsgctgcccctcccactctcggtgctggcttctcttccgggacgggcagtgccacccacagtgtgactctgaagagtgtctgtttgatggctacgactgtga

SEQ ID NO: 4732 - DNA, 201 bp, Homo sapiens
ggacgctgtcagccggagcaggccctcgtgggggcggagcttgtctgcaggctcggacttggtccgtagacttggctgcgcgggggggcggggcctattckcattgccggagcctctcgggagtaggagcaggaggaggcccgacccctcgcggccgtaggttttctgcaggcatgcgcgggcctcggcccaaccctgcga

SEQ ID NO: 4733 - DNA, 201 bp, Homo sapiens
tgaggatggagttgtgatgtgctcaggccctgaggagggagaggaggtgggccaggtgaaagggctggggcaagaatggtctggaggtgatggaagggatsaaagggcaaatcaaccttcactgatccttgctgttacccaaaggctgaagaaacaggcccaccctccacgtgccagctctggtctctgagtggtggctgt

SEQ ID NO: 4734 - DNA, 201 bp, Homo sapiens
gggccccggtgtcagaaacccggagccaaggggtgtgagggcagaagtggagatggggcctgcgatgctggctgcagtggcccgggaggaaactgggatgraggggactgctctctgggagtcccagacccctggaagggctgcccctcccactctcggtgctggcttctcttccgggacgggcagtgccacccacagtgt

SEQ ID NO: 4735 - DNA, 201 bp, Homo sapiens
aacccggagccaaggggtgtgagggcagaagtggagatggggcctgcgatgctggctgcagtggcccgggaggaaactgggatggaggggactgctctctrggagtcccagacccctggaagggctgcccctcccactctcggtgctggcttctcttccgggacgggcagtgccacccacagtgtgactctgaagagtgtc

SEQ ID NO: 4736 - DNA, 201 bp, Homo sapiens
  misc_feature (1)...(201): n = A,T,C or G, or insertion/deletion polymorphism (see Tables 1-2)
gcttcccgctcccctagggctccccagctctccctctccattgacacccagcttcttgtgcacttgcctccctggcttcactggcgagagatgccaggccnagcttgaagacccttgtcctccctccttctgttccaaaaggggccgctgccacatccaggcctcgggccgcccacagtgctcctgcatgcctggatggac

SEQ ID NO: 4737 - DNA, 201 bp, Homo sapiens
gggaaggagcggtggaagtagcccagctactgctggggctgggggcagcccgagagctgcgggaccaggctgggctagcgccggcggacgtcgctcaccarcgtaaccactgggatctgctgacgctgctggaaggggctgggccaccagaggcccgtcacaaagccacgccgggccgcgaggctgggcccttcccgcgcg

SEQ ID NO: 4738 - DNA, 201 bp, Homo sapiens
gtgattgggtggccctgggagcttgcggttctgcctccaacattccgatcccgcctccttgccttactccgtccccggagcggggatcacctcaacttgaytgtggtcccccagccctccaagaaatgcccataaaccaaggaggagagggtaaaaaatagaagaatacatggaattggggagaagaatgggaaaaaagat

SEQ ID NO: 4739 - DNA, 201 bp, Homo sapiens
gggctgggccaccagaggcccgtcacaaagccacgccgggccgcgaggctgggcccttcccgcgcgcacggacggtgtcagtaagcgtgcccccgcatggrggcggggctctgccgcgctgccggacgctgtcagccggagcaggccctcgtgggggcggagcttgtctgcaggctcggacttggtccgtagacttggctg

SEQ ID NO: 4740 - DNA, 201 bp, Homo sapiens
gcagctgccaagccctgcttcccgctcccctagggctccccagctctccctctccattgacacccagcttcttgtgcacttgcctccctggcttcactggygagagatgccaggccaagcttgaagacccttgtcctccctccttctgttccaaaaggggccgctgccacatccaggcctcgggccgcccacagtgctcct

SEQ ID NO: 4741 - DNA, 201 bp, Homo sapiens
gccctcctaggggctgttcgaatgggggcacctgccagctgatgccagagaaagactccacctttcacctctgcctctgtcccccaggtttcataggcccrggctgtgaggtgaatccagacaactgtgtcagccaccagtgtcagaatgggggcacttgccaggatgggctggacacctacacctgcctctgcccagaaa

SEQ ID NO: 4742 - DNA, 201 bp, Homo sapiens
attaagcagcggctggagacctccctaattatctcccccagcccccctcttcggttttaattaagtagaacagggaggggagtcattagaacaagaaataygaactgagctgccggtgaacccaggcattccagcggcctgagtccacatcgcttagatccctgattcaggacccaggtgacagacgcccccagccgccaa

SEQ ID NO: 4743 - DNA, 201 bp, Homo sapiens
cctcctaggggctgttcgaatgggggcacctgccagctgatgccagagaaagactccacctttcacctctgcctctgtcccccaggtttcataggcccggrctgtgaggtgaatccagacaactgtgtcagccaccagtgtcagaatgggggcacttgccaggatgggctggacacctacacctgcctctgcccagaaacc

SEQ ID NO: 4744 - DNA, 201 bp, Homo sapiens
cacagtgctcctgcatgcctggatggacaggtgagcagtgccagcttcgggacttctgttcagccaacccatgtgttaatggaggggtgtgtctggccacrtacccccagatccagtgccactgcccaccgggcttcgagggccatgcctgtgaacgtgatgtcaacgagtgcttccaggacccaggaccctgccccaaag

SEQ ID NO: 4745 - DNA, 201 bp, Homo sapiens
tgatgccagagaaagactccacctttcacctctgcctctgtcccccaggtttcataggcccgggctgtgaggtgaatccagacaactgtgtcagccaccartgtcagaatgggggcacttgccaggatgggctggacacctacacctgcctctgcccagaaacctggacaggattctccggcacccgatgtgaggaggata

SEQ ID NO: 4746 - DNA, 201 bp, Homo sapiens
atggcagggacatggtgtacccctatcctggggcccgggctgaagaaaagctaggaggaactcgggaccccacctatcaggagagagcagcccctcaaacrcagcccctgggcaaggagaccgactccctcagtgctgggtttgtggtggtcatgggtgtggatttgtcccgctgtggccctgaccacccggcatcccgct

SEQ ID NO: 4747 - DNA, 201 bp, Homo sapiens
cagcaggccgaggaggaagaagaggggcagtgggagcagaggaggtggctcctgccccagtgagagctctgagggtccctgcctgaagagggacagggacyggggcttggagaaggggctgtggaatgcagcccccttcactgctgctgctgctgctgctgctgctgctgctatgtgtctcagtggtcagacccagagggc

SEQ ID NO: 4748 - DNA, 201 bp, Homo sapiens
gtctcccaggctacgatggacagaactgctcaaaggaactcgatgcttgtcagtcccaaccctgtcacaaccatggaacctgtactcccaaacctggaggmttccactgtgcctgccctccaggctttgtggggctacgctgtgagggagacgtggacgagtgtctggaccagccctgccaccccacaggcactgcagcct

SEQ ID NO: 4749 - DNA, 201 bp, Homo sapiens; identical to SEQ ID NO: 4722

SEQ ID NO: 4750 - DNA, 201 bp, Homo sapiens; identical to SEQ ID NO: 4724

SEQ ID NO: 4751 - DNA, 201 bp, Homo sapiens; identical to SEQ ID NO: 4725

SEQ ID NO: 4752 - DNA, 201 bp, Homo sapiens; identical to SEQ ID NO: 4726

SEQ ID NO: 4753 - DNA, 201 bp, Homo sapiens; identical to SEQ ID NO: 4727

SEQ ID NO: 4754 - DNA, 201 bp, Homo sapiens; identical to SEQ ID NO: 4728

SEQ ID NO: 4755 - DNA, 123 bp, Homo sapiens; identical to SEQ ID NO: 4729

SEQ ID NO: 4756 - DNA, 201 bp, Homo sapiens; identical to SEQ ID NO: 4732

SEQ ID NO: 4757 - DNA, 201 bp, Homo sapiens; identical to SEQ ID NO: 4731

SEQ ID NO: 4758 - DNA, 201 bp, Homo sapiens; identical to SEQ ID NO: 4734

SEQ ID NO: 4759 - DNA, 201 bp, Homo sapiens; identical to SEQ ID NO: 4735

SEQ ID NO: 4760 - DNA, 201 bp, Homo sapiens
gaatgggggcacttgccaggatgggctggacacctacacctgcctctgcccagaaacctggacaggctgggactgctccgaagatgtggatgagtgtgagrcccagggtccccctcactgcagaaacgggggcacctgccagaactctgctggtagctttcactgcgtgtgtgtgagtggctggggcggcacaagctgtga

SEQ ID NO: 4761 - DNA, 201 bp, Homo sapiens; identical to SEQ ID NO: 4737

SEQ ID NO: 4762 - DNA, 201 bp, Homo sapiens
caccccacaggcactgcagcctgccactctctggccaatgccttctactgccagtgtctgcctggacacacaggccagtggtgtgaggtggagatagaccyctgccacagccaaccctgctttcatggagggacctgtgaggccacagcaggatcacccctgggtttcatctgccactgccccaagggttttgaaggcccc

SEQ ID NO: 4763 - DNA, 201 bp, Homo sapiens
aagggcagctctgtgaggtggagaccaacgagtgtgcctcagctccctgcctgaaccacgcggattgccatgacctgctcaacggcttccagtgcatctgyctgcctggattctccggcacccgatgtgaggaggatatcgatgagtgcagaagctctccctgtgccaatggtgggcagtgccaggaccagcctggagcct

SEQ ID NO: 4764 - DNA, 201 bp, Homo sapiens
ctgcccgccaggcttagaagggcagctctgtgaggtggagaccaacgagtgtgcctcagctccctgcctgaaccacgcggattgccatgacctgctcaacrgcttccagtgcatctgcctgcctggattctccggcacccgatgtgaggaggatatcgatgagtgcagaagctctccctgtgccaatggtgggcagtgcca

SEQ ID NO: 4765 - DNA, 201 bp, Homo sapiens; identical to SEQ ID NO: 4740

SEQ ID NO: 4766 - DNA, 201 bp, Homo sapiens; identical to SEQ ID NO: 4744

SEQ ID NO: 4767 - DNA, 201 bp, Homo sapiens
tggatgagtgtgagacccagggtccccctcactgcagaaacgggggcacctgccagaactctgctggtagctttcactgcgtgtgtgtgagtggctggggsggcacaagctgtgaggagaacctggatgactgtattgctgccacctgtgccccgggatccacctgcattgaccgggtgggctctttctcctgcctctgcc

SEQ ID NO: 4768 - DNA, 201 bp, Homo sapiens
tacttgccaccttccactgcctctgcccgccaggcttagaagggcagctctgtgaggtggagaccaacgagtgtgcctcagctccctgcctgaaccacgcrgattgccatgacctgctcaacggcttccagtgcatctgcctgcctggattctccggcacccgatgtgaggaggatatcgatgagtgcagaagctctccct

SEQ ID NO: 4769 - DNA, 201 bp, Homo sapiens; identical to SEQ ID NO: 4746

SEQ ID NO: 4770 - DNA, 201 bp, Homo sapiens
tgcagacagcccctgtaggaatagggcaacctgccaggacagccctcagggtccccgctgcctctgccccactggctacaccggaggcagctgccagactytgatggacttatgtgcccagaagccctgcccacgcaattcccactgcctccagactgggccctccttccactgcttgtgcctccagggatggaccgggcc

SEQ ID NO: 4771 - DNA, 201 bp, Homo sapiens; identical to SEQ ID NO: 4721

SEQ ID NO: 4772 - DNA, 201 bp, Homo sapiens
ccaggaccagcctggagccttccactgcaagtgtctcccaggctttgaagggccacgctgtcaaacagaggtggatgagtgcctgagtgacccatgtcccsttggagccagctgccttgatcttccaggagccttcttttgcctctgcccctctggtttcacaggccagctctgtgaggttcccctgtgtgctcccaacct

SEQ ID NO: 4773 - DNA, 201 bp, Homo sapiens; identical to SEQ ID NO: 4723

SEQ ID NO: 4774 - DNA, 201 bp, Homo sapiens
cgacagcggcccctcctatttctgccactgcccccctggattccaaggcagcctgtgccaggatcacgtgaacccatgtgagtccaggccttgccagaacrgggccacctgcatggcccagcccagtgggtatctctgccagtgtgccccaggctacgatggacagaactgctcaaaggaactcgatgcttgtcagtccca

SEQ ID NO: 4775 - DNA, 201 bp, Homo sapiens; identical to SEQ ID NO: 4736
  misc_feature (1)...(201): n = A,T,C or G, or insertion/deletion polymorphism (see Tables 1-2)

SEQ ID NO: 4776 - DNA, 201 bp, Homo sapiens
tgtgagggaaagctccgccccagctgtgcagacagcccctgtaggaatagggcaacctgccaggacagccctcagggtccccgctgcctctgccccactgkctacaccggaggcagctgccagactctgatggacttatgtgcccagaagccctgcccacgcaattcccactgcctccagactgggccctccttccactgc

SEQ ID NO: 4777 - DNA, 201 bp, Homo sapiens
gacccacctgtagtgaggagatgacagcttgtcactcagggccatgtctcaatggcggctcctgcaaccctagccctggaggctactactgcacctgccckccaagccacacagggccccagtgccaaaccagcactgactactgtgtgtctgccccgtgcttcaatgggggtacctgtgtgaacaggcctggcaccttct

SEQ ID NO: 4778 - DNA, 201 bp, Homo sapiens
aggctggaaggccttcctggttttaagatggatcccccaaaatgaagggttgtgagtttagtttctctcctaaaatgaatgtatgcccaccagagcagacrtcttccacgtggagaagctgcagctctggaaagagggtttaagatgctaggatgaggcaggcccagtcctcctccagaaaataagacaggccacaggagg

SEQ ID NO: 4779 - DNA, 201 bp, Homo sapiens
gtgattgggtggccctgggagcttgcggttctgcctccaacattccgatcccgcctccttgccttactccgtccccggagcggggatcacctcaacttgaytgtggtcccccagccctccaagaaatgcccataaaccaaggaggagagggtaaaaaatagaagaatacatggtagggaggaattccaaaaatgattaccc

SEQ ID NO: 4780 - DNA, 201 bp, Homo sapiens; identical to SEQ ID NO: 4739

SEQ ID NO: 4781 - DNA, 201 bp, Homo sapiens; identical to SEQ ID NO: 4741

SEQ ID NO: 4782 - DNA, 201 bp, Homo sapiens; identical to SEQ ID NO: 4743

SEQ ID NO: 4783 - DNA, 201 bp, Homo sapiens
tgatgccagagaaagactccacctttcacctctgcctctgtcccccaggtttcataggcccgggctgtgaggtgaatccagacaactgtgtcagccaccartgtcagaatgggggcacttgccaggatgggctggacacctacacctgcctctgcccagaaacctggacaggctgggactgctccgaagatgtggatgagt

SEQ ID NO: 4784 - DNA, 201 bp, Homo sapiens; identical to SEQ ID NO: 4747

SEQ ID NO: 4785 - DNA, 201 bp, Homo sapiens
gtgccccaggctacgatggacagaactgctcaaaggaactcgatgcttgtcagtcccaaccctgtcacaaccatggaacctgtactcccaaacctggaggmttccactgtgcctgccctccaggctttgtggggctacgctgtgagggagacgtggacgagtgtctggaccagccctgccaccccacaggcactgcagcct

SEQ ID NO: 4786 - DNA, 201 bp, Homo sapiens
tgactgggctttggggttgaacttttttttttttaaagaaagaaaaagaaaccctgggatccatctgttttttttgttgttgttgttgtttttgttgttgktggtggtggtggtggtggtggttcttaatttttaatttagtttggggaagtagcttgtttttttttttataaatatgttgatttcttgtctttttttttt

SEQ ID NO: 4787 - DNA, 201 bp, Homo sapiens
ggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtctt

SEQ ID NO: 4788 - DNA, 201 bp, Homo sapiens
gtaacttcagcaaacaggccactgaggtcctaaatgagtatttctactcccacctgagtaacccatatcctagtgaggaggccaaggaggagcttgccaaraagtgtggcatcaccgtgtctcaggtctccaactggtttggcaacaagaggattcgctataagaaaaacatcggaaagttccaagaggaggcaaacatct

SEQ ID NO: 4789 - DNA, 201 bp, Homo sapiens
gggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtct

SEQ ID NO: 4790 - DNA, 201 bp, Homo sapiens
tttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttctt

SEQ ID NO: 4791 - DNA, 201 bp, Homo sapiens
agtttctgctactttagggaattattgactgggctttggggttgaacttttttttttttaaagaaagaaaaagaaaccctgggatccatctgttttttttkttgttgttgttgtttttgttgttgttggtggtggtggtggtggtggttcttaatttttaatttagtttggggaagtagcttgtttttttttttataaata

SEQ ID NO: 4792 - DNA, 201 bp, Homo sapiens
ctgggctttggggttgaacttttttttttttaaagaaagaaaaagaaaccctgggatccatctgttttttttgttgttgttgttgtttttgttgttgttgktggtggtggtggtggtggttcttaatttttaatttagtttggggaagtagcttgtttttttttttataaatatgttgatttcttgtcttttttttttatt

SEQ ID NO: 4793 - DNA, 177 bp, Homo sapiens
ctcttttagagaatgtccggattgctattggactttggagcgtatggctccaaatcaactcattggctaaaacttgmcggaaaatggtggttaggtggccagaatggatttgtggccaggggcatggatgctgctgctgctgctcttcctgctgctgctcttcctgctgcccaccct

SEQ ID NO: 4794 - DNA, 201 bp, Homo sapiens; identical to SEQ ID NO: 4715

SEQ ID NO: 4795 - DNA, 201 bp, Homo sapiens; identical to SEQ ID NO: 4716

SEQ ID NO: 4796 - DNA, 201 bp, Homo sapiens; identical to SEQ ID NO: 4717

SEQ ID NO: 4797 - DNA, 106 bp, Homo sapiens
ctcttytagagaatgtccggattgctattggactttggagcgtatggctccaaatcaactcattggctaaaacttgacggaaaatggtggttaggtggccagaatg

SEQ ID NO: 4798 - DNA, 201 bp, Homo sapiens; identical to SEQ ID NO: 4718

SEQ ID NO: 4799 - DNA, 201 bp, Homo sapiens
ttaggtggccagaatggatttgtggccaggggcatggatgctgctgctgctgctcttcctgctgctgctcttcctgctgcccaccctgtggttctgcagcyccagtgccaagtacttcttcaagatggccttctacaatggctggatcctcttcctggctgtgctcgccatccctgtgtgtgccgtgcgaggacgcaacgt

SEQ ID NO: 4800 - DNA, 201 bp, Homo sapiens; identical to SEQ ID NO: 4720

SEQ ID NO: 4801 - DNA, 201 bp, Homo sapiens; identical to SEQ ID NO: 4715

SEQ ID NO: 4802 - DNA, 201 bp, Homo sapiens; identical to SEQ ID NO: 4716

SEQ ID NO: 4803 - DNA, 201 bp, Homo sapiens; identical to SEQ ID NO: 4717

SEQ ID NO: 4804 - DNA, 201 bp, Homo sapiens
ccctgaagccaaatttccattggaagaaaagatgtacccatattgtatgttgtgagaaggggttgtctcagcttgggcaagtaaggagactgatacgaagraagtaggaaagaaaaggtacagaggtaaaagagcatggaaaaggaaagggtcagggataaggccaaagagatctcttctctttaaaggccagagaaggca

SEQ ID NO: 4805 - DNA, 201 bp, Homo sapiens; identical to SEQ ID NO: 4718

SEQ ID NO: 4806 - DNA, 201 bp, Homo sapiens
tatggtggccagaatggatttgtggccaggggcatggatgctgctgctgctgctcttcctgctgctgctcttcctgctgcccaccctgtggttctgcagcyccagtgccaagtacttcttcaagatggccttctacaatggctggatcctcttcctggctgtgctcgccatccctgtgtgtgccgtgcgaggacgcaacgt

SEQ ID NO: 4807 - DNA, 201 bp, Homo sapiens
ctctgtgctgggggtgctaattacatggcaggaagaatggggcctctaaggggagtgtggggtctgtctctcccttttttccatctttttcctctctcgckttctttcttacacagaaacatacacataccgagaaacctatttctcagacccctttttctcctctgtctttctctctccctctcccacacctcacacaca

SEQ ID NO: 4808 - DNA, 201 bp, Homo sapiens
cgacttgaagaggacgcaggcttccagaggacaaaccccaatacaggagaagcacaagacagagaagggccaatggggtcatcccctccctaacgagactstctgtgctgggggtgctaattacatggcaggaagaatggggcctctaaggggagtgtggggtctgtctctcccttttttccatctttttcctctctcgct

SEQ ID NO: 4809 - DNA, 201 bp, Homo sapiens
gggggctctcacaaggcgacttgaagaggacgcaggcttccagaggacaaaccccaatacaggagaagcacaagacagagaagggccaatggggtcatccsctccctaacgagactctctgtgctgggggtgctaattacatggcaggaagaatggggcctctaaggggagtgtggggtctgtctctcccttttttccatc

SEQ ID NO: 4810 - DNA, 201 bp, Homo sapiens
tgtgaccccctcttcagtgacatccccaacggagggaccagggagtgttcactctgatacctccaactgatcttgcccctcagggtcacaggggtgggggstctcacaaggcgacttgaagaggacgcaggcttccagaggacaaaccccaatacaggagaagcacaagacagagaagggccaatggggtcatcccctccc

SEQ ID NO: 4811 - DNA, 201 bp, Homo sapiens
gttttaaataaagaaatttcttttttccctgggtttagttgagaatttttttcaaaaaacatgagaaaccccagaaaaaaaatgattttctttcacgaagytccaaacaggtttctctcctgttccccagccttgccttcatgatgcaggcccaattgcacccttgcagacaacagtctggcctgaaccctattgatgcaa

SEQ ID NO: 4812 - DNA, 201 bp, Homo sapiens; identical to SEQ ID NO: 4788

SEQ ID NO: 4813 - DNA, 201 bp, Homo sapiens
gaagaatggggcctctaaggggagtgtggggtctgtctctcccttttttccatctttttcctctctcgctttctttcttacacagaaacatacacataccsagaaacctatttctcagacccctttttctcctctgtctttctctctccctctcccacacctcacacacacatactcccacttgcaactattctgtttctc

SEQ ID NO: 4814 - DNA, 201 bp, Homo sapiens
cacaaggcgacttgaagaggacgcaggcttccagaggacaaaccccaatacaggagaagcacaagacagagaagggccaatggggtcatcccctccctaaygagactctctgtgctgggggtgctaattacatggcaggaagaatggggcctctaaggggagtgtggggtctgtctctcccttttttccatctttttcctc

SEQ ID NO: 4815 - DNA, 201 bp, Homo sapiens
acatggcaggaagaatggggcctctaaggggagtgtggggtctgtctctcccttttttccatctttttcctctctcgctttctttcttacacagaaacatrcacataccgagaaacctatttctcagacccctttttctcctctgtctttctctctccctctcccacacctcacacacacatactcccacttgcaactatt

SEQ ID NO: 4816 - DNA, 201 bp, Homo sapiens
aaaacatgagaaaccccagaaaaaaaatgattttctttcacgaagttccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactg

SEQ ID NO: 4817 - DNA, 147 bp, Homo sapiens
agatgggggctggagagagggtgcaggccccacctagggcggaggccacagcagggagaggggcagacagagccaggaccctggaaggaagcaggatggcwgccggaacagcagttggagcctgggtgctggtcctcagtctgtggg

SEQ ID NO: 4818 - DNA, 103 bp, Homo sapiens
ctatgctgtcaagaccgccgtgtcagtcacccaggggggccacagccgcaccagctccccgacacccccttcctctgcaggtggatcccactgtcaccccrgc

SEQ ID NO: 4819 - DNA, 201 bp, Homo sapiens; identical to SEQ ID NO: 4788

SEQ ID NO: 4820 - DNA, 201 bp, Homo sapiens; identical to SEQ ID NO: 4807

SEQ ID NO: 4821 - DNA, 201 bp, Homo sapiens; identical to SEQ ID NO: 4808

SEQ ID NO: 4822 - DNA, 201 bp, Homo sapiens; identical to SEQ ID NO: 4786

SEQ ID NO: 4823 - DNA, 201 bp, Homo sapiens; identical to SEQ ID NO: 4810

SEQ ID NO: 4824 - DNA, 201 bp, Homo sapiens; identical to SEQ ID NO: 4787

SEQ ID NO: 4825 - DNA, 201 bp, Homo sapiens; identical to SEQ ID NO: 4788

SEQ ID NO: 4826 - DNA, 201 bp, Homo sapiens; identical to SEQ ID NO: 4789

SEQ ID NO: 4827 - DNA, 201 bp, Homo sapiens; identical to SEQ ID NO: 4790

SEQ ID NO: 4828 - DNA, 201 bp, Homo sapiens; identical to SEQ ID NO: 4813

SEQ ID NO: 4829 - DNA, 201 bp, Homo sapiens; identical to SEQ ID NO: 4791

SEQ ID NO: 4830 - DNA, 201 bp, Homo sapiens; identical to SEQ ID NO: 4814

SEQ ID NO: 4831 - DNA, 201 bp, Homo sapiens; identical to SEQ ID NO: 4815

SEQ ID NO: 4832 - DNA, 201 bp, Homo sapiens; identical to SEQ ID NO: 4816

SEQ ID NO: 4833 - DNA, 147 bp, Homo sapiens; identical to SEQ ID NO: 4817

SEQ ID NO: 4834 - DNA, 201 bp, Homo sapiens; identical to SEQ ID NO: 4809

SEQ ID NO: 4835 - DNA, 201 bp, Homo sapiens; identical to SEQ ID NO: 4811

SEQ ID NO: 4836 - DNA, 201 bp, Homo sapiens; identical to SEQ ID NO: 4792

SEQ ID NO: 4837 - DNA, 177 bp, Homo sapiens
ctcttttagagaatgtccggattgctattggactttggagcgtatggctccaaatcaactcattggctaaaacttgmcggaaaatggtgagggaaaacactagggtcgcagggttcaaaatggctccaacctcctttggtgacgtagagagcagaacttgggtctgcccctcccttt

SEQ ID NO: 4838 - DNA, 201 bp, Homo sapiens; identical to SEQ ID NO: 4715

SEQ ID NO: 4839 - DNA, 201 bp, Homo sapiens; identical to SEQ ID NO: 4716

SEQ ID NO: 4840 - DNA, 201 bp, Homo sapiens; identical to SEQ ID NO: 4717

SEQ ID NO: 4841 - DNA, 106 bp, Homo sapiens
ctcttytagagaatgtccggattgctattggactttggagcgtatggctccaaatcaactcattggctaaaacttgacggaaaatggtgagggaaaacactagggt

SEQ ID NO: 4842 - DNA, 201 bp, Homo sapiens; identical to SEQ ID NO: 4718

SEQ ID NO: 4843 - DNA, 201 bp, Homo sapiens; identical to SEQ ID NO: 4799

SEQ ID NO: 4844 - DNA, 201 bp, Homo sapiens; identical to SEQ ID NO: 4807

SEQ ID NO: 4845 - DNA, 201 bp, Homo sapiens; identical to SEQ ID NO: 4808

SEQ ID NO: 4846 - DNA, 201 bp, Homo sapiens; identical to SEQ ID NO: 4786

SEQ ID NO: 4847 - DNA, 201 bp, Homo sapiens; identical to SEQ ID NO: 4810

SEQ ID NO: 4848 - DNA, 201 bp, Homo sapiens; identical to SEQ ID NO: 4787

SEQ ID NO: 4849 - DNA, 201 bp, Homo sapiens; identical to SEQ ID NO: 4789

SEQ ID NO: 4850 - DNA, 201 bp, Homo sapiens; identical to SEQ ID NO: 4788

SEQ ID NO: 4851 - DNA, 201 bp, Homo sapiens; identical to SEQ ID NO: 4790

SEQ ID NO: 4852 - DNA, 201 bp, Homo sapiens; identical to SEQ ID NO: 4813

SEQ ID NO: 4853 - DNA, 201 bp, Homo sapiens; identical to SEQ ID NO: 4791

SEQ ID NO: 4854 - DNA, 201 bp, Homo sapiens; identical to SEQ ID NO: 4814

SEQ ID NO: 4855 - DNA, 201 bp, Homo sapiens; identical to SEQ ID NO: 4815

SEQ ID NO: 4856 - DNA, 201 bp, Homo sapiens; identical to SEQ ID NO: 4816

SEQ ID NO: 4857 - DNA, 201 bp, Homo sapiens
agatgggggctggagagagggtgcaggccccacctagggcggaggccacagcagggagaggggcagacagagccaggaccctggaaggaagcaggatggcwgccggaacagcagttggagcctgggtgctggtcctcagtctgtggggggcagtagtaggtgctcaaaacatcacagcccggattggcgagccactggtgc

SEQ ID NO: 4858 - DNA, 201 bp, Homo sapiens; identical to SEQ ID NO: 4809

SEQ ID NO: 4859 - DNA, 201 bp, Homo sapiens
gccggacagaagcttggaaggtcctgtctccccagggaggaggcccctgggacagtgtggctcgtgtccttcccaacggctccctcttccttccggctgtsgggatccaggatgaggggattttccggtgccaggcaatgaacaggaatggaaaggagaccaagtccaactaccgagtccgtgtctaccagattcctggga

SEQ ID NO: 4860 - DNA, 201 bp, Homo sapiens; identical to SEQ ID NO: 4811

SEQ ID NO: 4861 - DNA, 201 bp, Homo sapiens; identical to SEQ ID NO: 4792

SEQ ID NO: 4862 - DNA, 201 bp, Homo sapiens
agtctgtggggggcagtagtaggtgctcaaaacatcacagcccggattggcgagccactggtgctgaagtgtaagggggcccccaagaaaccaccccagcrgctggaatggaaactgaacacaggccggacagaagcttggaaggtcctgtctccccagggaggaggcccctgggacagtgtggctcgtgtccttcccaac

SEQ ID NO: 4863 - DNA, 201 bp, Homo sapiens
gctggaatggaaactgaacacaggccggacagaagcttggaaggtcctgtctccccagggaggaggcccctgggacagtgtggctcgtgtccttcccaacrgctccctcttccttccggctgtcgggatccaggatgaggggattttccggtgccaggcaatgaacaggaatggaaaggagaccaagtccaactaccgagt

SEQ ID NO: 4864 - DNA, 201 bp, Homo sapiens
gggcagtagtaggtgctcaaaacatcacagcccggattggcgagccactggtgctgaagtgtaagggggcccccaagaaaccaccccagcggctggaatgraaactgaacacaggccggacagaagcttggaaggtcctgtctccccagggaggaggcccctgggacagtgtggctcgtgtccttcccaacggctccctct

SEQ ID NO: 4865 - DNA, 201 bp, Homo sapiens; identical to SEQ ID NO: 4807

SEQ ID NO: 4866 - DNA, 201 bp, Homo sapiens; identical to SEQ ID NO: 4808

SEQ ID NO: 4867 - DNA, 201 bp, Homo sapiens; identical to SEQ ID NO: 4786

SEQ ID NO: 4868 - DNA, 201 bp, Homo sapiens; identical to SEQ ID NO: 4810

SEQ ID NO: 4869 - DNA, 201 bp, Homo sapiens; identical to SEQ ID NO: 4787

SEQ ID NO: 4870 - DNA, 201 bp, Homo sapiens; identical to SEQ ID NO: 4788

SEQ ID NO: 4871 - DNA, 201 bp, Homo sapiens; identical to SEQ ID NO: 4789

SEQ ID NO: 4872 - DNA, 201 bp, Homo sapiens; identical to SEQ ID NO: 4790

SEQ ID NO: 4873 - DNA, 201 bp, Homo sapiens; identical to SEQ ID NO: 4813

SEQ ID NO: 4874 - DNA, 201 bp, Homo sapiens; identical to SEQ ID NO: 4791

SEQ ID NO: 4875 - DNA, 201 bp, Homo sapiens; identical to SEQ ID NO: 4814

SEQ ID NO: 4876 - DNA, 201 bp, Homo sapiens; identical to SEQ ID NO: 4815

SEQ ID NO: 4877 - DNA, 201 bp, Homo sapiens; identical to SEQ ID NO: 4816

SEQ ID NO: 4878 - DNA, 201 bp, Homo sapiens; identical to SEQ ID NO: 4857

SEQ ID NO: 4879 - DNA, 201 bp, Homo sapiens
ccaagaaaccaccccagcggctggaatggaaactgggaggaggcccctgggacagtgtggctcgtgtccttcccaacggctccctcttccttccggctgtsgggatccaggatgaggggattttccggtgccaggcaatgaacaggaatggaaaggagaccaagtccaactaccgagtccgtgtctaccagattcctggga

SEQ ID NO: 4880 - DNA, 201 bp, Homo sapiens; identical to SEQ ID NO: 4809

SEQ ID NO: 4881 - DNA, 201 bp, Homo sapiens; identical to SEQ ID NO: 4811

SEQ ID NO: 4882 - DNA, 201 bp, Homo sapiens; identical to SEQ ID NO: 4792

SEQ ID NO: 4883 - DNA, 201 bp, Homo sapiens
agtctgtggggggcagtagtaggtgctcaaaacatcacagcccggattggcgagccactggtgctgaagtgtaagggggcccccaagaaaccaccccagcrgctggaatggaaactgggaggaggcccctgggacagtgtggctcgtgtccttcccaacggctccctcttccttccggctgtcgggatccaggatgagggg

SEQ ID NO: 4884 - DNA, 201 bp, Homo sapiens
ggtgctgaagtgtaagggggcccccaagaaaccaccccagcggctggaatggaaactgggaggaggcccctgggacagtgtggctcgtgtccttcccaacrgctccctcttccttccggctgtcgggatccaggatgaggggattttccggtgccaggcaatgaacaggaatggaaaggagaccaagtccaactaccgagt

SEQ ID NO: 4885 - DNA, 201 bp, Homo sapiens
gggcagtagtaggtgctcaaaacatcacagcccggattggcgagccactggtgctgaagtgtaagggggcccccaagaaaccaccccagcggctggaatgraaactgggaggaggcccctgggacagtgtggctcgtgtccttcccaacggctccctcttccttccggctgtcgggatccaggatgaggggattttccggt

SEQ ID NO: 4886 - DNA, 201 bp, Homo sapiens; identical to SEQ ID NO: 4859

SEQ ID NO: 4887 - DNA, 201 bp, Homo sapiens; identical to SEQ ID NO: 4863

SEQ ID NO: 4888 - DNA, 201 bp, Homo sapiens; identical to SEQ ID NO: 4811

SEQ ID NO: 4889 - DNA, 201 bp, Homo sapiens; identical to SEQ ID NO: 4864

SEQ ID NO: 4890 - DNA, 201 bp, Homo sapiens; identical to SEQ ID NO: 4816

SEQ ID NO: 4891 - DNA, 201 bp, Homo sapiens; identical to SEQ ID NO: 4857

SEQ ID NO: 4892 - DNA, 201 bp, Homo sapiens; identical to SEQ ID NO: 4862

SEQ ID NO: 4893 - DNA, 201 bp, Homo sapiens; identical to SEQ ID NO: 4807

SEQ ID NO: 4894 - DNA, 201 bp, Homo sapiens; identical to SEQ ID NO: 4808

SEQ ID NO: 4895 - DNA, 201 bp, Homo sapiens; identical to SEQ ID NO: 4786

SEQ ID NO: 4896 - DNA, 201 bp, Homo sapiens; identical to SEQ ID NO: 4810

SEQ ID NO: 4897 - DNA, 201 bp, Homo sapiens; identical to SEQ ID NO: 4787

SEQ ID NO: 4898 - DNA, 201 bp, Homo sapiens; identical to SEQ ID NO: 4789

SEQ ID NO: 4899 - DNA, 201 bp, Homo sapiens; identical to SEQ ID NO: 4788

SEQ ID NO: 4900 - DNA, 201 bp, Homo sapiens; identical to SEQ ID NO: 4790

SEQ ID NO: 4901 - DNA, 201 bp, Homo sapiens; identical to SEQ ID NO: 4813

SEQ ID NO: 4902 - DNA, 201 bp, Homo sapiens; identical to SEQ ID NO: 4791

SEQ ID NO: 4903 - DNA, 201 bp, Homo sapiens; identical to SEQ ID NO: 4814

SEQ ID NO: 4904 - DNA, 201 bp, Homo sapiens; identical to SEQ ID NO: 4815

SEQ ID NO: 4905 - DNA, 201 bp, Homo sapiens; identical to SEQ ID NO: 4816

SEQ ID NO: 4906 - DNA, 201 bp, Homo sapiens; identical to SEQ ID NO: 4857

SEQ ID NO: 4907 - DNA, 201 bp, Homo sapiens; identical to SEQ ID NO: 4809

SEQ ID NO: 4908 - DNA, 201 bp, Homo sapiens; identical to SEQ ID NO: 4879

SEQ ID NO: 4909 - DNA, 201 bp, Homo sapiens; identical to SEQ ID NO: 4811

SEQ ID NO: 4910 - DNA, 201 bp, Homo sapiens; identical to SEQ ID NO: 4792

SEQ ID NO: 4911 - DNA, 201 bp, Homo sapiens; identical to SEQ ID NO: 4883

SEQ ID NO: 4912 - DNA, 201 bp, Homo sapiens; identical to SEQ ID NO: 4884

SEQ ID NO: 4913 - DNA, 201 bp, Homo sapiens; identical to SEQ ID NO: 4885

SEQ ID NO: 4914 - DNA, 201 bp, Homo sapiens; identical to SEQ ID NO: 4737

SEQ ID NO: 4915 - DNA, 201 bp, Homo sapiens; identical to SEQ ID NO: 4738

SEQ ID NO: 4916 - DNA, 201 bp, Homo sapiens; identical to SEQ ID NO: 4732

SEQ ID NO: 4917 - DNA, 201 bp, Homo sapiens; identical to SEQ ID NO: 4739

SEQ ID NO: 4918 - DNA, 201 bp, Homo sapiens; identical to SEQ ID NO: 4742

SEQ ID NO: 4919 - DNA, 201 bp, Homo sapiens
ccatgaacaacgcggagttctttaatacccgtgagcagcagcccaggccccttgaagagtgcagactcccacctggcctgggcgtctggctccgcagcagracacgaagtttgcattccccaaggggcggccagggggcggaccagggaaaggtagtcctctgcattttgccgtgtgctggtcccacccgcctcgcctggt

SEQ ID NO: 4920 - DNA, 201 bp, Homo sapiens
cctaatgcatcgcctcagccatgaacaacgcggagttctttaatacccgtgagcagcagcccaggccccttgaagagtgcagactcccacctggcctgggmgtctggctccgcagcagaacacgaagtttgcattccccaaggggcggccagggggcggaccagggaaaggtagtcctctgcattttgccgtgtgctggtc

SEQ ID NO: 4921 - DNA, 201 bp, Homo sapiens; identical to SEQ ID NO: 4720

SEQ ID NO: 4922 - DNA, 201 bp, Homo sapiens; identical to SEQ ID NO: 4742

SEQ ID NO: 4923 - DNA, 201 bp, Homo sapiens; identical to SEQ ID NO: 4722

SEQ ID NO: 4924 - DNA, 201 bp, Homo sapiens; identical to SEQ ID NO: 4724

SEQ ID NO: 4925 - DNA, 201 bp, Homo sapiens; identical to SEQ ID NO: 4726

SEQ ID NO: 4926 - DNA, 201 bp, Homo sapiens; identical to SEQ ID NO: 4725

SEQ ID NO: 4927 - DNA, 201 bp, Homo sapiens; identical to SEQ ID NO: 4727

SEQ ID NO: 4928 - DNA, 123 bp, Homo sapiens; identical to SEQ ID NO: 4729

SEQ ID NO: 4929 - DNA, 201 bp, Homo sapiens
gaccggtagcaccccctgccaaccagcttccctggcctgtgctgtgctccccagtggccggggtgattctcctggccctaggggctcttctcgtcctccarctcatccggcgtcgacgccgagagcatggagctctctggctgccccctggtttcactcgacggcctcggactcagtcagctccccaccgacgccggcccc

SEQ ID NO: 4930 - DNA, 201 bp, Homo sapiens; identical to SEQ ID NO: 4732

SEQ ID NO: 4931 - DNA, 201 bp, Homo sapiens; identical to SEQ ID NO: 4731

SEQ ID NO: 4932 - DNA, 201 bp, Homo sapiens; identical to SEQ ID NO: 4734

SEQ ID NO: 4933 - DNA, 201 bp, Homo sapiens; identical to SEQ ID NO: 4735

SEQ ID NO: 4934 - DNA, 201 bp, Homo sapiens; identical to SEQ ID NO: 4760

SEQ ID NO: 4935 - DNA, 201 bp, Homo sapiens; identical to SEQ ID NO: 4737

SEQ ID NO: 4936 - DNA, 201 bp, Homo sapiens
caccccacaggcactgcagcctgccactctctggccaatgccttctactgccagtgtctgcctggacacacaggccagtggtgtgaggtggagatagaccyctgccacagccaaccctgctttcatggagggacctgtgaggccacagcaggatcacccctgggtttcatctgccactgccccaaggcaaggttttgaagg

SEQ ID NO: 4937 - DNA, 201 bp, Homo sapiens; identical to SEQ ID NO: 4763

SEQ ID NO: 4938 - DNA, 201 bp, Homo sapiens; identical to SEQ ID NO: 4764

SEQ ID NO: 4939 - DNA, 201 bp, Homo sapiens; identical to SEQ ID NO: 4740

SEQ ID NO: 4940 - DNA, 201 bp, Homo sapiens; identical to SEQ ID NO: 4742

SEQ ID NO: 4941 - DNA, 201 bp, Homo sapiens; identical to SEQ ID NO: 4744

SEQ ID NO: 4942 - DNA, 201 bp, Homo sapiens; identical to SEQ ID NO: 4768

SEQ ID NO: 4943 - DNA, 201 bp, Homo sapiens; identical to SEQ ID NO: 4767

SEQ ID NO: 4944 - DNA, 201 bp, Homo sapiens; identical to SEQ ID NO: 4746

SEQ ID NO: 4945 - DNA, 201 bp, Homo sapiens; identical to SEQ ID NO: 4770

SEQ ID NO: 4946 - DNA, 201 bp, Homo sapiens; identical to SEQ ID NO: 4721

SEQ ID NO: 4947 - DNA, 201 bp, Homo sapiens; identical to SEQ ID NO: 4772

SEQ ID NO: 4948 - DNA, 201 bp, Homo sapiens; identical to SEQ ID NO: 4723

SEQ ID NO: 4949 - DNA, 201 bp, Homo sapiens; identical to SEQ ID NO: 4774

SEQ ID NO: 4950 - DNA, 201 bp, Homo sapiens; identical to SEQ ID NO: 4736
  misc_feature (1)...(201): n = A,T,C or G, or insertion/deletion polymorphism (see Tables 1-2)

SEQ ID NO: 4951 - DNA, 201 bp, Homo sapiens; identical to SEQ ID NO: 4776

SEQ ID NO: 4952 - DNA, 201 bp, Homo sapiens; identical to SEQ ID NO: 4777

SEQ ID NO: 4953 - DNA, 201 bp, Homo sapiens; identical to SEQ ID NO: 4738

SEQ ID NO: 4954 - DNA, 201 bp, Homo sapiens; identical to SEQ ID NO: 4739

SEQ ID NO: 4955 - DNA, 201 bp, Homo sapiens; identical to SEQ ID NO: 4741

SEQ ID NO: 4956 - DNA, 201 bp, Homo sapiens; identical to SEQ ID NO: 4743

SEQ ID NO: 4957 - DNA, 201 bp, Homo sapiens; identical to SEQ ID NO: 4783

SEQ ID NO: 4958 - DNA, 201 bp, Homo sapiens; identical to SEQ ID NO: 4747

SEQ ID NO: 4959 - DNA, 201 bp, Homo sapiens; identical to SEQ ID NO: 4785

SEQ ID NO: 4960 - DNA, 201 bp, Homo sapiens; identical to SEQ ID NO: 4742

SEQ ID NO: 4961 - DNA, 201 bp, Homo sapiens; identical to SEQ ID NO: 4807

SEQ ID NO: 4962 - DNA, 201 bp, Homo sapiens; identical to SEQ ID NO: 4808

SEQ ID NO: 4963 - DNA, 201 bp, Homo sapiens; identical to SEQ ID NO: 4786

SEQ ID NO: 4964 - DNA, 201 bp, Homo sapiens; identical to SEQ ID NO: 4810

SEQ ID NO: 4965 - DNA, 201 bp, Homo sapiens; identical to SEQ ID NO: 4787

SEQ ID NO: 4966 - DNA, 201 bp, Homo sapiens; identical to SEQ ID NO: 4788

SEQ ID NO: 4967 - DNA, 201 bp, Homo sapiens; identical to SEQ ID NO: 4789

SEQ ID NO: 4968 - DNA, 201 bp, Homo sapiens; identical to SEQ ID NO: 4790

SEQ ID NO: 4969 - DNA, 201 bp, Homo sapiens; identical to SEQ ID NO: 4813

SEQ ID NO: 4970 - DNA, 201 bp, Homo sapiens; identical to SEQ ID NO: 4791

SEQ ID NO: 4971 - DNA, 201 bp, Homo sapiens; identical to SEQ ID NO: 4814

SEQ ID NO: 4972 - DNA, 201 bp, Homo sapiens; identical to SEQ ID NO: 4815

SEQ ID NO: 4973 - DNA, 201 bp, Homo sapiens; identical to SEQ ID NO: 4816

SEQ ID NO: 4974 - DNA, 201 bp, Homo sapiens; identical to SEQ ID NO: 4857

SEQ ID NO: 4975 - DNA, 201 bp, Homo sapiens; identical to SEQ ID NO: 4859

SEQ ID NO: 4976 - DNA, 201 bp, Homo sapiens; identical to SEQ ID NO: 4809

SEQ ID NO: 4977 - DNA, 201 bp, Homo sapiens; identical to SEQ ID NO: 4811

SEQ ID NO: 4978 - DNA, 201 bp, Homo sapiens; identical to SEQ ID NO: 4792

SEQ ID NO: 4979 - DNA, 201 bp, Homo sapiens; identical to SEQ ID NO: 4862

SEQ ID NO: 4980 - DNA, 201 bp, Homo sapiens; identical to SEQ ID NO: 4863

SEQ ID NO: 4981 - DNA, 201 bp, Homo sapiens; identical to SEQ ID NO: 4864

SEQ ID NO: 4982 - DNA, 177 bp, Homo sapiens; identical to SEQ ID NO: 4793

SEQ ID NO: 4983 - DNA, 201 bp, Homo sapiens; identical to SEQ ID NO: 4715

SEQ ID NO: 4984 - DNA, 201 bp, Homo sapiens; identical to SEQ ID NO: 4716

SEQ ID NO: 4985 - DNA, 201 bp, Homo sapiens
ccggcactccatgctcactgttttccgggaaatctccactgatggccggggtggtggtgactatctgaagaagcctgggggcggtgggtgaaccctggctmtttggaatcttcaacttctgaagtgaatgtggatacagcgccactcctgccccctcttggccccatccatggactcttgcctcggtgcagtctccactct

SEQ ID NO: 4986 - DNA, 106 bp, Homo sapiens; identical to SEQ ID NO: 4797

SEQ ID NO: 4987 - DNA, 201 bp, Homo sapiens; identical to SEQ ID NO: 4718

SEQ ID NO: 4988 - DNA, 201 bp, Homo sapiens; identical to SEQ ID NO: 4799

SEQ ID NO: 4989 - DNA, 128 bp, Homo sapiens
tccggtttctgtataaattagggggcaggggtgctgtagaggcttcttatcgatgattgacgccgaggcccaggctgttgtcctcacaggagcctggcacmtagcctctcctccagcagcagcacctg

SEQ ID NO: 4990 - DNA, 201 bp, Homo sapiens; identical to SEQ ID NO: 4720

SEQ ID NO: 4991 - DNA, 201 bp, Homo sapiens; identical to SEQ ID NO: 4722

SEQ ID NO: 4992 - DNA, 201 bp, Homo sapiens; identical to SEQ ID NO: 4724

SEQ ID NO: 4993 - DNA, 201 bp, Homo sapiens; identical to SEQ ID NO: 4725

SEQ ID NO: 4994 - DNA, 201 bp, Homo sapiens; identical to SEQ ID NO: 4726

SEQ ID NO: 4995 - DNA, 201 bp, Homo sapiens; identical to SEQ ID NO: 4727

SEQ ID NO: 4996 - DNA, 201 bp, Homo sapiens; identical to SEQ ID NO: 4728

SEQ ID NO: 4997 - DNA, 123 bp, Homo sapiens; identical to SEQ ID NO: 4729

SEQ ID NO: 4998 - DNA, 201 bp, Homo sapiens; identical to SEQ ID NO: 4732

SEQ ID NO: 4999 - DNA, 201 bp, Homo sapiens; identical to SEQ ID NO: 4731

SEQ ID NO: 5000 - DNA, 201 bp, Homo sapiens; identical to SEQ ID NO: 4734

SEQ ID NO: 5001 - DNA, 201 bp, Homo sapiens; identical to SEQ ID NO: 4735

SEQ ID NO: 5002 - DNA, 201 bp, Homo sapiens; identical to SEQ ID NO: 4760

SEQ ID NO: 5003 - DNA, 201 bp, Homo sapiens; identical to SEQ ID NO: 4737

SEQ ID NO: 5004 - DNA, 201 bp, Homo sapiens; identical to SEQ ID NO: 4762

SEQ ID NO: 5005 - DNA, 201 bp, Homo sapiens; identical to SEQ ID NO: 4763

SEQ ID NO: 5006 - DNA, 201 bp, Homo sapiens; identical to SEQ ID NO: 4764

SEQ ID NO: 5007 - DNA, 201 bp, Homo sapiens; identical to SEQ ID NO: 4740

SEQ ID NO: 5008 - DNA, 201 bp, Homo sapiens; identical to SEQ ID NO: 4742

SEQ ID NO: 5009 - DNA, 201 bp, Homo sapiens; identical to SEQ ID NO: 4744

SEQ ID NO: 5010 - DNA, 201 bp, Homo sapiens; identical to SEQ ID NO: 4767

SEQ ID NO: 5011 - DNA, 201 bp, Homo sapiens; identical to SEQ ID NO: 4768

SEQ ID NO: 5012 - DNA, 201 bp, Homo sapiens; identical to SEQ ID NO: 4746

SEQ ID NO: 5013 - DNA, 201 bp, Homo sapiens; identical to SEQ ID NO: 4770

SEQ ID NO: 5014 - DNA, 201 bp, Homo sapiens; identical to SEQ ID NO: 4721

SEQ ID NO: 5015 - DNA, 201 bp, Homo sapiens; identical to SEQ ID NO: 4772

SEQ ID NO: 5016 - DNA, 201 bp, Homo sapiens; identical to SEQ ID NO: 4723

SEQ ID NO: 5017 - DNA, 201 bp, Homo sapiens; identical to SEQ ID NO: 4774

SEQ ID NO: 5018 - DNA, 201 bp, Homo sapiens; identical to SEQ ID NO: 4736
  misc_feature (1)...(201): n = A,T,C or G, or insertion/deletion polymorphism (see Tables 1-2)

SEQ ID NO: 5019 - DNA, 201 bp, Homo sapiens; identical to SEQ ID NO: 4776

SEQ ID NO: 5020 - DNA, 201 bp, Homo sapiens; identical to SEQ ID NO: 4777

SEQ ID NO: 5021 - DNA, 201 bp, Homo sapiens; identical to SEQ ID NO: 4738

SEQ ID NO: 5022 - DNA, 201 bp, Homo sapiens; identical to SEQ ID NO: 4739

SEQ ID NO: 5023 - DNA, 201 bp, Homo sapiens; identical to SEQ ID NO: 4741

SEQ ID NO: 5024 - DNA, 201 bp, Homo sapiens; identical to SEQ ID NO: 4743

SEQ ID NO: 5025 - DNA, 201 bp, Homo sapiens; identical to SEQ ID NO: 4783

SEQ ID NO: 5026 - DNA, 201 bp, Homo sapiens; identical to SEQ ID NO: 4747

SEQ ID NO: 5027 - DNA, 201 bp, Homo sapiens; identical to SEQ ID NO: 4785

SEQ ID NO: 5028 - DNA, 201 bp, Homo sapiens; identical to SEQ ID NO: 4742

SEQ ID NO: 5029 - DNA, 201 bp, Homo sapiens; identical to SEQ ID NO: 4722

SEQ ID NO: 5030 - DNA, 201 bp, Homo sapiens; identical to SEQ ID NO: 4724

SEQ ID NO: 5031 - DNA, 201 bp, Homo sapiens; identical to SEQ ID NO: 4726

SEQ ID NO: 5032 - DNA, 201 bp, Homo sapiens; identical to SEQ ID NO: 4725

SEQ ID NO: 5033 - DNA, 201 bp, Homo sapiens; identical to SEQ ID NO: 4727

SEQ ID NO: 5034 - DNA, 123 bp, Homo sapiens; identical to SEQ ID NO: 4729

SEQ ID NO: 5035 - DNA, 201 bp, Homo sapiens; identical to SEQ ID NO: 4728

SEQ ID NO: 5036 - DNA, 201 bp, Homo sapiens; identical to SEQ ID NO: 4732

SEQ ID NO: 5037 - DNA, 201 bp, Homo sapiens; identical to SEQ ID NO: 4731

SEQ ID NO: 5038 - DNA, 201 bp, Homo sapiens; identical to SEQ ID NO: 4734

SEQ ID NO: 5039 - DNA, 201 bp, Homo sapiens; identical to SEQ ID NO: 4735

SEQ ID NO: 5040 - DNA, 201 bp, Homo sapiens; identical to SEQ ID NO: 4760

SEQ ID NO: 5041 - DNA, 201 bp, Homo sapiens; identical to SEQ ID NO: 4737

SEQ ID NO: 5042 - DNA, 201 bp, Homo sapiens; identical to SEQ ID NO: 4936

SEQ ID NO: 5043 - DNA, 201 bp, Homo sapiens; identical to SEQ ID NO: 4763

SEQ ID NO: 5044 - DNA, 201 bp, Homo sapiens; identical to SEQ ID NO: 4764

SEQ ID NO: 5045 - DNA, 201 bp, Homo sapiens; identical to SEQ ID NO: 4740

SEQ ID NO: 5046 - DNA, 201 bp, Homo sapiens; identical to SEQ ID NO: 4742

SEQ ID NO: 5047 - DNA, 201 bp, Homo sapiens; identical to SEQ ID NO: 4744

SEQ ID NO: 5048 - DNA, 201 bp, Homo sapiens; identical to SEQ ID NO: 4768

SEQ ID NO: 5049 - DNA, 201 bp, Homo sapiens; identical to SEQ ID NO: 4767

SEQ ID NO: 5050 - DNA, 201 bp, Homo sapiens; identical to SEQ ID NO: 4746

SEQ ID NO: 5051 - DNA, 201 bp, Homo sapiens; identical to SEQ ID NO: 4770

SEQ ID NO: 5052 - DNA, 201 bp, Homo sapiens; identical to SEQ ID NO: 4721

SEQ ID NO: 5053 - DNA, 201 bp, Homo sapiens; identical to SEQ ID NO: 4772

SEQ ID NO: 5054 - DNA, 201 bp, Homo sapiens; identical to SEQ ID NO: 4723

SEQ ID NO: 5055 - DNA, 201 bp, Homo sapiens; identical to SEQ ID NO: 4774

SEQ ID NO: 5056 - DNA, 201 bp, Homo sapiens; identical to SEQ ID NO: 4736
  misc_feature (1)...(201): n = A,T,C or G, or insertion/deletion polymorphism (see Tables 1-2)

SEQ ID NO: 5057 - DNA, 201 bp, Homo sapiens; identical to SEQ ID NO: 4776

SEQ ID NO: 5058 - DNA, 201 bp, Homo sapiens; identical to SEQ ID NO: 4777

SEQ ID NO: 5059 - DNA, 201 bp, Homo sapiens; identical to SEQ ID NO: 4738

SEQ ID NO: 5060 - DNA, 201 bp, Homo sapiens; identical to SEQ ID NO: 4739

SEQ ID NO: 5061 - DNA, 201 bp, Homo sapiens; identical to SEQ ID NO: 4741

SEQ ID NO: 5062 - DNA, 201 bp, Homo sapiens; identical to SEQ ID NO: 4743

SEQ ID NO: 5063 - DNA, 201 bp, Homo sapiens; identical to SEQ ID NO: 4783

SEQ ID NO: 5064 - DNA, 201 bp, Homo sapiens; identical to SEQ ID NO: 4747

SEQ ID NO: 5065 - DNA, 201 bp, Homo sapiens; identical to SEQ ID NO: 4785

SEQ ID NO: 5066 - DNA, 201 bp, Homo sapiens; identical to SEQ ID NO: 4807

SEQ ID NO: 5067 - DNA, 201 bp, Homo sapiens; identical to SEQ ID NO: 4808

SEQ ID NO: 5068 - DNA, 201 bp, Homo sapiens; identical to SEQ ID NO: 4786

SEQ ID NO: 5069 - DNA, 201 bp, Homo sapiens; identical to SEQ ID NO: 4810

SEQ ID NO: 5070 - DNA, 201 bp, Homo sapiens; identical to SEQ ID NO: 4787

SEQ ID NO: 5071 - DNA, 201 bp, Homo sapiens; identical to SEQ ID NO: 4788

SEQ ID NO: 5072 - DNA, 201 bp, Homo sapiens; identical to SEQ ID NO: 4789

SEQ ID NO: 5073 - DNA, 201 bp, Homo sapiens; identical to SEQ ID NO: 4790

SEQ ID NO: 5074 - DNA, 201 bp, Homo sapiens; identical to SEQ ID NO: 4813

SEQ ID NO: 5075 - DNA, 201 bp, Homo sapiens; identical to SEQ ID NO: 4791

SEQ ID NO: 5076 - DNA, 201 bp, Homo sapiens; identical to SEQ ID NO: 4814

SEQ ID NO: 5077 - DNA, 201 bp, Homo sapiens; identical to SEQ ID NO: 4815

SEQ ID NO: 5078 - DNA, 201 bp, Homo sapiens; identical to SEQ ID NO: 4816

SEQ ID NO: 5079 - DNA, 201 bp, Homo sapiens; identical to SEQ ID NO: 4857

SEQ ID NO: 5080 - DNA, 201 bp, Homo sapiens
gccggacagaagcttggaaggtcctgtctccccagggaggaggcccctgggacagtgtggctcgtgtccttcccaacggctccctcttccttccggctgtsgggatccaggatgaggggattttccggtgccaggcaatgaacaggaatggaaaggagaccaagtccaactaccgaagtttgagaaccttcacaattacag

SEQ ID NO: 5081 - DNA, 201 bp, Homo sapiens; identical to SEQ ID NO: 4809

SEQ ID NO: 5082 - DNA, 201 bp, Homo sapiens; identical to SEQ ID NO: 4811

SEQ ID NO: 5083 - DNA, 201 bp, Homo sapiens; identical to SEQ ID NO: 4792

SEQ ID NO: 5084 - DNA, 201 bp, Homo sapiens; identical to SEQ ID NO: 4862

SEQ ID NO: 5085 - DNA, 201 bp, Homo sapiens
gctggaatggaaactgaacacaggccggacagaagcttggaaggtcctgtctccccagggaggaggcccctgggacagtgtggctcgtgtccttcccaacrgctccctcttccttccggctgtcgggatccaggatgaggggattttccggtgccaggcaatgaacaggaatggaaaggagaccaagtccaactaccgaag

SEQ ID NO: 5086 - DNA, 201 bp, Homo sapiens; identical to SEQ ID NO: 4864

SEQ ID NO: 5087 - DNA, 201 bp, Homo sapiens; identical to SEQ ID NO: 4720

SEQ ID NO: 5088 - DNA, 201 bp, Homo sapiens; identical to SEQ ID NO: 4807

SEQ ID NO: 5089 - DNA, 201 bp, Homo sapiens; identical to SEQ ID NO: 4808

SEQ ID NO: 5090 - DNA, 201 bp, Homo sapiens; identical to SEQ ID NO: 4786

SEQ ID NO: 5091 - DNA, 201 bp, Homo sapiens; identical to SEQ ID NO: 4810

SEQ ID NO: 5092 - DNA, 201 bp, Homo sapiens; identical to SEQ ID NO: 4787

SEQ ID NO: 5093 - DNA, 201 bp, Homo sapiens; identical to SEQ ID NO: 4788

SEQ ID NO: 5094 - DNA, 201 bp, Homo sapiens; identical to SEQ ID NO: 4789

SEQ ID NO: 5095 - DNA, 201 bp, Homo sapiens; identical to SEQ ID NO: 4790

SEQ ID NO: 5096 - DNA, 201 bp, Homo sapiens; identical to SEQ ID NO: 4813

SEQ ID NO: 5097 - DNA, 201 bp, Homo sapiens; identical to SEQ ID NO: 4791

SEQ ID NO: 5098 - DNA, 201 bp, Homo sapiens; identical to SEQ ID NO: 4814

SEQ ID NO: 5099 - DNA, 201 bp, Homo sapiens; identical to SEQ ID NO: 4815

SEQ ID NO: 5100 - DNA, 201 bp, Homo sapiens; identical to SEQ ID NO: 4816

SEQ ID NO: 5101 - DNA, 201 bp, Homo sapiens; identical to SEQ ID NO: 4857

SEQ ID NO: 5102 - DNA, 201 bp, Homo sapiens; identical to SEQ ID NO: 4859

SEQ ID NO: 5103 - DNA, 201 bp, Homo sapiens; identical to SEQ ID NO: 4809

SEQ ID NO: 5104 - DNA, 201 bp, Homo sapiens; identical to SEQ ID NO: 4811

SEQ ID NO: 5105 - DNA, 201 bp, Homo sapiens; identical to SEQ ID NO: 4792

SEQ ID NO: 5106 - DNA, 201 bp, Homo sapiens; identical to SEQ ID NO: 4862

SEQ ID NO: 5107 - DNA, 201 bp, Homo sapiens; identical to SEQ ID NO: 4863

SEQ ID NO: 5108 - DNA, 201 bp, Homo sapiens; identical to SEQ ID NO: 4864

SEQ ID NO: 5109 - DNA, 201 bp, Homo sapiens; identical to SEQ ID NO: 4720

SEQ ID NO: 5110 - DNA, 201 bp, Homo sapiens
acaaggacagggacgggcagccccaggtggtgcgtgtcaggggcgaggagagcgaggtcaccgtggggggcctggagcccgggcgcaaatacaagatgcayctgtacggcctccacgaggggcagcgcgtgggcccagtgtccaccgtgggcatcacggcgcccctgcccacaccactgccggtggagccccgcctggggg

SEQ ID NO: 5111 - DNA, 193 bp, Homo sapiens
  misc_feature (1)...(193): n = A,T,C or G, or insertion/deletion polymorphism (see Tables 1-2)
gtgagagacatcacctccgactccctcagcctctcctggacagtccccgagggccagtttgaccatttcttggtccagtttaagaatggggangggcagcccaaggcggtgcgggtgccgggacacgaggatggggtcaccatctcgggcctggagccagaccacaagtacaagatgaacctgtacggcttcc

SEQ ID NO: 5112 - DNA, 201 bp, Homo sapiens
tgatcgggaccccaacagcttgctcatctcctgcgctgtctcctaccgaggggcctggtggtacaggaactgccactacgccaacctcaacgggctctacrggagcacagtggaccatcagggagtgagctggtaccactggaagggcttcgagttctcggtgcccttcacggaaatgaagctgagctgctgcccacctct

SEQ ID NO: 5113 - DNA, 201 bp, Homo sapiens
gcagcccaaggtggtgcgggtgccggggcacgaggacggggtcaccatctcaggcctggagccagaccacaagtacaagatgaacctgtacggcttccacrgtggccagcgcgtgggccccatctctgtcattggggtgacagaggaagaaactcccgcccccacagaacccagcacggaggccccggagccccctgagga

SEQ ID NO: 5114 - DNA, 201 bp, Homo sapiens
actgggaggactatgcccatggttttgggaacatctctggagagttctggctgggcaatgaggccctgcacagcctgacacaggcaggtgactactccatscgcgtggacctgcgggctggggacgaggctgtgttcgcccagtacgactccttccacgtagactcggctgcggagtactaccgcctccacttggagggct

SEQ ID NO: 5115 - DNA, 201 bp, Homo sapiens
gcctgtgagcggagacctccgagcggtcgccgtctcggggctggacccggcccgcaagtacaagttcctgctctttggactccagaatgggaaacgccacrgcccagtccctgtggaggccaggaccgccccagacaccaaaccgtctccccgcctgggggagctgactgtgacagatgcgacccctgactccgtgggcct

SEQ ID NO: 5116 - DNA, 201 bp, Homo sapiens
agctgacagtgacaggatcctcccctgactcgctgagcctttcctggaccgtcccccagggccgctttgactccttcaccgtgcagtacaaggacagggaygggcggccccaggcggtgcgtgttgggggccaggagagcaaggtcactgtgaggggcctggagcctgggcgcaagtacaagatgcacctgtacggcctcc

SEQ ID NO: 5117 - DNA, 201 bp, Homo sapiens
ggagggctaccacggcaccgcaggggactccatgagctaccacagcggcagtgtcttctctgcccgtgatcgggaccccaacagcttgctcatctcctgcrctgtctcctaccgaggggcctggtggtacaggaactgccactacgccaacctcaacgggctctacgggagcacagtggaccatcagggagtgagctggta

SEQ ID NO: 5118 - DNA, 201 bp, Homo sapiens
cgtgtgggccccgtgtctgccatcggggtgacagctgcagaggaagagacccccagccccacagaacccagcatggaggccccggagccccctgaggagcygctcctgggggagctaacagtgacaggatcctcccctgactcgctgagcctctcctggaccgtcccccagggccgcttcgactccttcaccgtgcagtac

SEQ ID NO: 5119 - DNA, 201 bp, Homo sapiens
ggttcctgacggtcccacacagttgcgtgcactgaacttgaccgagggattcgccgtgctgcactggaagcccccccagaatcctgtggacacctatgacytccaggtcacagcccctggggccccgcctctgcaggcggagaccccaggcagcgcggtggactaccccctgcatgaccttgtcctccacaccaactacac

SEQ ID NO: 5120 - DNA, 201 bp, Homo sapiens
agaacccagcactgaggccccggaggcccctgaggagccgctcctgggggagttgacagtgacaggatcctcccctgactcgctgagcctctcctggaccrtcccccagggccgcttcgactccttcaccgtgcagtacaaggacagggacgggcagccccaggtggtgcgtgtcaggggcgaggagagcgaggtcaccgt

SEQ ID NO: 5121 - DNA, 201 bp, Homo sapiens
ccagggactgcggggaggagatgcagaacggagccggtgcctccaggaccagcaccatcttcctcaacggcaaccgcgagcggcccctgaacgtgttttgsgacatggagactgatgggggcggctggctggtgttccagcgccgcatggatggacagacagacttctggagggactgggaggactatgcccatggttttg

SEQ ID NO: 5122 - DNA, 201 bp, Homo sapiens
gggcggcgcgtgggcccggtgtccaccgtgggcgtgactgccccacaagaggatgtggacgagacccccagccctacagaaccaggcacagaggccccagrgccccccgaggagcctctcctgggggagctgacagtgacaggatcctcccctgactcgctgagcctttcctggaccgtcccccagggccgctttgactcc

SEQ ID NO: 5123 - DNA, 201 bp, Homo sapiens
  misc_feature (1)...(201): n = A,T,C or G, or insertion/deletion polymorphism (see Tables 1-2)
tggtgcgtgttgggggcgaggagagcgaggtcaccgtggggggcctggagcctgggcgcaaatacaagatgcacctgtacggcctccacgaggggcggcgngtgggcccggtgtccaccgtgggcgtgactgccccacaagaggatgtggacgagacccccagccctacagaaccaggcacagaggccccagagccccccg

SEQ ID NO: 5124 - DNA, 201 bp, Homo sapiens
ttgtctgtcccacaggagatcctgctcccaggagggatcacatctcaccagctccttggcctctttccctccacctcctacaatgcacggctccaggccaygtggggccagagcctcctgccgcccgtgtccacctctttcaccacgggtgggctgcggatccccttccccagggactgcggggaggagatgcagaacgga

SEQ ID NO: 5125 - DNA, 201 bp, Homo sapiens
tgggctgcggatccccttccccagggactgcggggaggagatgcagaacggagccggtgcctccaggaccagcaccatcttcctcaacggcaaccgcgagyggcccctgaacgtgttttgcgacatggagactgatgggggcggctggctggtgttccagcgccgcatggatggacagacagacttctggagggactggga

SEQ ID NO: 5126 - DNA, 201 bp, Homo sapiens
agttgacagtgacaggatcctcccctgactcgctgagcctctcctggaccgtcccccagggccgcttcgactccttcaccgtgcagtacaaggacagggaygggcagccccaggtggtgcgtgtcaggggcgaggagagcgaggtcaccgtggggggcctggagcccgggcgcaaatacaagatgcatctgtacggcctcc

SEQ ID NO: 5127 - DNA, 201 bp, Homo sapiens
ctgtacggcttccacggtggccagcgcgtgggccccatctctgtcattggggtgacggaggaagagacccccagccccacggaactcagcactgaggcccsggagccccctgaggagccgctcctgggggagctgacagtgacaggatcctcccctgactcgctgagcctctcctggaccatcccccagggccacttcgac

SEQ ID NO: 5128 - DNA, 132 bp, Homo sapiens
gaagagccagggtccttcaccacccagccgctggaggaagccttctctgccagcgatctcgcagcactgtgtttacaggggggaggggaggggttcgtacrggagcaataaaggagaaactgaggtacccgg

SEQ ID NO: 5129 - DNA, 201 bp, Homo sapiens
cctgtacggcctccacgaggggcggcgtgtgggcccggtgtccaccgtgggtgtgacagtgcccaccacaacccctgagccccccaacaagcctcgcctcrgggagctgaccgtgacagatgccacccctgactccctcagcctgtcctggatggtccccgagggccagtttgaccacttcctggtccagtacaggaatgg

SEQ ID NO: 5130 - DNA, 201 bp, Homo sapiens
  misc_feature (1)...(201): n = A,T,C or G, or insertion/deletion polymorphism (see Tables 1-2)
ctgccatcggggtgacagctgcagaggaagagacccccagccccacagaacccagcatggaggccccggagccccctgaggagccgctcctgggggagctnacagtgacaggatcctcccctgactcgctgagcctctcctggaccgtcccccagggccgcttcgactccttcaccgtgcagtacaaggacagggacgggc

SEQ ID NO: 5131 - DNA, 201 bp, Homo sapiens
cgggtgggctgcggatccccttccccagggactgcggggaggagatgcagaacggagccggtgcctccaggaccagcaccatcttcctcaacggcaaccgsgagcggcccctgaacgtgttttgcgacatggagactgatgggggcggctggctggtgttccagcgccgcatggatggacagacagacttctggagggact

SEQ ID NO: 5132 - DNA, 201 bp, Homo sapiens
ggctgcggagtactaccgcctccacttggagggctaccacggcaccgcaggggactccatgagctaccacagcggcagtgtcttctctgcccgtgatcggraccccaacagcttgctcatctcctgcgctgtctcctaccgaggggcctggtggtacaggaactgccactacgccaacctcaacgggctctacgggagcac

SEQ ID NO: 5133 - DNA, 201 bp, Homo sapiens
actgaggccccggaggcccctgaggagccgctcctgggggagttgacagtgacaggatcctcccctgactcgctgagcctctcctggaccgtcccccaggkccgcttcgactccttcaccgtgcagtacaaggacagggacgggcagccccaggtggtgcgtgtcaggggcgaggagagcgaggtcaccgtggggggcctg

SEQ ID NO: 5134 - DNA, 201 bp, Homo sapiens
ccttcgactccttcctgctccgctttggggttccatcaccaagcactctggagccgcatccgcgtccactgctgcagcgcgagctgatggtgccggggacycggcactcggccgtgctccgggacctgcgttccgggactctgtacagcctgacactgtatgggctgcgaggaccccacaaggccgacagcatccagggaa

SEQ ID NO: 5135 - DNA, 180 bp, Homo sapiens
gtgagagacatcacctccgactccctcagcctctcctggacagtccccgagggccagtttgaccatttcttggtccagtwtaagaatggggacgggcagcccaaggcggtgcgggtgccgggacacgaggatggggtcaccatctcgggcctggagccagaccacaagtacaagatgaac

SEQ ID NO: 5136 - DNA, 201 bp, Homo sapiens
cctgactccctcagcctgtcctggatggtccccgagggccagtttgaccacttcctggtccagtacaggaatggggatgggcagcccaaggtggtgcgggkgccggggcacgaggacggggtcaccatctcaggcctggagccagaccacaagtacaagatgaacctgtacggcttccacggtggccagcgcgtgggcccc

SEQ ID NO: 5137 - DNA, 201 bp, Homo sapiens
ccgagggccagtttgaccatttcttggtccagtttaagaatggggacgggcagcccaaggcggtgcgggtgccgggacacgaggatggggtcaccatctcrggcctggagccagaccacaagtacaagatgaacctgtacggcttccacggtggccagcgcgtgggccccgtgtctgctgttggtttaactgccccaggaa

SEQ ID NO: 5138 - DNA, 201 bp, Homo sapiens
ccctgactccctcagcctgtcctggatggtccccgagggccagtttgaccacttcctggtccagtacaggaatggggatgggcagcccaaggtggtgcggktgccggggcacgaggacggggtcaccatctcaggcctggagccagaccacaagtacaagatgaacctgtacggcttccacggtggccagcgcgtgggccc

SEQ ID NO: 5139 - DNA, 201 bp, Homo sapiens
gagcgaggtcaccgtggggggcctggagcctgggcgcaaatacaagatgcacctgtacggcctccacgaggggcggcgcgtgggcccggtgtccaccgtgrgcgtgactgccccacaagaggatgtggacgagacccccagccctacagaaccaggcacagaggccccagagccccccgaggagcctctcctgggggagct

SEQ ID NO: 5140 - DNA, 201 bp, Homo sapiens
  misc_feature (1)...(201): n = A,T,C or G, or insertion/deletion polymorphism (see Tables 1-2)
caggcggtgcgtgttgggggccaggagagcaaggtcactgtgaggggcctggagcctgggcgcaagtacaagatgcacctgtacggcctccacgaggggcngcgcctgggcccggtgtctgccgtgggcgtcacagaggatgaagccgagaccacccaagcagtgcctaccatgacccctgagccccccatcaagcctcgc

SEQ ID NO: 5141 - DNA, 201 bp, Homo sapiens
acttcctggtccagtacaggaatggggatgggcagcccaaggcggtgcgggtgccggggcacgaggacggggtcaccatctcaggcctggagccagaccayaaatacaagatgaacctgtacggcttccacggtggccagcgcgtaggccctgtgtctgccattggggtgacggaggaagagacccccagccccacagaac

SEQ ID NO: 5142 - DNA, 201 bp, Homo sapiens
tgggcgcaaatacaagatgcacctgtacggcctccacgaggggcggcgcgtgggcccggtgtccaccgtgggcgtgactgccccacaagaggatgtggacragacccccagccctacagaaccaggcacagaggccccagagccccccgaggagcctctcctgggggagctgacagtgacaggatcctcccctgactcgct

SEQ ID NO: 5143 - DNA, 201 bp, Homo sapiens
tgcgtgttgggggccaggagagcaaggtcactgtgaggggcctggagcctgggcgcaagtacaagatgcacctgtacggcctccacgaggggcggcgcctrggcccggtgtctgccgtgggcgtcacagaggatgaagccgagaccacccaagcagtgcctaccatgacccctgagccccccatcaagcctcgcctggggg

SEQ ID NO: 5144 - DNA, 201 bp, Homo sapiens
tgcccaccacaacccctgagccccccaacaagcctcgcctcggggagctgaccgtgacagatgccacccctgactccctcagcctgtcctggatggtcccygagggccagtttgaccacttcctggtccagtacaggaatggggatgggcagcccaaggtggtgcgggtgccggggcacgaggacggggtcaccatctcag

SEQ ID NO: 5145 - DNA, 201 bp, Homo sapiens
gcggtgcgggtgccggggcacgaggacggggtcaccatctcaggcctggagccagaccataaatacaagatgaacctgtacggcttccacggtggccagcrcgtgggccccatctctgtcattggggtgacggaggaagagacccccagccccacggaactcagcactgaggccccggagccccctgaggagccgctcctg

SEQ ID NO: 5146 - DNA, 201 bp, Homo sapiens
  misc_feature (1)...(201): n = A,T,C or G, or insertion/deletion polymorphism (see Tables 1-2)
acagggacgggcggccccaggtggtgcgtgttgggggcgaggagagcgaggtcaccgtggggggcctggagcctgggcgcaaatacaagatgcacctgtanggcctccacgaggggcggcgcgtgggcccggtgtccaccgtgggcgtgactgccccacaagaggatgtggacgagacccccagccctacagaaccaggca

SEQ ID NO: 5147 - DNA, 201 bp, Homo sapiens
gccaaggaagtgaccccccgcaccgccctgctcacttggactgagcccccagtccggcccgcaggctacctgctcagcttccacacccctggtggacagakccaggtgccccggccccactgacccaactcccctccctgggtgattccaggaggtgctgcctctggccctcccggagggtctccacctccctctcccctg

SEQ ID NO: 5148 - DNA, 201 bp, Homo sapiens
gtgcagtacaaggacagggacgggcggccccaggtggtgcgtgtcaggggcgaggagagcgaggtcaccgtggggggcctggagcccgggtgcaaatacargatgcacctgtacggcctccacgaggggcagcgcgtgggcccagtgtccgctgtgggtgtgacagctccaaaggatgaagccgagaccacccaagcagtg

SEQ ID NO: 5149 - DNA, 201 bp, Homo sapiens
cgctgagcctctcctggaccgtcccccagggccgcttcgactccttcaccgtgcagtacaaggacagggacgggcggccccaggtggtgcgtgttgggggygaggagagcgaggtcaccgtggggggcctggagcctgggcgcaaatacaagatgcacctgtacggcctccacgaggggcggcgcgtgggcccggtgtcca

SEQ ID NO: 5150 - DNA, 201 bp, Homo sapiens
  misc_feature (1)...(201): n = A,T,C or G, or insertion/deletion polymorphism (see Tables 1-2)
tactaccgcctccacttggagggctaccacggcaccgcaggggactccatgagctaccacagcggcagtgtcttctctgcccgtgatcgggaccccaacancttgctcatctcctgcgctgtctcctaccgaggggcctggtggtacaggaactgccactacgccaacctcaacgggctctacgggagcacagtggaccat

SEQ ID NO: 5151 - DNA, 201 bp, Homo sapiens
gccgcttcgactccttcaccgtgcagtacaaggacagggacgggcagccccaggtggtgcgtgtcaggggcgaggagagcgaggtcaccgtggggggcctrgagcccgggcgcaaatacaagatgcatctgtacggcctccacgaggggcagcgcgtgggcccagtgtccaccgtgggcatcacggcgcccctgcccacac

SEQ ID NO: 5152 - DNA, 201 bp, Homo sapiens
ctcccctgactcgctgagcctctcctggaccgtcccccagggccgcttcgactccttcaccgtgcagtacaaggacagggacgggcagccccaggtggtgsgtgtcaggggcgaggagagcgaggtcaccgtggggggcctggagcccgggcgcaaatacaagatgcatctgtacggcctccacgaggggcagcgcgtggg

SEQ ID NO: 5153 - DNA, 201 bp, Homo sapiens
cccgactccctcagcctgtcctggatggttcccgagggccagtttgaccacttcctggtccagtacaggaatggggatgggcagcccaaggcggtgcgggkgccggggcacgaggacggggtcaccatctcaggcctggagccagaccataaatacaagatgaacctgtacggcttccacggtggccagcgcgtaggccct

SEQ ID NO: 5154 - DNA, 201 bp, Homo sapiens
ggcggccccaggtggtgcgtgtcaggggcgaggagagcgaggtcaccgtggggggcctggagcccgggtgcaaatacaagatgcacctgtacggcctccaygaggggcagcgcgtgggcccagtgtccgctgtgggtgtgacagctccaaaggatgaagccgagaccacccaagcagtgcctaccatgacccctgagcccc

SEQ ID NO: 5155 - DNA, 201 bp, Homo sapiens
tcgctgagcctctcctggaccgtcccccagggccgcttcgactccttcaccgtgcagtacaaggacagggacgggcagccccaggtggtgcgtgtcagggkcgaggagagcgaggtcaccgtggggggcctggagcccgggcgcaaatacaagatgcatctgtacggcctccacgaggggcagcgcgtgggcccagtgtcc

SEQ ID NO: 5156 - DNA, 201 bp, Homo sapiens; identical to SEQ ID NO: 5110

SEQ ID NO: 5157 - DNA, 201 bp, Homo sapiens
  misc_feature (1)...(201): n = A,T,C or G, or insertion/deletion polymorphism (see Tables 1-2)
agatgacagtgagagacatcacctccgactccctcagcctctcctggacagtccccgagggccagtttgaccatttcttggtccagtttaagaatggggangggcagcccaaggcggtgcgggtgccgggacacgaggatggggtcaccatctcgggcctggagccagaccacaagtacaagatgaacctgtacggcttcc

SEQ ID NO: 5158 - DNA, 201 bp, Homo sapiens
ccacctcggggagttgacagtggaggaggccacgtcacacaccctgcatctctcctggatggtgactgagggagaatttgactccttcgaaatccagtacrcagatagagacgggcaactccaaatggtccgcataggaggtgaccggaatgacatcaccctctctggcctggaatccgaccacagatacctggtgaccct

SEQ ID NO: 5159 - DNA, 201 bp, Homo sapiens; identical to SEQ ID NO: 5112

SEQ ID NO: 5160 - DNA, 201 bp, Homo sapiens; identical to SEQ ID NO: 5113

SEQ ID NO: 5161 - DNA, 201 bp, Homo sapiens; identical to SEQ ID NO: 5114

SEQ ID NO: 5162 - DNA, 201 bp, Homo sapiens
catggggtccctcctgggggcaagccctctgaccccatcatctaccaaggcattatggacaaggatgaggagaagcctgggaagtcctcaggcccaccacrcctgggtgagctgacggtgacagacaggacctccgactccttgctcctgcgctggacggtccccgagggcgagtttgactccttcgtgatccagtacaaa

SEQ ID NO: 5163 - DNA, 201 bp, Homo sapiens; identical to SEQ ID NO: 5115

SEQ ID NO: 5164 - DNA, 201 bp, Homo sapiens
ggcggccccgggcggtgcgtgttgggggcaaggagagtgaggtcaccgtgggaggcctagagcccgggcacaagtacaagatgcacctgtacggcctccaygaggggcagcgcgtgggcccggtgtccgccgtgggcgtgacagccccacaacaagaagagacccctccagccactgagtccccgctggagccacgcctag

SEQ ID NO: 5165 - DNA, 201 bp, Homo sapiens; identical to SEQ ID NO: 5116

SEQ ID NO: 5166 - DNA, 201 bp, Homo sapiens
ggccagcgtgtgggccccgtgtctgccatcggggtgacagaggaagagacccccagccccacagaacccagcatggaggccccggagccccctgaggagcygctcctgggggagctaacagtgacaggatcctcccctgactcgctgagcctctcctggaccgtcccccagggccgcttcgactccttcaccgtgcagtac

SEQ ID NO: 5167 - DNA, 201 bp, Homo sapiens; identical to SEQ ID NO: 5117

SEQ ID NO: 5168 - DNA, 201 bp, Homo sapiens; identical to SEQ ID NO: 5119

SEQ ID NO: 5169 - DNA, 201 bp, Homo sapiens
ctcccaccgcaacccccgagccccccatcaagcctcgcctgggggagctgaccgtgacagatgccacccctgactccctcagcctgtcctggacagttccygagggacagtttgaccacttcctggtccagtacaggaatggagatgggcagcccaaggcagtgagggtgccagggcacgaggaaggggtcaccatctcgg

SEQ ID NO: 5170 - DNA, 201 bp, Homo sapiens
gaccacggccccgacccctccagcgcctgagccccacctcggggagttgacagtggaggaggccacgtcacacaccctgcatctctcctggatggtgactragggagaatttgactccttcgaaatccagtacacagatagagacgggcaactccaaatggtccgcataggaggtgaccggaatgacatcaccctctctgg

SEQ ID NO: 5171 - DNA, 201 bp, Homo sapiens
tgaggagccgctcctgggggagctaacagtgacaggatcctcccctgactcgctgagcctctcctggaccgtcccccagggccgcttcgactccttcaccrtgcagtacaaggacagggacgggcggccccaggtggtgcgtgttgggggcgaggagagtgaagtcaccgtggggggcctggagcctgggcgcaagtacaa

SEQ ID NO: 5172 - DNA, 201 bp, Homo sapiens; identical to SEQ ID NO: 5120

SEQ ID NO: 5173 - DNA, 201 bp, Homo sapiens; identical to SEQ ID NO: 5122

SEQ ID NO: 5174 - DNA, 201 bp, Homo sapiens; identical to SEQ ID NO: 5121

SEQ ID NO: 5175 - DNA, 201 bp, Homo sapiens; identical to SEQ ID NO: 5123
  misc_feature (1)...(201): n = A,T,C or G, or insertion/deletion polymorphism (see Tables 1-2)

SEQ ID NO: 5176 - DNA, 201 bp, Homo sapiens
ggtggacagaaccaggagatcctgctcccaggagggatcacatctcaccagctccttggcctctttccctccacctcctacaatgcacggctccaggccaygtggggccagagcctcctgccgcccgtgtccacctctttcaccacgggtgggctgcggatccccttccccagggactgcggggaggagatgcagaacgga

SEQ ID NO: 5177 - DNA, 201 bp, Homo sapiens; identical to SEQ ID NO: 5125

SEQ ID NO: 5178 - DNA, 201 bp, Homo sapiens; identical to SEQ ID NO: 5126

SEQ ID NO: 5179 - DNA, 201 bp, Homo sapiens; identical to SEQ ID NO: 5127

SEQ ID NO: 5180 - DNA, 201 bp, Homo sapiens; identical to SEQ ID NO: 5129

SEQ ID NO: 5181 - DNA, 132 bp, Homo sapiens; identical to SEQ ID NO: 5128

SEQ ID NO: 5182 - DNA, 201 bp, Homo sapiens
  misc_feature (1)...(201): n = A,T,C or G, or insertion/deletion polymorphism (see Tables 1-2)
ccgtgtctgccatcggggtgacagaggaagagacccccagccccacagaacccagcatggaggccccggagccccctgaggagccgctcctgggggagctnacagtgacaggatcctcccctgactcgctgagcctctcctggaccgtcccccagggccgcttcgactccttcaccgtgcagtacaaggacagggacgggc

SEQ ID NO: 5183 - DNA, 201 bp, Homo sapiens; identical to SEQ ID NO: 5131

SEQ ID NO: 5184 - DNA, 201 bp, Homo sapiens; identical to SEQ ID NO: 5132

SEQ ID NO: 5185 - DNA, 201 bp, Homo sapiens
atccagtacaaagacagggacgggcagccccaggtggtgcccgtggaaggaccccagcgctcggccgtcatcacctccctggatcctggccgcaagtacaratttgtcctgtatgggtttgttggcaagaagaggcatggtccgctggtggctgaagccaagatcttgcctcagagtgacccaagtccagggactccaccc

SEQ ID NO: 5186 - DNA, 201 bp, Homo sapiens
aagtacagattcactctgtttggaattgcgaacaagaagcggtatggccccctcacggccgatggcaccactgctccagagaggaaagaggagcccccccrccctgagttcctggagcagcccctcctgggggaactgacagtgaccggcgtgaccccagactccttgcgtctctcatggacagtggcccagggccccttc

SEQ ID NO: 5187 - DNA, 201 bp, Homo sapiens
ttgggggcaaggagagtgaggtcaccgtgggaggcctagagcccgggcacaagtacaagatgcacctgtacggcctccacgaggggcagcgcgtgggcccrgtgtccgccgtgggcgtgacagccccacaacaagaagagacccctccagccactgagtccccgctggagccacgcctaggagagctgacagtgacagatg

SEQ ID NO: 5188 - DNA, 201 bp, Homo sapiens
cgtgggcccggtgtccgccgtgggcgtgacagccccacaacaagaagagacccctccagccactgagtccccgctggagccacgcctaggagagctgacartgacagatgtgacccccaactctgtgggcctctcctggacagtccccgagggccagtttgactccttcatagtccagtacaaggacaaggacgggcagcc

SEQ ID NO: 5189 - DNA, 201 bp, Homo sapiens; identical to SEQ ID NO: 5133

SEQ ID NO: 5190 - DNA, 201 bp, Homo sapiens; identical to SEQ ID NO: 5134

SEQ ID NO: 5191 - DNA, 201 bp, Homo sapiens
ctgcgcctagggcagatgacagtgagagacatcacctccgactccctcagcctctcctggacagtccccgagggccagtttgaccatttcttggtccagtwtaagaatggggacgggcagcccaaggcggtgcgggtgccgggacacgaggatggggtcaccatctcgggcctggagccagaccacaagtacaagatgaac

SEQ ID NO: 5192 - DNA, 201 bp, Homo sapiens; identical to SEQ ID NO: 5136

SEQ ID NO: 5193 - DNA, 201 bp, Homo sapiens
ccgagggccagtttgaccatttcttggtccagtttaagaatggggacgggcagcccaaggcggtgcgggtgccgggacacgaggatggggtcaccatctcrggcctggagccagaccacaagtacaagatgaacctgtacggcttccacggtggccagcgcgtgggccccgtgtctgctgttggtttaactgcctcgacag

SEQ ID NO: 5194 - DNA, 201 bp, Homo sapiens; identical to SEQ ID NO: 5138

SEQ ID NO: 5195 - DNA, 201 bp, Homo sapiens; identical to SEQ ID NO: 5139

SEQ ID NO: 5196 - DNA, 201 bp, Homo sapiens; identical to SEQ ID NO: 5140
  misc_feature (1)...(201): n = A,T,C or G, or insertion/deletion polymorphism (see Tables 1-2)

SEQ ID NO: 5197 - DNA, 201 bp, Homo sapiens; identical to SEQ ID NO: 5141

SEQ ID NO: 5198 - DNA, 201 bp, Homo sapiens; identical to SEQ ID NO: 5142

SEQ ID NO: 5199 - DNA, 201 bp, Homo sapiens
gcagtgcctgttgcgggggatgagaatgaggttactgtccccggcctggatcccgaccggaagtataagatgaacctctacgggcttcgtggcaggcagcrtgtggggcccgagtctgtggtggccaagactgctcctcaggaggatgtggacgagacccccagccccacagaactgggcacggaggccccggagtccccc

SEQ ID NO: 5200 - DNA, 201 bp, Homo sapiens; identical to SEQ ID NO: 5143

SEQ ID NO: 5201 - DNA, 201 bp, Homo sapiens; identical to SEQ ID NO: 5144

SEQ ID NO: 5202 - DNA, 201 bp, Homo sapiens; identical to SEQ ID NO: 5145

SEQ ID NO: 5203 - DNA, 201 bp, Homo sapiens
acaggatcctcccctgattcgctgagcctcttctggaccgtcccccagggcagcttcgactctttcaccgtgcagtacaaggacagggatgggcggccccrggcggtgcgtgttgggggcaaggagagtgaggtcaccgtgggaggcctagagcccgggcacaagtacaagatgcacctgtacggcctccacgaggggcag

SEQ ID NO: 5204 - DNA, 201 bp, Homo sapiens
aagtcctcaggcccaccacgcctgggtgagctgacggtgacagacaggacctccgactccttgctcctgcgctggacggtccccgagggcgagtttgactmcttcgtgatccagtacaaagacagggacgggcagccccaggtggtgcccgtggaaggaccccagcgctcggccgtcatcacctccctggatcctggccgc

SEQ ID NO: 5205 - DNA, 201 bp, Homo sapiens
tgaacctgtacggcttccacggtggccagcgcatgggccctgtgtctgtcgtcggggtgacagaacccagcatggaggccccggagcccgctgaggagccrctcctgggggagctaacagtgacaggatcctcccctgactcgctgagcctctcctggaccgtcccccagggccgcttcgactccttcaccgtgcagtaca

SEQ ID NO: 5206 - DNA, 201 bp, Homo sapiens; identical to SEQ ID NO: 5146
  misc_feature (1)...(201): n = A,T,C or G, or insertion/deletion polymorphism (see Tables 1-2)

SEQ ID NO: 5207 - DNA, 201 bp, Homo sapiens
gccaaggaagtgaccccccgcaccgccctgctcacttggactgagcccccagtccggcccgcaggctacctgctcagcttccacacccctggtggacagakccaggagatcctgctcccaggagggatcacatctcaccagctccttggcctctttccctccacctcctacaatgcacggctccaggccatgtggggccag

SEQ ID NO: 5208 - DNA, 201 bp, Homo sapiens; identical to SEQ ID NO: 5148

SEQ ID NO: 5209 - DNA, 201 bp, Homo sapiens; identical to SEQ ID NO: 5149

SEQ ID NO: 5210 - DNA, 201 bp, Homo sapiens; identical to SEQ ID NO: 5150
  misc_feature (1)...(201): n = A,T,C or G, or insertion/deletion polymorphism (see Tables 1-2)

SEQ ID NO: 5211 - DNA, 201 bp, Homo sapiens
cagaacctcccaccgcaacccccgagccccccatcaagcctcgcctgggggagctgaccgtgacagatgccacccctgactccctcagcctgtcctggacrgttcccgagggacagtttgaccacttcctggtccagtacaggaatggagatgggcagcccaaggcagtgagggtgccagggcacgaggaaggggtcacca

SEQ ID NO: 5212 - DNA, 201 bp, Homo sapiens; identical to SEQ ID NO: 5151

SEQ ID NO: 5213 - DNA, 201 bp, Homo sapiens
ccctgaagcagacgggacgctgctgactgacctgatgccaggcgtagaatatgtggtgactgtcacagcggagcggggccgggcagtcagctacccagctkctgtcagggccaacacagggtcctcacccttgggcctcttggggactaccgatgagcctcctccctcaggcccctcgacgacgcaaggggcccaggctcc

SEQ ID NO: 5214 - DNA, 201 bp, Homo sapiens; identical to SEQ ID NO: 5152

SEQ ID NO: 5215 - DNA, 201 bp, Homo sapiens
  misc_feature (1)...(201): n = A,T,C or G, or insertion/deletion polymorphism (see Tables 1-2)
tttgtcctgtatgggtttgttggcaagaagaggcatggtccgctggtggctgaagccaagatcttgcctcagagtgacccaagtccagggactccaccccncctgggaaacctgtgggtgacagaccctaccccagattcactgcacctctcctggactgtccctgagggccagtttgacaccttcatggtccagtacagg

SEQ ID NO: 5216 - DNA, 201 bp, Homo sapiens; identical to SEQ ID NO: 5154

SEQ ID NO: 5217 - DNA, 201 bp, Homo sapiens; identical to SEQ ID NO: 5153

SEQ ID NO: 5218 - DNA, 201 bp, Homo sapiens; identical to SEQ ID NO: 5155

SEQ ID NO: 5219 - DNA, 201 bp, Homo sapiens
cagaacccagcatggaggccccggagcccgctgaggagccgctcctgggggagctaacagtgacaggatcctcccctgactcgctgagcctctcctggacygtcccccagggccgcttcgactccttcaccgtgcagtacaaggacagggacgggcggccccaggtggtgcgtgttgggggcgaggagagtgaagtcaccg

SEQ ID NO: 5220 - DNA, 201 bp, Homo sapiens; identical to SEQ ID NO: 5134

SEQ ID NO: 5221 - DNA, 201 bp, Homo sapiens
cagacagcgcgggagctcgcaggagtcacgaggccacagcgacttcattgtctgactgggcctggacctataaacttcccacctcagccttgggccaagcmtggaagataaaaatggagcaccccatggcgcccctcactcagattctcccctgggcttctcccacgcagccccagaagaggacacaccagccccagagtt

SEQ ID NO: 5222 - DNA, 201 bp, Homo sapiens
tgatcgggaccccaacagcttgctcatctcctgcgctgtctcctaccgaggggcctggtggtacaggaactgccactacgccaacctcaacgggctctacrggagcacagtggaccatcagggagtgagctggtaccactggaagggcttcgagttctcggtgcccttcacggaaatgaagctgagaccaagaaactttcg

SEQ ID NO: 5223 - DNA, 201 bp, Homo sapiens; identical to SEQ ID NO: 5114

SEQ ID NO: 5224 - DNA, 201 bp, Homo sapiens
tccatcaaggagtccagagcaggagccaggccaggcgggagggaaaggccctgggaggggctctctaatctcccagccccgactctgccccgtcactgccrctgctcctcattactcgctggggctgctgtcgcctccccgaagggtggccttgtccagatagcggcaaacctccctgccgtggatgagtcaggagcattt

SEQ ID NO: 5225 - DNA, 201 bp, Homo sapiens; identical to SEQ ID NO: 5117

SEQ ID NO: 5226 - DNA, 201 bp, Homo sapiens; identical to SEQ ID NO: 5119

SEQ ID NO: 5227 - DNA, 201 bp, Homo sapiens
  misc_feature (1)...(201): n = A,T,C or G, or insertion/deletion polymorphism (see Tables 1-2)
caggagcattttcttaagaggaacatcactggaaaacaaaatgagcggggacacagaaaccaacagcagtggctgcatttgtggtacaggctcctcttccngagctcgctgatgcccacctcagacaggcctgaccacggcacggctggtgggatttgccagtcacctcaaccagccagttccaccctcagcttctctcag

SEQ ID NO: 5228 - DNA, 201 bp, Homo sapiens; identical to SEQ ID NO: 5121

SEQ ID NO: 5229 - DNA, 201 bp, Homo sapiens; identical to SEQ ID NO: 5125

SEQ ID NO: 5230 - DNA, 201 bp, Homo sapiens; identical to SEQ ID NO: 5176

SEQ ID NO: 5231 - DNA, 201 bp, Homo sapiens; identical to SEQ ID NO: 5207

SEQ ID NO: 5232 - DNA, 134 bp, Homo sapiens
gaagagccagggtccttcaccacccagccgctggaggaagccttctctgccagcgatctcgcagcactgtgtttacaggggggaggggaggggttcgtacrggagcaataaaggagaaactgaggtacccggct

SEQ ID NO: 5233 - DNA, 201 bp, Homo sapiens; identical to SEQ ID NO: 5150
  misc_feature (1)...(201): n = A,T,C or G, or insertion/deletion polymorphism (see Tables 1-2)

SEQ ID NO: 5234 - DNA, 201 bp, Homo sapiens; identical to SEQ ID NO: 5131

SEQ ID NO: 5235 - DNA, 201 bp, Homo sapiens; identical to SEQ ID NO: 5132

SEQ ID NO: 5236 - DNA, 201 bp, Homo sapiens; identical to SEQ ID NO: 5158

SEQ ID NO: 5237 - DNA, 201 bp, Homo sapiens; identical to SEQ ID NO: 5112

SEQ ID NO: 5238 - DNA, 201 bp, Homo sapiens; identical to SEQ ID NO: 5162

SEQ ID NO: 5239 - DNA, 201 bp, Homo sapiens; identical to SEQ ID NO: 5115

SEQ ID NO: 5240 - DNA, 201 bp, Homo sapiens; identical to SEQ ID NO: 5116

SEQ ID NO: 5241 - DNA, 201 bp, Homo sapiens; identical to SEQ ID NO: 5170

SEQ ID NO: 5242 - DNA, 201 bp, Homo sapiens; identical to SEQ ID NO: 5124

SEQ ID NO: 5243 - DNA, 201 bp, Homo sapiens; identical to SEQ ID NO: 5125

SEQ ID NO: 5244 - DNA, 201 bp, Homo sapiens; identical to SEQ ID NO: 5127

SEQ ID NO: 5245 - DNA, 201 bp, Homo sapiens; identical to SEQ ID NO: 5182
  misc_feature (1)...(201): n = A,T,C or G, or insertion/deletion polymorphism (see Tables 1-2)

SEQ ID NO: 5246 - DNA, 201 bp, Homo sapiens; identical to SEQ ID NO: 5131

SEQ ID NO: 5247 - DNA, 201 bp, Homo sapiens
ctactctggcgaggattgcggtgtgaggcagtgcccgaatgactgcagccagcacggcgtgtgccaggacggtgtgtgcatctgttgggaaggctacgtgrgtgaggactgcagcatccgcacctgcccctccaactgccacgggaggggccgctgtgaggaagggcgctgcctgtgcgacccaggctacaccggccctac

SEQ ID NO: 5248 - DNA, 201 bp, Homo sapiens; identical to SEQ ID NO: 5132

SEQ ID NO: 5249 - DNA, 201 bp, Homo sapiens; identical to SEQ ID NO: 5185

SEQ ID NO: 5250 - DNA, 201 bp, Homo sapiens; identical to SEQ ID NO: 5188

SEQ ID NO: 5251 - DNA, 201 bp, Homo sapiens; identical to SEQ ID NO: 5134

SEQ ID NO: 5252 - DNA, 201 bp, Homo sapiens; identical to SEQ ID NO: 5191

SEQ ID NO: 5253 - DNA, 201 bp, Homo sapiens; identical to SEQ ID NO: 5136

SEQ ID NO: 5254 - DNA, 201 bp, Homo sapiens; identical to SEQ ID NO: 5138

SEQ ID NO: 5255 - DNA, 201 bp, Homo sapiens; identical to SEQ ID NO: 5140
  misc_feature (1)...(201): n = A,T,C or G, or insertion/deletion polymorphism (see Tables 1-2)

SEQ ID NO: 5256 - DNA, 201 bp, Homo sapiens; identical to SEQ ID NO: 5142

SEQ ID NO: 5257 - DNA, 201 bp, Homo sapiens
  misc_feature (1)...(201): n = A,T,C or G, or insertion/deletion polymorphism (see Tables 1-2)
aggctacactggtgacgactgtggcatgaggagctgccctcgcggttgcagtcagagggggcgctgtgagaatgggcgctgcgtgtgtaaccccggctacnctggcgaggactgtggggtgaggagctgccctcggggctgcagccagcggggacgctgcaaggacgggcgctgcgtgtgtgaccccggctacactggcga

SEQ ID NO: 5258 - DNA, 201 bp, Homo sapiens; identical to SEQ ID NO: 5143

SEQ ID NO: 5259 - DNA, 201 bp, Homo sapiens; identical to SEQ ID NO: 5144

SEQ ID NO: 5260 - DNA, 201 bp, Homo sapiens; identical to SEQ ID NO: 5145

SEQ ID NO: 5261 - DNA, 201 bp, Homo sapiens
gtgacgcaggctactcaggggaagactgcagcacgcgcagctgccccgggggctgccgaggccgcggccagtgcctagatgggcggtgtgtgtgcgaggayggctactctggcgaggattgcggtgtgaggcagtgcccgaatgactgcagccagcacggcgtgtgccaggacggtgtgtgcatctgttgggaaggctacg

SEQ ID NO: 5262 - DNA, 201 bp, Homo sapiens; identical to SEQ ID NO: 5203

SEQ ID NO: 5263 - DNA, 201 bp, Homo sapiens; identical to SEQ ID NO: 5204

SEQ ID NO: 5264 - DNA, 201 bp, Homo sapiens
gcatgggccctgtgtctgtcgtcggggtgacagctgcagaggaagagacccccagccccacagaacccagcatggaggccccggagcccgctgaggagccrctcctgggggagctaacagtgacaggatcctcccctgactcgctgagcctctcctggaccgtcccccagggccgcttcgactccttcaccgtgcagtaca

SEQ ID NO: 5265 - DNA, 201 bp, Homo sapiens; identical to SEQ ID NO: 5147

SEQ ID NO: 5266 - DNA, 201 bp, Homo sapiens
ccccacagatgctgagatccctccctcttccccaccctcagcctcggggtcctgcccagatgactgcaatgatcagggtcgctgtgtccgtggtcgttgcrtgtgctttcccggctacactggccccagctgtggctggccatcctgtcccggggactgccaaggccgtgggcgctgcgtgcagggcgtgtgtgtgtgccg

SEQ ID NO: 5267 - DNA, 201 bp, Homo sapiens
  misc_feature (1)...(201): n = A,T,C or G, or insertion/deletion polymorphism (see Tables 1-2)
agtggccgctgcatgtgttggccggggtacacaggccgggactgcggcacgcgcgcctgtcctggcgactgtcgcgggcgcgggcgctgcgtggatggccnctgcgtgtgcaacccgggcttcaccggtgaggactgtgggagccgtcgctgtcccggggactgccgtgggcacggcctttgcgaggatggcgtgtgcgtg

SEQ ID NO: 5268 - DNA, 201 bp, Homo sapiens; identical to SEQ ID NO: 5148

SEQ ID NO: 5269 - DNA, 201 bp, Homo sapiens
agcatccgcacctgcccctccaactgccacgggaggggccgctgtgaggaagggcgctgcctgtgcgacccaggctacaccggccctacctgtgccacccrcatgtgcccggctgactgccggggacgtgggcggtgtgtgcaaggagtgtgcctgtgccacgtgggctatggcggtgaggactgcgggcaggaagagcct

SEQ ID NO: 5270 - DNA, 201 bp, Homo sapiens; identical to SEQ ID NO: 5211

SEQ ID NO: 5271 - DNA, 201 bp, Homo sapiens; identical to SEQ ID NO: 5151

SEQ ID NO: 5272 - DNA, 201 bp, Homo sapiens
ccctgaagcagacgggacgctgctgactgacctgatgccaggcgtagaatatgtggtgactgtcacagcggagcggggccgggcagtcagctacccagctkctgtcagggccaacacagaggaaagggaggaggagtccccgcccaggccaagcctgtcccagcccccacggcggccttggggcaacctgacggccgagct

SEQ ID NO: 5273 - DNA, 201 bp, Homo sapiens; identical to SEQ ID NO: 5152

SEQ ID NO: 5274 - DNA, 201 bp, Homo sapiens; identical to SEQ ID NO: 5215
  misc_feature (1)...(201): n = A,T,C or G, or insertion/deletion polymorphism (see Tables 1-2)

SEQ ID NO: 5275 - DNA, 201 bp, Homo sapiens; identical to SEQ ID NO: 5219

SEQ ID NO: 5276 - DNA, 201 bp, Homo sapiens; identical to SEQ ID NO: 5110

SEQ ID NO: 5277 - DNA, 201 bp, Homo sapiens; identical to SEQ ID NO: 5157
  misc_feature (1)...(201): n = A,T,C or G, or insertion/deletion polymorphism (see Tables 1-2)

SEQ ID NO: 5278 - DNA, 201 bp, Homo sapiens; identical to SEQ ID NO: 5113

SEQ ID NO: 5279 - DNA, 201 bp, Homo sapiens; identical to SEQ ID NO: 5114

SEQ ID NO: 5280 - DNA, 201 bp, Homo sapiens; identical to SEQ ID NO: 5164

SEQ ID NO: 5281 - DNA, 201 bp, Homo sapiens; identical to SEQ ID NO: 5117

SEQ ID NO: 5282 - DNA, 201 bp, Homo sapiens; identical to SEQ ID NO: 5166

SEQ ID NO: 5283 - DNA, 201 bp, Homo sapiens; identical to SEQ ID NO: 5169

SEQ ID NO: 5284 - DNA, 201 bp, Homo sapiens; identical to SEQ ID NO: 5119

SEQ ID NO: 5285 - DNA, 201 bp, Homo sapiens; identical to SEQ ID NO: 5171

SEQ ID NO: 5286 - DNA, 201 bp, Homo sapiens; identical to SEQ ID NO: 5120

SEQ ID NO: 5287 - DNA, 201 bp, Homo sapiens; identical to SEQ ID NO: 5121

SEQ ID NO: 5288 - DNA, 201 bp, Homo sapiens; identical to SEQ ID NO: 5122

SEQ ID NO: 5289 - DNA, 201 bp, Homo sapiens; identical to SEQ ID NO: 5123
  misc_feature (1)...(201): n = A,T,C or G, or insertion/deletion polymorphism (see Tables 1-2)

SEQ ID NO: 5290 - DNA, 201 bp, Homo sapiens; identical to SEQ ID NO: 5126

SEQ ID NO: 5291 - DNA, 132 bp, Homo sapiens; identical to SEQ ID NO: 5128

SEQ ID NO: 5292 - DNA, 201 bp, Homo sapiens; identical to SEQ ID NO: 5129

SEQ ID NO: 5293 - DNA, 201 bp, Homo sapiens; identical to SEQ ID NO: 5186

SEQ ID NO: 5294 - DNA, 201 bp, Homo sapiens; identical to SEQ ID NO: 5187

SEQ ID NO: 5295 - DNA, 201 bp, Homo sapiens; identical to SEQ ID NO: 5133

SEQ ID NO: 5296 - DNA, 201 bp, Homo sapiens
gcggaccctctgcagtctccatggtgtgtttgatctgagccgctgcacctgttcctgtgagccaggctggggtgggcccacctgctcagaccccacagatrctgagatccctccctcttccccaccctcagcctcggggtcctgcccagatgactgcaatgatcagggtcgctgtgtccgtggtcgttgcgtgtgctttcc

SEQ ID NO: 5297 - DNA, 201 bp, Homo sapiens; identical to SEQ ID NO: 5193

SEQ ID NO: 5298 - DNA, 201 bp, Homo sapiens; identical to SEQ ID NO: 5139

SEQ ID NO: 5299 - DNA, 201 bp, Homo sapiens; identical to SEQ ID NO: 5141

SEQ ID NO: 5300 - DNA, 201 bp, Homo sapiens; identical to SEQ ID NO: 5199

SEQ ID NO: 5301 - DNA, 201 bp, Homo sapiens; identical to SEQ ID NO: 5146
  misc_feature (1)...(201): n = A,T,C or G, or insertion/deletion polymorphism (see Tables 1-2)

SEQ ID NO: 5302 - DNA, 201 bp, Homo sapiens; identical to SEQ ID NO: 5149

SEQ ID NO: 5303 - DNA, 201 bp, Homo sapiens; identical to SEQ ID NO: 5150
  misc_feature (1)...(201): n = A,T,C or G, or insertion/deletion polymorphism (see Tables 1-2)

SEQ ID NO: 5304 - DNA, 201 bp, Homo sapiens; identical to SEQ ID NO: 5154

SEQ ID NO: 5305 - DNA, 201 bp, Homo sapiens; identical to SEQ ID NO: 5153

SEQ ID NO: 5306 - DNA, 201 bp, Homo sapiens; identical to SEQ ID NO: 5155

SEQ ID NO: 5307 - DNA, 201 bp, Homo sapiens; identical to SEQ ID NO: 5158

SEQ ID NO: 5308 - DNA, 201 bp, Homo sapiens; identical to SEQ ID NO: 5222

SEQ ID NO: 5309 - DNA, 201 bp, Homo sapiens; identical to SEQ ID NO: 5162

SEQ ID NO: 5310 - DNA, 201 bp, Homo sapiens; identical to SEQ ID NO: 5115

SEQ ID NO: 5311 - DNA, 201 bp, Homo sapiens; identical to SEQ ID NO: 5116

SEQ ID NO: 5312 - DNA, 201 bp, Homo sapiens; identical to SEQ ID NO: 5170

SEQ ID NO: 5313 - DNA, 201 bp, Homo sapiens; identical to SEQ ID NO: 5176

SEQ ID NO: 5314 - DNA, 201 bp, Homo sapiens; identical to SEQ ID NO: 5125

SEQ ID NO: 5315 - DNA, 201 bp, Homo sapiens; identical to SEQ ID NO: 5127

SEQ ID NO: 5316 - DNA, 201 bp, Homo sapiens; identical to SEQ ID NO: 5182
  misc_feature (1)...(201): n = A,T,C or G, or insertion/deletion polymorphism (see Tables 1-2)

SEQ ID NO: 5317 - DNA, 201 bp, Homo sapiens; identical to SEQ ID NO: 5131

SEQ ID NO: 5318 - DNA, 201 bp, Homo sapiens; identical to SEQ ID NO: 5247

SEQ ID NO: 5319 - DNA, 201 bp, Homo sapiens; identical to SEQ ID NO: 5132

SEQ ID NO: 5320 - DNA, 201 bp, Homo sapiens; identical to SEQ ID NO: 5185

SEQ ID NO: 5321 - DNA, 201 bp, Homo sapiens; identical to SEQ ID NO: 5188

SEQ ID NO: 5322 - DNA, 201 bp, Homo sapiens; identical to SEQ ID NO: 5134

SEQ ID NO: 5323 - DNA, 201 bp, Homo sapiens; identical to SEQ ID NO: 5191

SEQ ID NO: 5324 - DNA, 201 bp, Homo sapiens; identical to SEQ ID NO: 5136

SEQ ID NO: 5325 - DNA, 201 bp, Homo sapiens; identical to SEQ ID NO: 5138

SEQ ID NO: 5326 - DNA, 201 bp, Homo sapiens; identical to SEQ ID NO: 5140
  misc_feature (1)...(201): n = A,T,C or G, or insertion/deletion polymorphism (see Tables 1-2)

SEQ ID NO: 5327 - DNA, 201 bp, Homo sapiens; identical to SEQ ID NO: 5142

SEQ ID NO: 5328 - DNA, 201 bp, Homo sapiens; identical to SEQ ID NO: 5257
  misc_feature (1)...(201): n = A,T,C or G, or insertion/deletion polymorphism (see Tables 1-2)

SEQ ID NO: 5329 - DNA, 201 bp, Homo sapiens; identical to SEQ ID NO: 5143

SEQ ID NO: 5330 - DNA, 201 bp, Homo sapiens; identical to SEQ ID NO: 5144

SEQ ID NO: 5331 - DNA, 201 bp, Homo sapiens; identical to SEQ ID NO: 5145

SEQ ID NO: 5332 - DNA, 201 bp, Homo sapiens; identical to SEQ ID NO: 5261

SEQ ID NO: 5333 - DNA, 201 bp, Homo sapiens; identical to SEQ ID NO: 5203

SEQ ID NO: 5334 - DNA, 201 bp, Homo sapiens; identical to SEQ ID NO: 5204

SEQ ID NO: 5335 - DNA, 201 bp, Homo sapiens; identical to SEQ ID NO: 5205

SEQ ID NO: 5336 - DNA, 201 bp, Homo sapiens; identical to SEQ ID NO: 5207

SEQ ID NO: 5337 - DNA, 201 bp, Homo sapiens; identical to SEQ ID NO: 5266

SEQ ID NO: 5338 - DNA, 201 bp, Homo sapiens; identical to SEQ ID NO: 5267
  misc_feature (1)...(201): n = A,T,C or G, or insertion/deletion polymorphism (see Tables 1-2)

SEQ ID NO: 5339 - DNA, 201 bp, Homo sapiens; identical to SEQ ID NO: 5148

SEQ ID NO: 5340 - DNA, 201 bp, Homo sapiens; identical to SEQ ID NO: 5269

SEQ ID NO: 5341 - DNA, 201 bp, Homo sapiens; identical to SEQ ID NO: 5211

SEQ ID NO: 5342 - DNA, 201 bp, Homo sapiens; identical to SEQ ID NO: 5151

SEQ ID NO: 5343 - DNA, 201 bp, Homo sapiens; identical to SEQ ID NO: 5272

SEQ ID NO: 5344 - DNA, 201 bp, Homo sapiens; identical to SEQ ID NO: 5152

SEQ ID NO: 5345 - DNA, 201 bp, Homo sapiens; identical to SEQ ID NO: 5215
  misc_feature (1)...(201): n = A,T,C or G, or insertion/deletion polymorphism (see Tables 1-2)

SEQ ID NO: 5346 - DNA, 201 bp, Homo sapiens; identical to SEQ ID NO: 5219

SEQ ID NO: 5347 - DNA, 201 bp, Homo sapiens; identical to SEQ ID NO: 5110

SEQ ID NO: 5348 - DNA, 201 bp, Homo sapiens; identical to SEQ ID NO: 5157
  misc_feature (1)...(201): n = A,T,C or G, or insertion/deletion polymorphism (see Tables 1-2)

SEQ ID NO: 5349 - DNA, 201 bp, Homo sapiens; identical to SEQ ID NO: 5113

SEQ ID NO: 5350 - DNA, 201 bp, Homo sapiens; identical to SEQ ID NO: 5114

SEQ ID NO: 5351 - DNA, 201 bp, Homo sapiens; identical to SEQ ID NO: 5164

SEQ ID NO: 5352 - DNA, 201 bp, Homo sapiens; identical to SEQ ID NO: 5117

SEQ ID NO: 5353 - DNA, 201 bp, Homo sapiens; identical to SEQ ID NO: 5166

SEQ ID NO: 5354 - DNA, 201 bp, Homo sapiens; identical to SEQ ID NO: 5169

SEQ ID NO: 5355 - DNA, 201 bp, Homo sapiens; identical to SEQ ID NO: 5119

SEQ ID NO: 5356 - DNA, 201 bp, Homo sapiens; identical to SEQ ID NO: 5171

SEQ ID NO: 5357 - DNA, 201 bp, Homo sapiens; identical to SEQ ID NO: 5120

SEQ ID NO: 5358 - DNA, 201 bp, Homo sapiens; identical to SEQ ID NO: 5121

SEQ ID NO: 5359 - DNA, 201 bp, Homo sapiens; identical to SEQ ID NO: 5122

SEQ ID NO: 5360 - DNA, 201 bp, Homo sapiens; identical to SEQ ID NO: 5123
  misc_feature (1)...(201): n = A,T,C or G, or insertion/deletion polymorphism (see Tables 1-2)

SEQ ID NO: 5361 - DNA, 201 bp, Homo sapiens; identical to SEQ ID NO: 5126

SEQ ID NO: 5362 - DNA, 134 bp, Homo sapiens; identical to SEQ ID NO: 5232

SEQ ID NO: 5363 - DNA, 201 bp, Homo sapiens; identical to SEQ ID NO: 5129

SEQ ID NO: 5364 - DNA, 201 bp, Homo sapiens; identical to SEQ ID NO: 5186

SEQ ID NO: 5365 - DNA, 201 bp, Homo sapiens; identical to SEQ ID NO: 5187

SEQ ID NO: 5366 - DNA, 201 bp, Homo sapiens; identical to SEQ ID NO: 5133

SEQ ID NO: 5367 - DNA, 201 bp, Homo sapiens; identical to SEQ ID NO: 5296

SEQ ID NO: 5368 - DNA, 201 bp, Homo sapiens; identical to SEQ ID NO: 5193

SEQ ID NO: 5369 - DNA, 201 bp, Homo sapiens; identical to SEQ ID NO: 5139

SEQ ID NO: 5370 - DNA, 201 bp, Homo sapiens; identical to SEQ ID NO: 5141

SEQ ID NO: 5371 - DNA, 201 bp, Homo sapiens; identical to SEQ ID NO: 5199

SEQ ID NO: 5372 - DNA, 201 bp, Homo sapiens; identical to SEQ ID NO: 5146
  misc_feature (1)...(201): n = A,T,C or G, or insertion/deletion polymorphism (see Tables 1-2)

SEQ ID NO: 5373 - DNA, 201 bp, Homo sapiens; identical to SEQ ID NO: 5149

SEQ ID NO: 5374 - DNA, 201 bp, Homo sapiens; identical to SEQ ID NO: 5150
  misc_feature (1)...(201): n = A,T,C or G, or insertion/deletion polymorphism (see Tables 1-2)

SEQ ID NO: 5375 - DNA, 201 bp, Homo sapiens; identical to SEQ ID NO: 5154

SEQ ID NO: 5376 - DNA, 201 bp, Homo sapiens; identical to SEQ ID NO: 5153

SEQ ID NO: 5377 - DNA, 201 bp, Homo sapiens; identical to SEQ ID NO: 5155

SEQ ID NO: 5378 - DNA, 201 bp, Homo sapiens; identical to SEQ ID NO: 5134

SEQ ID NO: 5379 - DNA, 201 bp, Homo sapiens; identical to SEQ ID NO: 5221

SEQ ID NO: 5380 - DNA, 201 bp, Homo sapiens; identical to SEQ ID NO: 5222

SEQ ID NO: 5381 - DNA, 201 bp, Homo sapiens; identical to SEQ ID NO: 5114

SEQ ID NO: 5382 - DNA, 201 bp, Homo sapiens; identical to SEQ ID NO: 5224

SEQ ID NO: 5383 - DNA, 201 bp, Homo sapiens; identical to SEQ ID NO: 5117

SEQ ID NO: 5384 - DNA, 201 bp, Homo sapiens; identical to SEQ ID NO: 5119

SEQ ID NO: 5385 - DNA, 201 bp, Homo sapiens; identical to SEQ ID NO: 5227
  misc_feature (1)...(201): n = A,T,C or G, or insertion/deletion polymorphism (see Tables 1-2)

SEQ ID NO: 5386 - DNA, 201 bp, Homo sapiens; identical to SEQ ID NO: 5121

SEQ ID NO: 5387 - DNA, 201 bp, Homo sapiens; identical to SEQ ID NO: 5125

SEQ ID NO: 5388 - DNA, 201 bp, Homo sapiens; identical to SEQ ID NO: 5176

SEQ ID NO: 5389 - DNA, 201 bp, Homo sapiens; identical to SEQ ID NO: 5207

SEQ ID NO: 5390 - DNA, 134 bp, Homo sapiens; identical to SEQ ID NO: 5232

SEQ ID NO: 5391 - DNA, 201 bp, Homo sapiens; identical to SEQ ID NO: 5150
  misc_feature (1)...(201): n = A,T,C or G, or insertion/deletion polymorphism (see Tables 1-2)

SEQ ID NO: 5392 - DNA, 201 bp, Homo sapiens; identical to SEQ ID NO: 5131

SEQ ID NO: 5393 - DNA, 201 bp, Homo sapiens; identical to SEQ ID NO: 5132

SEQ ID NO: 5394 - DNA, 201 bp, Homo sapiens; identical to SEQ ID NO: 5158

SEQ ID NO: 5395 - DNA, 201 bp, Homo sapiens; identical to SEQ ID NO: 5222

SEQ ID NO: 5396 - DNA, 201 bp, Homo sapiens; identical to SEQ ID NO: 5115

SEQ ID NO: 5397 - DNA, 201 bp, Homo sapiens; identical to SEQ ID NO: 5116

SEQ ID NO: 5398 - DNA, 201 bp, Homo sapiens
catctcggccgtcgccattactgcgcctgagccccacctcggggagttgacagtggaggaggccacgtcacacaccctgcatctctcctggatggtgactragggagaatttgactccttcgaaatccagtacacagatagagacgggcaactccaaatggtccgcataggaggtgaccggaatgacatcaccctctctgg

SEQ ID NO: 5399 - DNA, 201 bp, Homo sapiens; identical to SEQ ID NO: 5176

SEQ ID NO: 5400 - DNA, 201 bp, Homo sapiens; identical to SEQ ID NO: 5125

SEQ ID NO: 5401 - DNA, 201 bp, Homo sapiens; identical to SEQ ID NO: 5127

SEQ ID NO: 5402 - DNA, 201 bp, Homo sapiens
  misc_feature (1)...(201): n = A,T,C or G, or insertion/deletion polymorphism (see Tables 1-2)
cgggacacgaggatggggctgcagaggaagagacccccagccccacagaacccagcatggaggccccggagccccctgaggagccgctcctgggggagctnacagtgacaggatcctcccctgactcgctgagcctctcctggaccgtcccccagggccgcttcgactccttcaccgtgcagtacaaggacagggacgggc

SEQ ID NO: 5403 - DNA, 201 bp, Homo sapiens; identical to SEQ ID NO: 5131

SEQ ID NO: 5404 - DNA, 201 bp, Homo sapiens; identical to SEQ ID NO: 5247

SEQ ID NO: 5405 - DNA, 201 bp, Homo sapiens
gagcggggccgggcagtcagctacccagctgctgtcagggccaacacaggaccccagcgctcggccgtcatcacctccctggatcctggccgcaagtacaratttgtcctgtatgggtttgttggcaagaagaggcatggtccgctggtggctgaagccaagatcttgcctcagagtgacccaagtccagggactccaccc

SEQ ID NO: 5406 - DNA, 201 bp, Homo sapiens; identical to SEQ ID NO: 5132

SEQ ID NO: 5407 - DNA, 201 bp, Homo sapiens; identical to SEQ ID NO: 5134

SEQ ID NO: 5408 - DNA, 201 bp, Homo sapiens
ctgcgcctagggcagatgacagtgagagacatcacctccgactccctcagcctctcctggacagtccccgagggccagtttgaccatttcttggtccagtwtaagaatggggacgggcagcccaaggcggtgcgggtgccgggacacgaggatggggctgcagaggaagagacccccagccccacagaacccagcatggag

SEQ ID NO: 5409 - DNA, 201 bp, Homo sapiens; identical to SEQ ID NO: 5136

SEQ ID NO: 5410 - DNA, 201 bp, Homo sapiens; identical to SEQ ID NO: 5138

SEQ ID NO: 5411 - DNA, 201 bp, Homo sapiens; identical to SEQ ID NO: 5140
  misc_feature (1)...(201): n = A,T,C or G, or insertion/deletion polymorphism (see Tables 1-2)

SEQ ID NO: 5412 - DNA, 201 bp, Homo sapiens; identical to SEQ ID NO: 5257
  misc_feature (1)...(201): n = A,T,C or G, or insertion/deletion polymorphism (see Tables 1-2)

SEQ ID NO: 5413 - DNA, 201 bp, Homo sapiens; identical to SEQ ID NO: 5145

SEQ ID NO: 5414 - DNA, 201 bp, Homo sapiens; identical to SEQ ID NO: 5143

SEQ ID NO: 5415 - DNA, 201 bp, Homo sapiens; identical to SEQ ID NO: 5144

SEQ ID NO: 5416 - DNA, 201 bp, Homo sapiens; identical to SEQ ID NO: 5261

SEQ ID NO: 5417 - DNA, 201 bp, Homo sapiens; identical to SEQ ID NO: 5203

SEQ ID NO: 5418 - DNA, 201 bp, Homo sapiens; identical to SEQ ID NO: 5264

SEQ ID NO: 5419 - DNA, 201 bp, Homo sapiens; identical to SEQ ID NO: 5266

SEQ ID NO: 5420 - DNA, 201 bp, Homo sapiens; identical to SEQ ID NO: 5207

SEQ ID NO: 5421 - DNA, 201 bp, Homo sapiens
cgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtg

SEQ ID NO: 5422 - DNA, 201 bp, Homo sapiens; identical to SEQ ID NO: 5267
  misc_feature (1)...(201): n = A,T,C or G, or insertion/deletion polymorphism (see Tables 1-2)

SEQ ID NO: 5423 - DNA, 201 bp, Homo sapiens; identical to SEQ ID NO: 5148

SEQ ID NO: 5424 - DNA, 201 bp, Homo sapiens; identical to SEQ ID NO: 5269

SEQ ID NO: 5425 - DNA, 201 bp, Homo sapiens; identical to SEQ ID NO: 5211

SEQ ID NO: 5426 - DNA, 201 bp, Homo sapiens; identical to SEQ ID NO: 5151

SEQ ID NO: 5427 - DNA, 201 bp, Homo sapiens
ccctgaagcagacgggacgctgctgactgacctgatgccaggcgtagaatatgtggtgactgtcacagcggagcggggccgggcagtcagctacccagctkctgtcagggccaacacaggaccccagcgctcggccgtcatcacctccctggatcctggccgcaagtacaaatttgtcctgtatgggtttgttggcaagaa

SEQ ID NO: 5428 - DNA, 201 bp, Homo sapiens; identical to SEQ ID NO: 5152

SEQ ID NO: 5429 - DNA, 201 bp, Homo sapiens; identical to SEQ ID NO: 5215
  misc_feature (1)...(201): n = A,T,C or G, or insertion/deletion polymorphism (see Tables 1-2)

SEQ ID NO: 5430 - DNA, 201 bp, Homo sapiens
cagaacccagcatggaggccccggagcccgctgaggagccgctcctgggggagctaacagtgacaggatcctcccctgactcgctgagcctctcctggacygtcccccagggccgcttcgactccttcaccgtgcagtacaaggacagggacgggcggccccaggtggtgcgtgttgggggcgaggagacccccgaagagg

SEQ ID NO: 5431 - DNA, 201 bp, Homo sapiens; identical to SEQ ID NO: 5110

SEQ ID NO: 5432 - DNA, 201 bp, Homo sapiens
  misc_feature (1)...(201): n = A,T,C or G, or insertion/deletion polymorphism (see Tables 1-2)
agatgacagtgagagacatcacctccgactccctcagcctctcctggacagtccccgagggccagtttgaccatttcttggtccagtttaagaatggggangggcagcccaaggcggtgcgggtgccgggacacgaggatggggctgcagaggaagagacccccagccccacagaacccagcatggaggccccggagcccc

SEQ ID NO: 5433 - DNA, 201 bp, Homo sapiens
gcagcccaaggtggtgcgggtgccggggcacgaggacggggtcaccatctcaggcctggagccagaccacaagtacaagatgaacctgtacggcttccacrgtggccagcgcgtgggccccatctctgtcattggggtgacagctgcagaggaagaaactcccgcccccacagaacccagcacggaggccccggagccccc

SEQ ID NO: 5434 - DNA, 201 bp, Homo sapiens; identical to SEQ ID NO: 5114

SEQ ID NO: 5435 - DNA, 201 bp, Homo sapiens
ggcggccccgggcggtgcgtgttgggggcaaggagagtgaggtcaccgtgggaggcctagagcccgggcacaagtacaagatgcacctgtacggcctccaygaggggcagcgcgtgggcccggtgtccgccgtgggcgtgacagaggcctccaagcctcccctggagccacgcctaggggagctgacagtgacggatataa

SEQ ID NO: 5436 - DNA, 201 bp, Homo sapiens
aaggcggtgcgggtgccgggacacgaggatggggctgcagaggaagagacccccagccccacagaacccagcatggaggccccggagccccctgaggagcygctcctgggggagctaacagtgacaggatcctcccctgactcgctgagcctctcctggaccgtcccccagggccgcttcgactccttcaccgtgcagtac

SEQ ID NO: 5437 - DNA, 201 bp, Homo sapiens; identical to SEQ ID NO: 5117

SEQ ID NO: 5438 - DNA, 201 bp, Homo sapiens; identical to SEQ ID NO: 5169

SEQ ID NO: 5439 - DNA, 201 bp, Homo sapiens; identical to SEQ ID NO: 5119

SEQ ID NO: 5440 - DNA, 201 bp, Homo sapiens
tgaggagccgctcctgggggagctaacagtgacaggatcctcccctgactcgctgagcctctcctggaccgtcccccagggccgcttcgactccttcaccrtgcagtacaaggacagggacgggcggccccaggtggtgcgtgttgggggcgaggagacccccgaagaggagtcccctgatgctcctcttgcaaagctgcg

SEQ ID NO: 5441 - DNA, 201 bp, Homo sapiens; identical to SEQ ID NO: 5120

SEQ ID NO: 5442 - DNA, 201 bp, Homo sapiens
gggcgcaaatacaagatgcacctgtacggcctccacgaggggcggcgcgtgggcccggtgtccaccgtgggcgtgactgaaccaggcacagaggccccagrgccccccgaggagcctctcctgggggagctgacagtgacaggatcctcccctgactcgctgagcctttcctggaccgtcccccagggccgctttgactcc

SEQ ID NO: 5443 - DNA, 201 bp, Homo sapiens; identical to SEQ ID NO: 5121

SEQ ID NO: 5444 - DNA, 201 bp, Homo sapiens
  misc_feature (1)...(201): n = A,T,C or G, or insertion/deletion polymorphism (see Tables 1-2)
tggtgcgtgttgggggcgaggagagcgaggtcaccgtggggggcctggagcctgggcgcaaatacaagatgcacctgtacggcctccacgaggggcggcgngtgggcccggtgtccaccgtgggcgtgactgaaccaggcacagaggccccagagccccccgaggagcctctcctgggggagctgacagtgacaggatcct

SEQ ID NO: 5445 - DNA, 201 bp, Homo sapiens; identical to SEQ ID NO: 5126

SEQ ID NO: 5446 - DNA, 134 bp, Homo sapiens; identical to SEQ ID NO: 5232

SEQ ID NO: 5447 - DNA, 201 bp, Homo sapiens
cccggtgtccaccgtgggtgtgacagctccagaggatgaagcagagaccacccaagcagtgcccaccacaacccctgagccccccaacaagcctcgcctcrgggagctgaccgtgacagatgccacccctgactccctcagcctgtcctggatggtccccgagggccagtttgaccacttcctggtccagtacaggaatgg

SEQ ID NO: 5448 - DNA, 201 bp, Homo sapiens; identical to SEQ ID NO: 5186

SEQ ID NO: 5449 - DNA, 201 bp, Homo sapiens
ttgggggcaaggagagtgaggtcaccgtgggaggcctagagcccgggcacaagtacaagatgcacctgtacggcctccacgaggggcagcgcgtgggcccrgtgtccgccgtgggcgtgacagaggcctccaagcctcccctggagccacgcctaggggagctgacagtgacggatataacccctgactctgtgggcctct

SEQ ID NO: 5450 - DNA, 201 bp, Homo sapiens; identical to SEQ ID NO: 5133

SEQ ID NO: 5451 - DNA, 201 bp, Homo sapiens; identical to SEQ ID NO: 5296

SEQ ID NO: 5452 - DNA, 201 bp, Homo sapiens
gagcgaggtcaccgtggggggcctggagcctgggcgcaaatacaagatgcacctgtacggcctccacgaggggcggcgcgtgggcccggtgtccaccgtgrgcgtgactgaaccaggcacagaggccccagagccccccgaggagcctctcctgggggagctgacagtgacaggatcctcccctgactcgctgagcctttc

SEQ ID NO: 5453 - DNA, 201 bp, Homo sapiens; identical to SEQ ID NO: 5141

SEQ ID NO: 5454 - DNA, 201 bp, Homo sapiens
gcagtgcctgttgcgggggatgagaatgaggttactgtccccggcctggatcccgaccggaagtataagatgaacctctacgggcttcgtggcaggcagcrtgtggggcccgagtctgtggtggccaagactggaggatgtggacgagacccccagccccacagaactgggcacggaggccccggagtcccccgaggagcc

SEQ ID NO: 5455 - DNA, 201 bp, Homo sapiens
  misc_feature (1)...(201): n = A,T,C or G, or insertion/deletion polymorphism (see Tables 1-2)
acagggacgggcggccccaggtggtgcgtgttgggggcgaggagagcgaggtcaccgtggggggcctggagcctgggcgcaaatacaagatgcacctgtanggcctccacgaggggcggcgcgtgggcccggtgtccaccgtgggcgtgactgaaccaggcacagaggccccagagccccccgaggagcctctcctggggg

SEQ ID NO: 5456 - DNA, 201 bp, Homo sapiens; identical to SEQ ID NO: 5149

SEQ ID NO: 5457 - DNA, 201 bp, Homo sapiens; identical to SEQ ID NO: 5150
  misc_feature (1)...(201): n = A,T,C or G, or insertion/deletion polymorphism (see Tables 1-2)

SEQ ID NO: 5458 - DNA, 201 bp, Homo sapiens; identical to SEQ ID NO: 5154

SEQ ID NO: 5459 - DNA, 201 bp, Homo sapiens; identical to SEQ ID NO: 5153

SEQ ID NO: 5460 - DNA, 201 bp, Homo sapiens; identical to SEQ ID NO: 5155

SEQ ID NO: 5461 - DNA, 201 bp, Homo sapiens; identical to SEQ ID NO: 5134

SEQ ID NO: 5462 - DNA, 201 bp, Homo sapiens; identical to SEQ ID NO: 5221

SEQ ID NO: 5463 - DNA, 201 bp, Homo sapiens; identical to SEQ ID NO: 5112

SEQ ID NO: 5464 - DNA, 201 bp, Homo sapiens; identical to SEQ ID NO: 5114

SEQ ID NO: 5465 - DNA, 201 bp, Homo sapiens; identical to SEQ ID NO: 5224

SEQ ID NO: 5466 - DNA, 201 bp, Homo sapiens; identical to SEQ ID NO: 5117

SEQ ID NO: 5467 - DNA, 201 bp, Homo sapiens; identical to SEQ ID NO: 5119

SEQ ID NO: 5468 - DNA, 201 bp, Homo sapiens; identical to SEQ ID NO: 5227
  misc_feature (1)...(201): n = A,T,C or G, or insertion/deletion polymorphism (see Tables 1-2)

SEQ ID NO: 5469 - DNA, 201 bp, Homo sapiens; identical to SEQ ID NO: 5121

SEQ ID NO: 5470 - DNA, 201 bp, Homo sapiens; identical to SEQ ID NO: 5124

SEQ ID NO: 5471 - DNA, 201 bp, Homo sapiens; identical to SEQ ID NO: 5125

SEQ ID NO: 5472 - DNA, 201 bp, Homo sapiens; identical to SEQ ID NO: 5147

SEQ ID NO: 5473 - DNA, 201 bp, Homo sapiens; identical to SEQ ID NO: 5150
  misc_feature (1)...(201): n = A,T,C or G, or insertion/deletion polymorphism (see Tables 1-2)

SEQ ID NO: 5474 - DNA, 132 bp, Homo sapiens; identical to SEQ ID NO: 5128

SEQ ID NO: 5475 - DNA, 201 bp, Homo sapiens; identical to SEQ ID NO: 5131

SEQ ID NO: 5476 - DNA, 201 bp, Homo sapiens; identical to SEQ ID NO: 5132

SEQ ID NO: 5477 - DNA, 201 bp, Homo sapiens
cccgccacctttacatcagcagcagcaaccccgacctcatcacgcggcgcgtgcaccactcggtgcaaacgttccaggaggacagcctgcccgtggcgcaytcgctgcaggaggtcagcgagcccctcaccgccgcgcgccacgcgcagctgcacaaacggaacagcatcgaggtggccgggctcagccacggcctggagg

SEQ ID NO: 5478 - DNA, 201 bp, Homo sapiens
acaacactgtcacctatggaaggtttaagatcacgacccggttccgcacagactctggctgctatgccaccacaggcctgaagatgaagcacctccttacygggcaagagaggaccgtctggcacctccaatacacagactggcctgaacatggctgtccagaagacctcaagggatttttatcatatcttgaagagatcc

SEQ ID NO: 5479 - DNA, 201 bp, Homo sapiens
acggccataagaagtccctgtcggacgccaccatgctaatccacagcagcgaggaggaggaggacgaggacttcgaggaggagagcggggcccgggcgccycctgcacgtgcgcgcgagcctcggcccggcctggcccaggacccacctggctgccctcgcgtcctgctcgccgggcccctgcacatcctggagcccaagg

SEQ ID NO: 5480 - DNA, 201 bp, Homo sapiens
atggaaggcatcctgtggtatttaggtggcatgacattgccaacatgtcccacaacaagtccttttttgcattagagctggcaaataaagaggagaccatycaatttcaaactgaagacatggaaacagcaaaatacatttggagactctgtgttgcgcgacacaagttttacagactaaaccagtgtaacctgcaaactc

SEQ ID NO: 5481 - DNA, 201 bp, Homo sapiens
tacagaaccatatgcttcttcccaagataacctctttgtgcccaaccagaacggatactactgtcactctcagacaagcttggatagagcccagattgacytcaacggtcggatccgtaatggcagtgtctacagtgcacacagcaccaactccttaaataatcctcagccctacttgcagccctcgccgatgtcgtccaa

SEQ ID NO: 5482 - DNA, 201 bp, Homo sapiens
  misc_feature (1)...(201): n = A,T,C or G, or insertion/deletion polymorphism (see Tables 1-2)
tcaatgctcccttcctcgggccattggagactccgttgctttttaatggcggcagcggctgctgggtgagcagctggaggccggacagtgttcgtcccatncggagaggatcgctttctcctggcgtcaccagcgctgggttggtgggggtagcttttccctctttgctcctccattcttgaagaaagaagaagatgccac

SEQ ID NO: 5483 - DNA, 201 bp, Homo sapiens
agcccctcaccgccgcgcgccacgcgcagctgcacaaacggaacagcatcgaggtggccgggctcagccacggcctggagggcctgcggctcaaggagcgsaccctatccgcgtcggcggcagaggtggcgccgcgagccgtctcggtgggctcccagcccagcgttttcaccgagaggacacagcgagaagggccggagg

SEQ ID NO: 5484 - DNA, 201 bp, Homo sapiens
gtacagtccaaatttgtgcacagagattgctgtggtattcaagaggtacttgcattttagctccttaattccctggccagtgttagctgtttagtgccccctcacccatcccatttaggcacatcccaatagacagagccaggctgagttacagggggagagtgtcatctctggccccgattaagatggccttgtcacagt

SEQ ID NO: 5485 - DNA, 201 bp, Homo sapiens
aagctccaggctcatctaagctcccacaatttcttacggggccagtcatgtgaagcgtttacagcttaaaaaaaaagcgcttgcctaactcatactttccygttgacacttgatccacgcagcgtggcactgggacgtaagtggcgcagtctgaatggcggcacgctgaaggaaacgtgcgaagcacaggctgaagagggg

SEQ ID NO: 5486 - DNA, 201 bp, Homo sapiens
ctgaaaatgcagaaagaaatcgattccaagatgttcttccttatgatgatgtgagagtggagttggtcccaactaaagaaaacaacactggttacatcaaygcatcacatattaaggtctctgtcagtggaatcgaatgggattatattgccacacagggaccattacagaatacctgtcaagatttttggcagatggtat

SEQ ID NO: 5487 - DNA, 201 bp, Homo sapiens
aggagagcggggcccgggcgcctcctgcacgtgcgcgcgagcctcggcccggcctggcccaggacccacctggctgccctcgcgtcctgctcgccgggccyctgcacatcctggagcccaaggcccacgtcccagacgcggagaagaggatgatggacagcagccccgtccgcacgaccgcagaggcccagcggccctgga

SEQ ID NO: 5488 - DNA, 201 bp, Homo sapiens
atagcacaagtgatccccaaagccccaaccctccgttgttggtccactgcagtgctggggtaggaaggactggcgtggtgattttgtcggagatcatgatygcctgcctggaacacaatgaggtgctggacatcccgagagtgctggacatgctgaggcaacagagaatgatgctggtgcagactctctgccagtacacat

SEQ ID NO: 5489 - DNA, 201 bp, Homo sapiens
  misc_feature (1)...(201): n = A,T,C or G, or insertion/deletion polymorphism (see Tables 1-2)
attcttaagaaacggctagttgatggggagtgctcaacagcacgactccctgaaaatgcagaaagaaatcgattccaagatgttcttccttatgatgatgngagagtggagttggtcccaactaaagaaaacaacactggttacatcaacgcatcacatattaaggtctctgtcagtggaatcgaatgggattatattgcc

SEQ ID NO: 5490 - DNA, 196 bp, Homo sapiens
gccccatgagcgcgccgcggcccgggctggcgtgcgggtgcggctgcggcggccgcgcggcggggccccgggaggcgggtcgctgagcggggcgckcggccccgaggatgcgggagcgggagcgggagcagcgctggcgtcaatgctcccttcctcgggccattggagactccgttgctttttaatggcggcagcg

SEQ ID NO: 5491 - DNA, 201 bp, Homo sapiens
cctgaacatggctgtccagaagacctcaagggatttttatcatatcttgaagagatccagtctgttcgacgccatacaaatagcacaagtgatccccaaarccccaaccctccgttgttggtccactgcagtgctggggtaggaaggactggcgtggtgattttgtcggagatcatgatcgcctgcctggaacacaatgag

SEQ ID NO: 5492 - DNA, 201 bp, Homo sapiens; identical to SEQ ID NO: 5483

SEQ ID NO: 5493 - DNA, 201 bp, Homo sapiens; identical to SEQ ID NO: 5477

SEQ ID NO: 5494 - DNA, 201 bp, Homo sapiens; identical to SEQ ID NO: 5487

SEQ ID NO: 5495 - DNA, 201 bp, Homo sapiens; identical to SEQ ID NO: 5479

SEQ ID NO: 5496 - DNA, 201 bp, Homo sapiens; identical to SEQ ID NO: 5480

SEQ ID NO: 5497 - DNA, 201 bp, Homo sapiens; identical to SEQ ID NO: 5481

SEQ ID NO: 5498 - DNA, 201 bp, Homo sapiens; identical to SEQ ID NO: 5482
  misc_feature (1)...(201): n = A,T,C or G, or insertion/deletion polymorphism (see Tables 1-2)

SEQ ID NO: 5499 - DNA, 201 bp, Homo sapiens; identical to SEQ ID NO: 5477

SEQ ID NO: 5500 - DNA, 201 bp, Homo sapiens; identical to SEQ ID NO: 5479

SEQ ID NO: 5501 - DNA, 201 bp, Homo sapiens; identical to SEQ ID NO: 5480

SEQ ID NO: 5502 - DNA, 201 bp, Homo sapiens; identical to SEQ ID NO: 5481

SEQ ID NO: 5503 - DNA, 201 bp, Homo sapiens; identical to SEQ ID NO: 5482
  misc_feature (1)...(201): n = A,T,C or G, or insertion/deletion polymorphism (see Tables 1-2)

SEQ ID NO: 5504 - DNA, 201 bp, Homo sapiens; identical to SEQ ID NO: 5483

SEQ ID NO: 5505 - DNA, 201 bp, Homo sapiens; identical to SEQ ID NO: 5487

SEQ ID NO: 5506 - DNA, 196 bp, Homo sapiens; identical to SEQ ID NO: 5490

SEQ ID NO: 5507 - DNA, 201 bp, Homo sapiens
gcgtggtgcagctggcagcaggttgggggtgtgcagctcaccacacagcaggggggcaggcaggtaccctccacacggcagtctgggcggcaccacctgayacgggtgctcacagctccactgctgccctcctggccatagccaatgccaccaccaatgccacagccagttccgcaggagctggtctggcagcagcttggc

SEQ ID NO: 5508 - DNA, 123 bp, Homo sapiens
cagcttggctggcagcagctggagccgcatgtcccactggtggagcagctgggatatccacagaagctggtctggcagcaggtcatggtgttgggagctgstatgaagtctgggttgcttgga

SEQ ID NO: 5509 - DNA, 197 bp, Homo sapiens
gcaggtgggctcacaggagtagcagcagcagactgggcggcagcaggactgtccacagtaggatgggcggcagcaggaggcctcggcgtggtgcagytggcagcaggttgggggtgtgcagctcaccacacagcaggggggcaggcaggtaccctccacacggcagtctgggcggcaccacctgatacgggtgctca

SEQ ID NO: 5510 - DNA, 201 bp, Homo sapiens
acacggcagtctgggcggcaccacctgatacgggtgctcacagctccactgctgccctcctggccatagccaatgccaccaccaatgccacagccagttcygcaggagctggtctggcagcagcttggctggcagcagctggtctcacagcagcttggctggcagcaactggagctgcaggtcccactagttgagaagcta

SEQ ID NO: 5511 - DNA, 201 bp, Homo sapiens
ctcacagcagcttggctggcagcaactggagctgcaggtcccactagttgagaagctaggaaatccgcagaagctggtctggcagcagcttggctggcagsagctggtctcacagcagcttggctggcagcagctggagccgcatgtcccactggtggagcagctgggatatccacagaagctggtctggcagcaggtcat

SEQ ID NO: 5512 - DNA, 201 bp, Homo sapiens
gcaactggagctgcaggtcccactagttgagaagctaggaaatccgcagaagctggtctggcagcagcttggctggcagcagctggtctcacagcagcttkgctggcagcagctggagccgcatgtcccactggtggagcagctgggatatccacagaagctggtctggcagcaggtcatggtgttgggagctggtatgaa

SEQ ID NO: 5513 - DNA, 201 bp, Homo sapiens; identical to SEQ ID NO: 1591

SEQ ID NO: 5514 - DNA, 201 bp, Homo sapiens; identical to SEQ ID NO: 1564

SEQ ID NO: 5515 - DNA, 201 bp, Homo sapiens
accgcggcggacaccgcggctcagatcacccagcgcaagtgggaggcggcccgtgtggcggagcaggagagagcctacctggagggcacgtgcgtggagtsgctccgcagatacctggagaacgggaaggacacgctggagcgcgcggaccccccaaagacacacgtgacccaccaccccatctctgaccatgaggccacc

SEQ ID NO: 5516 - DNA, 201 bp, Homo sapiens; identical to SEQ ID NO: 1593

SEQ ID NO: 5517 - DNA, 201 bp, Homo sapiens
ctgttagcataatgtgaggaggtggagagacagcccacccttgtgtccactgtgacccctgttcccatgctgacctgtgtttcctccccagtcatctttcytgttccagagaggtggggctggatgtctccatctctgtctcaactttatgtgcactgagctgcaacttcttacttccctactgaaaataagaatctgaat

SEQ ID NO: 5518 - DNA, 201 bp, Homo sapiens; identical to SEQ ID NO: 1545

SEQ ID NO: 5519 - DNA, 201 bp, Homo sapiens
aaaggcacctgaatgtgtctgcgtccctgttagcataatgtgaggaggtggagagacagcccacccttgtgtccactgtgacccctgttcccatgctgacytgtgtttcctccccagtcatctttcttgttccagagaggtggggctggatgtctccatctctgtctcaactttatgtgcactgagctgcaacttcttact

SEQ ID NO: 5520 - DNA, 201 bp, Homo sapiens; identical to SEQ ID NO: 1572

SEQ ID NO: 5521 - DNA, 201 bp, Homo sapiens
agagcctctggcatctctttctgcaaaggcacctgaatgtgtctgcgtccctgttagcataatgtgaggaggtggagagacagcccacccttgtgtccacygtgacccctgttcccatgctgacctgtgtttcctccccagtcatctttcttgttccagagaggtggggctggatgtctccatctctgtctcaactttatg

SEQ ID NO: 5522 - DNA, 201 bp, Homo sapiens; identical to SEQ ID NO: 1522

SEQ ID NO: 5523 - DNA, 201 bp, Homo sapiens
gaacctgcgcggctactacaaccagagcgaggccgggtctcacaccctccagagcatgtacggctgcgacgtggggccggacgggcgcctcctccgcgggyataaccagtacgcctacgacggcaaggattacatcgccctgaacgaggacctgcgctcctggaccgcggcggacaccgcggctcagatcacccagcgcaa

SEQ ID NO: 5524 - DNA, 201 bp, Homo sapiens
gcggggagccccgcttcatctcagtgggctacgtggacgacacccagttcgtgaggttcgacagcgacgccgcgagtccgagagaggagccgcgggcgccrtggatagagcaggaggggccggagtattgggaccggaacacacagatcttcaagaccaacacacagactgaccgagagagcctgcggaacctgcgcggct

SEQ ID NO: 5525 - DNA, 201 bp, Homo sapiens
tgctggtcatggcgccccgaaccgtcctcctgctgctctcggcggccctggccctgaccgagacctgggccggctcccactccatgaggtatttctacacmgccatgtcccggcccggccgcggggagccccgcttcatctcagtgggctacgtggacgacacccagttcgtgaggttcgacagcgacgccgcgagtccga

SEQ ID NO: 5526 - DNA, 201 bp, Homo sapiens; identical to SEQ ID NO: 1524

SEQ ID NO: 5527 - DNA, 201 bp, Homo sapiens
acgggaaggacacgctggagcgcgcggaccccccaaagacacacgtgacccaccaccccatctctgaccatgaggccaccctgaggtgctgggccctgggyttctaccctgcggagatcacactgacctggcagcgggatggcgaggaccaaactcaggacactgagcttgtggagaccagaccagcaggagatagaacct

SEQ ID NO: 5528 - DNA, 201 bp, Homo sapiens; identical to SEQ ID NO: 1528

SEQ ID NO: 5529 - DNA, 201 bp, Homo sapiens; identical to SEQ ID NO: 1554

SEQ ID NO: 5530 - DNA, 201 bp, Homo sapiens; identical to SEQ ID NO: 1504

SEQ ID NO: 5531 - DNA, 201 bp, Homo sapiens; identical to SEQ ID NO: 1592

SEQ ID NO: 5532 - DNA, 201 bp, Homo sapiens
aggagagagcctacctggagggcacgtgcgtggagtggctccgcagatacctggagaacgggaaggacacgctggagcgcgcggaccccccaaagacacaygtgacccaccaccccatctctgaccatgaggccaccctgaggtgctgggccctgggcttctaccctgcggagatcacactgacctggcagcgggatggcg

SEQ ID NO: 5533 - DNA, 201 bp, Homo sapiens
gagtggctccgcagatacctggagaacgggaaggacacgctggagcgcgcggaccccccaaagacacacgtgacccaccaccccatctctgaccatgaggycaccctgaggtgctgggccctgggcttctaccctgcggagatcacactgacctggcagcgggatggcgaggaccaaactcaggacactgagcttgtggag

SEQ ID NO: 5534 - DNA, 142 bp, Homo sapiens
tacttccctactgaaaataagaatctgaatataaatttgttttctcaaatatttgctatgagaggttgatggattaattaaataagtcaattcctggaatktgagagagcaaataaagacctgagaaccttccagaatctgc

SEQ ID NO: 5535 - DNA, 201 bp, Homo sapiens; identical to SEQ ID NO: 1517

SEQ ID NO: 5536 - DNA, 201 bp, Homo sapiens
ggagggcacgtgcgtggagtggctccgcagatacctggagaacgggaaggacacgctggagcgcgcggaccccccaaagacacacgtgacccaccaccccrtctctgaccatgaggccaccctgaggtgctgggccctgggcttctaccctgcggagatcacactgacctggcagcgggatggcgaggaccaaactcagga

SEQ ID NO: 5537 - DNA, 201 bp, Homo sapiens; identical to SEQ ID NO: 1560

SEQ ID NO: 5538 - DNA, 201 bp, Homo sapiens; identical to SEQ ID NO: 1520

SEQ ID NO: 5539 - DNA, 201 bp, Homo sapiens; identical to SEQ ID NO: 1534

SEQ ID NO: 5540 - DNA, 201 bp, Homo sapiens; identical to SEQ ID NO: 1536

SEQ ID NO: 5541 - DNA, 201 bp, Homo sapiens
tgtgacccctgttcccatgctgacctgtgtttcctccccagtcatctttcttgttccagagaggtggggctggatgtctccatctctgtctcaactttatrtgcactgagctgcaacttcttacttccctactgaaaataagaatctgaatataaatttgttttctcaaatatttgctatgagaggttgatggattaatta

SEQ ID NO: 5542 - DNA, 201 bp, Homo sapiens; identical to SEQ ID NO: 1591

SEQ ID NO: 5543 - DNA, 201 bp, Homo sapiens
ctgtgacccctgttcccatgctgacctgtgtttcctccccagtcatctttcttgttccagagaggtggggctggatgtctccatctctgtctcaactttaygtgcactgagctgcaacttcttacttccctaagaggttgatggattaattaaataagtcaattcctggaatttgagagagcaaataaagacctgagaacc

SEQ ID NO: 5544 - DNA, 201 bp, Homo sapiens; identical to SEQ ID NO: 5515

SEQ ID NO: 5545 - DNA, 201 bp, Homo sapiens; identical to SEQ ID NO: 1593

SEQ ID NO: 5546 - DNA, 201 bp, Homo sapiens
ctgttagcataatgtgaggaggtggagagacagcccacccttgtgtccactgtgacccctgttcccatgctgacctgtgtttcctccccagtcatctttcytgttccagagaggtggggctggatgtctccatctctgtctcaactttatgtgcactgagctgcaacttcttacttccctaagaggttgatggattaatta

SEQ ID NO: 5547 - DNA, 201 bp, Homo sapiens; identical to SEQ ID NO: 1545

SEQ ID NO: 5548 - DNA, 201 bp, Homo sapiens; identical to SEQ ID NO: 5519

SEQ ID NO: 5549 - DNA, 201 bp, Homo sapiens; identical to SEQ ID NO: 1572

SEQ ID NO: 5550 - DNA, 201 bp, Homo sapiens; identical to SEQ ID NO: 5521

SEQ ID NO: 5551 - DNA, 201 bp, Homo sapiens; identical to SEQ ID NO: 1522

SEQ ID NO: 5552 - DNA, 201 bp, Homo sapiens; identical to SEQ ID NO: 5523

SEQ ID NO: 5553 - DNA, 201 bp, Homo sapiens; identical to SEQ ID NO: 5524

SEQ ID NO: 5554 - DNA, 201 bp, Homo sapiens; identical to SEQ ID NO: 5525

SEQ ID NO: 5555 - DNA, 201 bp, Homo sapiens; identical to SEQ ID NO: 1524

SEQ ID NO: 5556 - DNA, 201 bp, Homo sapiens; identical to SEQ ID NO: 5527

SEQ ID NO: 5557 - DNA, 201 bp, Homo sapiens; identical to SEQ ID NO: 1528

SEQ ID NO: 5558 - DNA, 201 bp, Homo sapiens; identical to SEQ ID NO: 1554

SEQ ID NO: 5559 - DNA, 201 bp, Homo sapiens; identical to SEQ ID NO: 1504

SEQ ID NO: 5560 - DNA, 201 bp, Homo sapiens; identical to SEQ ID NO: 1592

SEQ ID NO: 5561 - DNA, 201 bp, Homo sapiens; identical to SEQ ID NO: 5532

SEQ ID NO: 5562 - DNA, 201 bp, Homo sapiens; identical to SEQ ID NO: 5533

SEQ ID NO: 5563 - DNA, 137 bp, Homo sapiens
ggatgtctccatctctgtctcaactttatgtgcactgagctgcaacttcttacttccctaagaggttgatggattaattaaataagtcaattcctggaatktgagagagcaaataaagacctgagaaccttccagaa

SEQ ID NO: 5564 - DNA, 201 bp, Homo sapiens; identical to SEQ ID NO: 1517

SEQ ID NO: 5565 - DNA, 201 bp, Homo sapiens; identical to SEQ ID NO: 5536

SEQ ID NO: 5566 - DNA, 201 bp, Homo sapiens; identical to SEQ ID NO: 1560

SEQ ID NO: 5567 - DNA, 201 bp, Homo sapiens; identical to SEQ ID NO: 1520

SEQ ID NO: 5568 - DNA, 201 bp, Homo sapiens; identical to SEQ ID NO: 1534

SEQ ID NO: 5569 - DNA, 201 bp, Homo sapiens; identical to SEQ ID NO: 1536

SEQ ID NO: 5570 - DNA, 201 bp, Homo sapiens
tgtgacccctgttcccatgctgacctgtgtttcctccccagtcatctttcttgttccagagaggtggggctggatgtctccatctctgtctcaactttatrtgcactgagctgcaacttcttacttccctaagaggttgatggattaattaaataagtcaattcctggaatttgagagagcaaataaagacctgagaacct

SEQ ID NO: 5571 - DNA, 201 bp, Homo sapiens; identical to SEQ ID NO: 5515

SEQ ID NO: 5572 - DNA, 201 bp, Homo sapiens
gaccagcaggagatagaaccttccagaagtgggcagctgtggtggtgccttctggagaagagcagagatacacatgccatgtacagcatgaggggctgccraagcccctcaccctgagatgggccgtcttcccagtccaccgtccccatcgtgggcattgttgctggcctggctgtcctagcagttgtggtcatcggagct

SEQ ID NO: 5573 - DNA, 201 bp, Homo sapiens
tgctgtgatgtgtaggaggaagagctcaggtggaaaaggagggagctgctctcaggctgcgtgcagcaacagtgcccagggctctgatgagtctctcatcrcttgtaaagcctgagacagctgcctgtgtgggactgagatgcaggatttcttcacacctctcctttgtgacttcaagagcctctggcatctctttctgca

SEQ ID NO: 5574 - DNA, 201 bp, Homo sapiens
gtggtgccttctggagaagagcagagatacacatgccatgtacagcatgaggggctgccgaagcccctcaccctgagatgggccgtcttcccagtccaccrtccccatcgtgggcattgttgctggcctggctgtcctagcagttgtggtcatcggagctgtggtcgctgctgtgatgtgtaggaggaagagctcaggtgg

SEQ ID NO: 5575 - DNA, 201 bp, Homo sapiens
gctgtcctagcagttgtggtcatcggagctgtggtcgctgctgtgatgtgtaggaggaagagctcaggtggaaaaggagggagctgctctcaggctgcgtscagcaacagtgcccagggctctgatgagtctctcatcacttgtaaagcctgagacagctgcctgtgtgggactgagatgcaggatttcttcacacctctc

SEQ ID NO: 5576 - DNA, 201 bp, Homo sapiens; identical to SEQ ID NO: 5523

SEQ ID NO: 5577 - DNA, 201 bp, Homo sapiens; identical to SEQ ID NO: 5524

SEQ ID NO: 5578 - DNA, 201 bp, Homo sapiens; identical to SEQ ID NO: 5525

SEQ ID NO: 5579 - DNA, 201 bp, Homo sapiens; identical to SEQ ID NO: 5527

SEQ ID NO: 5580 - DNA, 201 bp, Homo sapiens
ggagatcacactgacctggcagcgggatggcgaggaccaaactcaggacactgagcttgtggagaccagaccagcaggagatagaaccttccagaagtggrcagctgtggtggtgccttctggagaagagcagagatacacatgccatgtacagcatgaggggctgccgaagcccctcaccctgagatgggccgtcttccc

SEQ ID NO: 5581 - DNA, 201 bp, Homo sapiens
tgtgaggaggtggagagacagcccacccccgtgtccaccgtgacccctgtccccacactgacctgtgttccctccccgatcatctttcctgttccagagargtgggctggatgtctccatctctgtctcaactttacgtgtactgagctgcaacttcttacttccctactgaaaataagaatctgaatataaatttgtttt

SEQ ID NO: 5582 - DNA, 201 bp, Homo sapiens
ttctggagaagagcagagatacacatgccatgtacagcatgaggggctgccgaagcccctcaccctgagatgggccgtcttcccagtccaccgtccccatygtgggcattgttgctggcctggctgtcctagcagttgtggtcatcggagctgtggtcgctgctgtgatgtgtaggaggaagagctcaggtggaaaaggag

SEQ ID NO: 5583 - DNA, 201 bp, Homo sapiens
accctgagatgggccgtcttcccagtccaccgtccccatcgtgggcattgttgctggcctggctgtcctagcagttgtggtcatcggagctgtggtcgctrctgtgatgtgtaggaggaagagctcaggtggaaaaggagggagctgctctcaggctgcgtgcagcaacagtgcccagggctctgatgagtctctcatcac

SEQ ID NO: 5584 - DNA, 201 bp, Homo sapiens
gtctgcgttcctgttagcataatgtgaggaggtggagagacagcccacccccgtgtccaccgtgacccctgtccccacactgacctgtgttccctccccgrtcatctttcctgttccagagaagtgggctggatgtctccatctctgtctcaactttacgtgtactgagctgcaacttcttacttccctactgaaaataag

SEQ ID NO: 5585 - DNA, 201 bp, Homo sapiens
tctgaatgtgtctgcgttcctgttagcataatgtgaggaggtggagagacagcccacccccgtgtccaccgtgacccctgtccccacactgacctgtgttycctccccgatcatctttcctgttccagagaagtgggctggatgtctccatctctgtctcaactttacgtgtactgagctgcaacttcttacttccctact

SEQ ID NO: 5586 - DNA, 201 bp, Homo sapiens
agagcctctggcatctctttctgcaaaggcatctgaatgtgtctgcgttcctgttagcataatgtgaggaggtggagagacagcccacccccgtgtccacygtgacccctgtccccacactgacctgtgttccctccccgatcatctttcctgttccagagaagtgggctggatgtctccatctctgtctcaactttacgt

SEQ ID NO: 5587 - DNA, 201 bp, Homo sapiens
tgggccgtcttcccagtccaccgtccccatcgtgggcattgttgctggcctggctgtcctagcagttgtggtcatcggagctgtggtcgctgctgtgatgygtaggaggaagagctcaggtggaaaaggagggagctgctctcaggctgcgtgcagcaacagtgcccagggctctgatgagtctctcatcacttgtaaagc

SEQ ID NO: 5588 - DNA, 201 bp, Homo sapiens; identical to SEQ ID NO: 5532

SEQ ID NO: 5589 - DNA, 201 bp, Homo sapiens; identical to SEQ ID NO: 5533

SEQ ID NO: 5590 - DNA, 201 bp, Homo sapiens; identical to SEQ ID NO: 5536

SEQ ID NO: 5591 - DNA, 201 bp, Homo sapiens
gaagtgggcagctgtggtggtgccttctggagaagagcagagatacacatgccatgtacagcatgaggggctgccgaagcccctcaccctgagatgggccrtcttcccagtccaccgtccccatcgtgggcattgttgctggcctggctgtcctagcagttgtggtcatcggagctgtggtcgctgctgtgatgtgtagga

SEQ ID NO: 5592 - DNA, 201 bp, Homo sapiens; identical to SEQ ID NO: 1534

SEQ ID NO: 5593 - DNA, 201 bp, Homo sapiens; identical to SEQ ID NO: 1536

SEQ ID NO: 5594 - DNA, 201 bp, Homo sapiens; identical to SEQ ID NO: 1591

SEQ ID NO: 5595 - DNA, 201 bp, Homo sapiens; identical to SEQ ID NO: 1593

SEQ ID NO: 5596 - DNA, 201 bp, Homo sapiens
gacggcaaggattacatcgccctgaacgaggacctgagctcctggaccgcggcggacaccgcggctcagatcacccagcgcaagtgggaggcggcccgtgwggcggagcagctgagagcctacctggagggcctgtgcgtggagtggctccgcagatacctggagaacgggaaggagacgctgcagcgcgcggacccccca

SEQ ID NO: 5597 - DNA, 201 bp, Homo sapiens; identical to SEQ ID NO: 1572

SEQ ID NO: 5598 - DNA, 201 bp, Homo sapiens
gatgtacggctgcgacgtggggccggacgggcgcctcctccgcgggtatgaccaggacgcctacgacggcaaggattacatcgccctgaacgaggacctgmgctcctggaccgcggcggacaccgcggctcagatcacccagcgcaagtgggaggcggcccgtgtggcggagcagctgagagcctacctggagggcctgtg

SEQ ID NO: 5599 - DNA, 201 bp, Homo sapiens
agcgcaagtgggaggcggcccgtgtggcggagcagctgagagcctacctggagggcctgtgcgtggagtggctccgcagatacctggagaacgggaaggasacgctgcagcgcgcggaccccccaaagacacacgtgacccaccaccccatctctgaccatgaggccaccctgaggtgctgggccctgggcttctaccctg

SEQ ID NO: 5600 - DNA, 201 bp, Homo sapiens
gtgggaggcggcccgtgtggcggagcagctgagagcctacctggagggcctgtgcgtggagtggctccgcagatacctggagaacgggaaggagacgctgsagcgcgcggaccccccaaagacacacgtgacccaccaccccatctctgaccatgaggccaccctgaggtgctgggccctgggcttctaccctgcggagat

SEQ ID NO: 5601 - DNA, 201 bp, Homo sapiens; identical to SEQ ID NO: 1554

SEQ ID NO: 5602 - DNA, 201 bp, Homo sapiens
cgacggcaaggattacatcgccctgaacgaggacctgagctcctggaccgcggcggacaccgcggctcagatcacccagcgcaagtgggaggcggcccgtstggcggagcagctgagagcctacctggagggcctgtgcgtggagtggctccgcagatacctggagaacgggaaggagacgctgcagcgcgcggacccccc

SEQ ID NO: 5603 - DNA, 201 bp, Homo sapiens; identical to SEQ ID NO: 1504

SEQ ID NO: 5604 - DNA, 201 bp, Homo sapiens; identical to SEQ ID NO: 1592

SEQ ID NO: 5605 - DNA, 201 bp, Homo sapiens; identical to SEQ ID NO: 1533

SEQ ID NO: 5606 - DNA, 201 bp, Homo sapiens; identical to SEQ ID NO: 1517

SEQ ID NO: 5607 - DNA, 201 bp, Homo sapiens; identical to SEQ ID NO: 1520

SEQ ID NO: 5608 - DNA, 201 bp, Homo sapiens; identical to SEQ ID NO: 1534

SEQ ID NO: 5609 - DNA, 201 bp, Homo sapiens
caacctatgtcgggtccttcttccaggatactcgtgacgcgtccccatttcccactcccattgggtgtcgggtgtctagagaagccaatcagtgtcgccgsggtcccagttctaaagtccccacgcacccacccggactcagaatctcctcagacgccgagatgcgggtcacggcgccccgaaccctcctcctgctgctct

SEQ ID NO: 5610 - DNA, 201 bp, Homo sapiens; identical to SEQ ID NO: 1536

SEQ ID NO: 5611 - DNA, 201 bp, Homo sapiens; identical to SEQ ID NO: 1564

SEQ ID NO: 5612 - DNA, 201 bp, Homo sapiens; identical to SEQ ID NO: 5517

SEQ ID NO: 5613 - DNA, 160 bp, Homo sapiens
cgagtttcacttcttctcccaacctatgtcgggtccttcttccaggatactcgtgacgcrtccccatttcccactcccattgggtgtcgggtgtctagagaagccaatcagtgtcgccggggtcccagttctaaagtccccacgcacccacccggactca

SEQ ID NO: 5614 - DNA, 201 bp, Homo sapiens; identical to SEQ ID NO: 1545

SEQ ID NO: 5615 - DNA, 201 bp, Homo sapiens; identical to SEQ ID NO: 5519

SEQ ID NO: 5616 - DNA, 201 bp, Homo sapiens
accgcggcggacaccgcggctcagatcacccagcgcaagtgggaggcggcccgtgtggcggagcagctgagagcctacctggagggcctgtgcgtggagtsgctccgcagatacctggagaacgggaaggagacgctgcagcgcgcggaccccccaaagacacacgtgacccaccaccccatctctgaccatgaggccacc

SEQ ID NO: 5617 - DNA, 201 bp, Homo sapiens; identical to SEQ ID NO: 1522

SEQ ID NO: 5618 - DNA, 201 bp, Homo sapiens; identical to SEQ ID NO: 5521

SEQ ID NO: 5619 - DNA, 201 bp, Homo sapiens; identical to SEQ ID NO: 1524

SEQ ID NO: 5620 - DNA, 201 bp, Homo sapiens; identical to SEQ ID NO: 1581

SEQ ID NO: 5621 - DNA, 201 bp, Homo sapiens; identical to SEQ ID NO: 1528

SEQ ID NO: 5622 - DNA, 201 bp, Homo sapiens
agctgagagcctacctggagggcctgtgcgtggagtggctccgcagatacctggagaacgggaaggagacgctgcagcgcgcggaccccccaaagacacaygtgacccaccaccccatctctgaccatgaggccaccctgaggtgctgggccctgggcttctaccctgcggagatcacactgacctggcagcgggatggcg

SEQ ID NO: 5623 - DNA, 201 bp, Homo sapiens
ggagggcctgtgcgtggagtggctccgcagatacctggagaacgggaaggagacgctgcagcgcgcggaccccccaaagacacacgtgacccaccaccccrtctctgaccatgaggccaccctgaggtgctgggccctgggcttctaccctgcggagatcacactgacctggcagcgggatggcgaggaccaaactcagga

SEQ ID NO: 5624 - DNA, 142 bp, Homo sapiens; identical to SEQ ID NO: 5534

SEQ ID NO: 5625 - DNA, 201 bp, Homo sapiens; identical to SEQ ID NO: 1560

SEQ ID NO: 5626 - DNA, 201 bp, Homo sapiens; identical to SEQ ID NO: 5541

SEQ ID NO: 5627 - DNA, 201 bp, Homo sapiens
ggcgccccgagccctcctcctgctgctctcgggaggcctggccctgaccgagacctgggcctgctcccactccatgaggtatttcgacaccgccgtgtccyggcccggccgcggagagccccgcttcatctcagtgggctacgtggacgacacgcagttcgtgcggttcgacagcgacgccgcgagtccgagaggggagcc

SEQ ID NO: 5628 - DNA, 201 bp, Homo sapiens
ccagaagtgggcagctgtggtggtgccttctggagaagagcagagatacacgtgccatatgcagcacgaggggctgccagagcccctcaccctgagctggragccatcttcccagcccaccatccccatcatgggcatcgttgctggcctggctgtcctggctgtcctagctgtcctaggagctgtgatggctgttgtgat

SEQ ID NO: 5629 - DNA, 201 bp, Homo sapiens
tcctcctgctgctctcgggaggcctggccctgaccgagacctgggcctgctcccactccatgaggtatttcgacaccgccgtgtcccggcccggccgcggrgagccccgcttcatctcagtgggctacgtggacgacacgcagttcgtgcggttcgacagcgacgccgcgagtccgagaggggagccgcgggcgccgtggg

SEQ ID NO: 5630 - DNA, 201 bp, Homo sapiens
aggccagcaggagatggaaccttccagaagtgggcagctgtggtggtgccttctggagaagagcagagatacacgtgccatatgcagcacgaggggctgcmagagcccctcaccctgagctgggagccatcttcccagcccaccatccccatcatgggcatcgttgctggcctggctgtcctggctgtcctagctgtccta

SEQ ID NO: 5631 - DNA, 201 bp, Homo sapiens
ctgctctcgggaggcctggccctgaccgagacctgggcctgctcccactccatgaggtatttcgacaccgccgtgtcccggcccggccgcggagagccccrcttcatctcagtgggctacgtggacgacacgcagttcgtgcggttcgacagcgacgccgcgagtccgagaggggagccgcgggcgccgtgggtggagcag

SEQ ID NO: 5632 - DNA, 147 bp, Homo sapiens
atgcgggtcatggcgccccgagccctcctcctgctgctctcgggagscctggccctgaccgagacctgggcctgctcccactccatgaggtatttcgacaccgccgtgtcccggcccggccgcggagagccccgcttcatctcagtg

SEQ ID NO: 5633 - DNA, 201 bp, Homo sapiens
ggatggcgaggaccaaactcaggacaccgagcttgtggagaccaggccagcaggagatggaaccttccagaagtgggcagctgtggtggtgccttctggasaagagcagagatacacgtgccatatgcagcacgaggggctgccagagcccctcaccctgagctgggagccatcttcccagcccaccatccccatcatggg

SEQ ID NO: 5634 - DNA, 173 bp, Homo sapiens
atgcgggtcatggcgccccgagccctcctcctgctgctctcgggaggcctggccctgaccgagacctgggcckgctcccactccatgaggtatttcgacaccgccgtgtcccggcccggccgcggagagccccgcttcatctcagtgggctacgtggacgacacgcagttcgt

SEQ ID NO: 5635 - DNA, 201 bp, Homo sapiens
tgttgtgatgtgtaggaggaagagctcaggtggaaaaggagggagctgctctcaggctgcgtgcagcaacagtgcccagggctctgatgagtctctcatcrcttgtaaagcctgagacagctgcctgtgtgggactgagatgcaggatttcttcacacctctcctttgtgacttcaagagcctctggcatctctttctgca

SEQ ID NO: 5636 - DNA, 201 bp, Homo sapiens
gggaggcctggccctgaccgagacctgggcctgctcccactccatgaggtatttcgacaccgccgtgtcccggcccggccgcggagagccccgcttcatckcagtgggctacgtggacgacacgcagttcgtgcggttcgacagcgacgccgcgagtccgagaggggagccgcgggcgccgtgggtggagcaggaggggcc

SEQ ID NO: 5637 - DNA, 201 bp, Homo sapiens
gtgtcccggcccggccgcggagagccccgcttcatctcagtgggctacgtggacgacacgcagttcgtgcggttcgacagcgacgccgcgagtccgagagrggagccgcgggcgccgtgggtggagcaggaggggccggagtattgggaccgggagacacagaagtacaagcgccaggcacaggctgaccgagtgagcctg

SEQ ID NO: 5638 - DNA, 201 bp, Homo sapiens
tcccactccatgaggtatttcgacaccgccgtgtcccggcccggccgcggagagccccgcttcatctcagtgggctacgtggacgacacgcagttcgtgcrgttcgacagcgacgccgcgagtccgagaggggagccgcgggcgccgtgggtggagcaggaggggccggagtattgggaccgggagacacagaagtacaag

SEQ ID NO: 5639 - DNA, 201 bp, Homo sapiens
tgggctacgtggacgacacgcagttcgtgcggttcgacagcgacgccgcgagtccgagaggggagccgcgggcgccgtgggtggagcaggaggggccggartattgggaccgggagacacagaagtacaagcgccaggcacaggctgaccgagtgagcctgcggaacctgcgcggctactacaaccagagcgaggacgggt

SEQ ID NO: 5640 - DNA, 201 bp, Homo sapiens
ccggagtattgggaccgggagacacagaagtacaagcgccaggcacaggctgaccgagtgagcctgcggaacctgcgcggctactacaaccagagcgaggmcgggtctcacaccctccagaggatgtatggctgcgacctggggcccgacgggcgcctcctccgcgggtatgaccagtccgcctacgacggcaaggattac

SEQ ID NO: 5641 - DNA, 201 bp, Homo sapiens
caccctgagctgggagccatcttcccagcccaccatccccatcatgggcatcgttgctggcctggctgtcctggctgtcctagctgtcctaggagctgtgrtggctgttgtgatgtgtaggaggaagagctcaggtggaaaaggagggagctgctctcaggctgcgtgcagcaacagtgcccagggctctgatgagtctct

SEQ ID NO: 5642 - DNA, 201 bp, Homo sapiens
cctcaccctgagctgggagccatcttcccagcccaccatccccatcatgggcatcgttgctggcctggctgtcctggctgtcctagctgtcctaggagctrtgatggctgttgtgatgtgtaggaggaagagctcaggtggaaaaggagggagctgctctcaggctgcgtgcagcaacagtgcccagggctctgatgagtc

SEQ ID NO: 5643 - DNA, 159 bp, Homo sapiens
atgcgggtcatggcgccccgagccctcctcctgctgctctcgggaggcctggccctgaycgagacctgggcctgctcccactccatgaggtatttcgacaccgccgtgtcccggcccggccgcggagagccccgcttcatctcagtgggctacgtggac

SEQ ID NO: 5644 - DNA, 201 bp, Homo sapiens
gccatcttcccagcccaccatccccatcatgggcatcgttgctggcctggctgtcctggctgtcctagctgtcctaggagctgtgatggctgttgtgatgygtaggaggaagagctcaggtggaaaaggagggagctgctctcaggctgcgtgcagcaacagtgcccagggctctgatgagtctctcatcacttgtaaagc

SEQ ID NO: 5645 - DNA, 201 bp, Homo sapiens
caccgagcttgtggagaccaggccagcaggagatggaaccttccagaagtgggcagctgtggtggtgccttctggagaagagcagagatacacgtgccatrtgcagcacgaggggctgccagagcccctcaccctgagctgggagccatcttcccagcccaccatccccatcatgggcatcgttgctggcctggctgtcct

SEQ ID NO: 5646 - DNA, 201 bp, Homo sapiens
ctgggagccatcttcccagcccaccatccccatcatgggcatcgttgctggcctggctgtcctggctgtcctagctgtcctaggagctgtgatggctgttrtgatgtgtaggaggaagagctcaggtggaaaaggagggagctgctctcaggctgcgtgcagcaacagtgcccagggctctgatgagtctctcatcacttg

SEQ ID NO: 5647 - DNA, 201 bp, Homo sapiens
agctgggagccatcttcccagcccaccatccccatcatgggcatcgttgctggcctggctgtcctggctgtcctagctgtcctaggagctgtgatggctgytgtgatgtgtaggaggaagagctcaggtggaaaaggagggagctgctctcaggctgcgtgcagcaacagtgcccagggctctgatgagtctctcatcact

SEQ ID NO: 5648 - DNA, 201 bp, Homo sapiens
agaggggagccgcgggcgccgtgggtggagcaggaggggccggagtattgggaccgggagacacagaagtacaagcgccaggcacaggctgaccgagtgarcctgcggaacctgcgcggctactacaaccagagcgaggacgggtctcacaccctccagaggatgtatggctgcgacctggggcccgacgggcgcctcctc

SEQ ID NO: 5649 - DNA, 201 bp, Homo sapiens
cagcacgaggggctgccagagcccctcaccctgagctgggagccatcttcccagcccaccatccccatcatgggcatcgttgctggcctggctgtcctggytgtcctagctgtcctaggagctgtgatggctgttgtgatgtgtaggaggaagagctcaggtggaaaaggagggagctgctctcaggctgcgtgcagcaac

SEQ ID NO: 5650 - DNA, 197 bp, Homo sapiens
atgcgggtcatggcgccccgagccctcctcctgctgctctcgggaggcctggccctgaccgagacctgggcctgctcccactccatgaggtatttckacaccgccgtgtcccggcccggccgcggagagccccgcttcatctcagtgggctacgtggacgacacgcagttcgtgcggttcgacagcgacgccgcgag

SEQ ID NO: 5651 - DNA, 201 bp, Homo sapiens
tggagaagagcagagatacacgtgccatatgcagcacgaggggctgccagagcccctcaccctgagctgggagccatcttcccagcccaccatccccatcrtgggcatcgttgctggcctggctgtcctggctgtcctagctgtcctaggagctgtgatggctgttgtgatgtgtaggaggaagagctcaggtggaaaagg

SEQ ID NO: 5652 - DNA, 201 bp, Homo sapiens
ccgccgtgtcccggcccggccgcggagagccccgcttcatctcagtgggctacgtggacgacacgcagttcgtgcggttcgacagcgacgccgcgagtccragaggggagccgcgggcgccgtgggtggagcaggaggggccggagtattgggaccgggagacacagaagtacaagcgccaggcacaggctgaccgagtga

SEQ ID NO: 5653 - DNA, 198 bp, Homo sapiens
atgcgggtcatggcgccccgagccctcctcctgctgctctcgggaggcctggccctgaccgagacctgggcctgctcccactccatgaggtatttcghcaccgccgtgtcccggcccggccgcggagagccccgcttcatctcagtgggctacgtggacgacacgcagttcgtgcggttcgacagcgacgccgcgagt

SEQ ID NO: 5654 - DNA, 201 bp, Homo sapiens
tgcgggtcatggcgccccgagccctcctcctgctgctctcgggaggcctggccctgaccgagacctgggcctgctcccactccatgaggtatttcgacacmgccgtgtcccggcccggccgcggagagccccgcttcatctcagtgggctacgtggacgacacgcagttcgtgcggttcgacagcgacgccgcgagtccga

SEQ ID NO: 5655 - DNA, 128 bp, Homo sapiens
atgcgggtcatggcgccccgagccctcmtcctgctgctctcgggaggcctggccctgaccgagacctgggcctgctcccactccatgaggtatttcgacaccgccgtgtcccggcccggccgcggaga

SEQ ID NO: 5656 - DNA, 201 bp, Homo sapiens
gcgggtcatggcgccccgagccctcctcctgctgctctcgggaggcctggccctgaccgagacctgggcctgctcccactccatgaggtatttcgacacckccgtgtcccggcccggccgcggagagccccgcttcatctcagtgggctacgtggacgacacgcagttcgtgcggttcgacagcgacgccgcgagtccgag

SEQ ID NO: 5657 - DNA, 122 bp, Homo sapiens
atgcgggtcatggcgccccgarccctcctcctgctgctctcgggaggcctggccctgaccgagacctgggcctgctcccactccatgaggtatttcgacaccgccgtgtcccggcccggccg

SEQ ID NO: 5658 - DNA, 201 bp, Homo sapiens
ggcccggccgcggagagccccgcttcatctcagtgggctacgtggacgacacgcagttcgtgcggttcgacagcgacgccgcgagtccgagaggggagccscgggcgccgtgggtggagcaggaggggccggagtattgggaccgggagacacagaagtacaagcgccaggcacaggctgaccgagtgagcctgcggaacc

SEQ ID NO: 5659 - DNA, 201 bp, Homo sapiens
gggtcatggcgccccgagccctcctcctgctgctctcgggaggcctggccctgaccgagacctgggcctgctcccactccatgaggtatttcgacaccgcygtgtcccggcccggccgcggagagccccgcttcatctcagtgggctacgtggacgacacgcagttcgtgcggttcgacagcgacgccgcgagtccgagag

SEQ ID NO: 5660 - DNA, 201 bp, Homo sapiens
ggccgcggagagccccgcttcatctcagtgggctacgtggacgacacgcagttcgtgcggttcgacagcgacgccgcgagtccgagaggggagccgcgggmgccgtgggtggagcaggaggggccggagtattgggaccgggagacacagaagtacaagcgccaggcacaggctgaccgagtgagcctgcggaacctgcgc

SEQ ID NO: 5661 - DNA, 201 bp, Homo sapiens
gtcctggctgtcctagctgtcctaggagctgtgatggctgttgtgatgtgtaggaggaagagctcaggtggaaaaggagggagctgctctcaggctgcgtscagcaacagtgcccagggctctgatgagtctctcatcacttgtaaagcctgagacagctgcctgtgtgggactgagatgcaggatttcttcacacctctc

SEQ ID NO: 5662 - DNA, 201 bp, Homo sapiens
cctccgcgggtatgaccagtccgcctacgacggcaaggattacatcgccctgaacgaggacctgcgctcctggaccgccgcggacacggcggctcagatcwcccagcgcaagtgggaggcggcccgtgaggcggagcagtggagagcctacctggagggcacgtgcgtggagtggctccgcagatacctggagaacgggaa

SEQ ID NO: 5663 - DNA, 201 bp, Homo sapiens
ggattacatcgccctgaacgaggacctgcgctcctggaccgccgcggacacggcggctcagatcacccagcgcaagtgggaggcggcccgtgaggcggagsagtggagagcctacctggagggcacgtgcgtggagtggctccgcagatacctggagaacgggaaggagacgctgcagcgcgcggaacacccaaagacaca

SEQ ID NO: 5664 - DNA, 201 bp, Homo sapiens
gggagccatcttcccagcccaccatccccatcatgggcatcgttgctggcctggctgtcctggctgtcctagctgtcctaggagctgtgatggctgttgtkatgtgtaggaggaagagctcaggtggaaaaggagggagctgctctcaggctgcgtgcagcaacagtgcccagggctctgatgagtctctcatcacttgta

SEQ ID NO: 5665 - DNA, 201 bp, Homo sapiens
cctgggcctgctcccactccatgaggtatttcgacaccgccgtgtcccggcccggccgcggagagccccgcttcatctcagtgggctacgtggacgacacscagttcgtgcggttcgacagcgacgccgcgagtccgagaggggagccgcgggcgccgtgggtggagcaggaggggccggagtattgggaccgggagacac

SEQ ID NO: 5666 - DNA, 201 bp, Homo sapiens
tgagctgggagccatcttcccagcccaccatccccatcatgggcatcgttgctggcctggctgtcctggctgtcctagctgtcctaggagctgtgatggcygttgtgatgtgtaggaggaagagctcaggtggaaaaggagggagctgctctcaggctgcgtgcagcaacagtgcccagggctctgatgagtctctcatca

SEQ ID NO: 5667 - DNA, 201 bp, Homo sapiens
ccctgagctgggagccatcttcccagcccaccatccccatcatgggcatcgttgctggcctggctgtcctggctgtcctagctgtcctaggagctgtgatsgctgttgtgatgtgtaggaggaagagctcaggtggaaaaggagggagctgctctcaggctgcgtgcagcaacagtgcccagggctctgatgagtctctca

SEQ ID NO: 5668 - DNA, 201 bp, Homo sapiens; identical to SEQ ID NO: 5581

SEQ ID NO: 5669 - DNA, 201 bp, Homo sapiens; identical to SEQ ID NO: 5584

SEQ ID NO: 5670 - DNA, 201 bp, Homo sapiens; identical to SEQ ID NO: 5585

SEQ ID NO: 5671 - DNA, 201 bp, Homo sapiens; identical to SEQ ID NO: 5586

SEQ ID NO: 5672 - DNA, 201 bp, Homo sapiens
agtgggcagctgtggtggtgccttctggagaagagcagagatacacgtgccatatgcagcacgaggggctgccagagcccctcaccctgagctgggagccrtcttcccagcccaccatccccatcatgggcatcgttgctggcctggctgtcctggctgtcctagctgtcctaggagctgtgatggctgttgtgatgtgta

SEQ ID NO: 5673 - DNA, 201 bp, Homo sapiens
ccgagccctcctcctgctgctctcgggaggcctggccctgaccgagacctgggcctgctcccactccatgaggtatttcgacaccgccgtgtcccggcccrgccgcggagagccccgcttcatctcagtgggctacgtggacgacacgcagttcgtgcggttcgacagcgacgccgcgagtccgagaggggagccgcgggc

SEQ ID NO: 5674 - DNA, 201 bp, Homo sapiens
cagaagtgggcagctgtggtggtgccttctggagaagagcagagatacacgtgccatatgcagcacgaggggctgccagagcccctcaccctgagctgggrgccatcttcccagcccaccatccccatcatgggcatcgttgctggcctggctgtcctggctgtcctagctgtcctaggagctgtgatggctgttgtgatg

SEQ ID NO: 5675 - DNA, 201 bp, Homo sapiens
cccgagccctcctcctgctgctctcgggaggcctggccctgaccgagacctgggcctgctcccactccatgaggtatttcgacaccgccgtgtcccggccyggccgcggagagccccgcttcatctcagtgggctacgtggacgacacgcagttcgtgcggttcgacagcgacgccgcgagtccgagaggggagccgcggg

SEQ ID NO: 5676 - DNA, 201 bp, Homo sapiens; identical to SEQ ID NO: 5627

SEQ ID NO: 5677 - DNA, 201 bp, Homo sapiens; identical to SEQ ID NO: 5628

SEQ ID NO: 5678 - DNA, 201 bp, Homo sapiens; identical to SEQ ID NO: 5629

SEQ ID NO: 5679 - DNA, 201 bp, Homo sapiens; identical to SEQ ID NO: 5630

SEQ ID NO: 5680 - DNA, 201 bp, Homo sapiens; identical to SEQ ID NO: 5631

SEQ ID NO: 5681 - DNA, 201 bp, Homo sapiens
atcacactgacctggcagcgggatggcgaggaccaaactcaggacactgagcttatgcgggtcatggcgccccgagccctcctcctgctgctctcgggagscctggccctgaccgagacctgggcctgctcccactccatgaggtatttcgacaccgccgtgtcccggcccggccgcggagagccccgcttcatctcagtg

SEQ ID NO: 5682 - DNA, 201 bp, Homo sapiens; identical to SEQ ID NO: 5633

SEQ ID NO: 5683 - DNA, 201 bp, Homo sapiens
gacggcaaggattacatcgccctgaacgaggacctgagctcctggaccgcggcggacaccgcggctcagatcacccagcgcaagtgggaggcggcccgtgwggcggagcagctgagagcctacctggagggcctgtgcgtggagtggctccgcagatacctggagaacgggaaggagacgctgcagcgcgcgggtaccagg

SEQ ID NO: 5684 - DNA, 201 bp, Homo sapiens
cgaggaccaaactcaggacactgagcttatgcgggtcatggcgccccgagccctcctcctgctgctctcgggaggcctggccctgaccgagacctgggcckgctcccactccatgaggtatttcgacaccgccgtgtcccggcccggccgcggagagccccgcttcatctcagtgggctacgtggacgacacgcagttcgt

SEQ ID NO: 5685 - DNA, 201 bp, Homo sapiens; identical to SEQ ID NO: 5635

SEQ ID NO: 5686 - DNA, 201 bp, Homo sapiens; identical to SEQ ID NO: 5636

SEQ ID NO: 5687 - DNA, 201 bp, Homo sapiens; identical to SEQ ID NO: 5637

SEQ ID NO: 5688 - DNA, 201 bp, Homo sapiens; identical to SEQ ID NO: 5638

SEQ ID NO: 5689 - DNA, 201 bp, Homo sapiens; identical to SEQ ID NO: 5639

SEQ ID NO: 5690 - DNA, 201 bp, Homo sapiens; identical to SEQ ID NO: 5640

SEQ ID NO: 5691 - DNA, 201 bp, Homo sapiens; identical to SEQ ID NO: 5598

SEQ ID NO: 5692 - DNA, 201 bp, Homo sapiens
agcgcaagtgggaggcggcccgtgtggcggagcagctgagagcctacctggagggcctgtgcgtggagtggctccgcagatacctggagaacgggaaggasacgctgcagcgcgcgggtaccaggggcagtggggagccttccccatctcctatagacgccgagatgctggtcatggcgccccgaaccgtcctcctgctgc

SEQ ID NO: 5693 - DNA, 201 bp, Homo sapiens
gtgggaggcggcccgtgtggcggagcagctgagagcctacctggagggcctgtgcgtggagtggctccgcagatacctggagaacgggaaggagacgctgsagcgcgcgggtaccaggggcagtggggagccttccccatctcctatagacgccgagatgctggtcatggcgccccgaaccgtcctcctgctgctctcggc

SEQ ID NO: 5694 - DNA, 201 bp, Homo sapiens; identical to SEQ ID NO: 5641

SEQ ID NO: 5695 - DNA, 201 bp, Homo sapiens
cgacggcaaggattacatcgccctgaacgaggacctgagctcctggaccgcggcggacaccgcggctcagatcacccagcgcaagtgggaggcggcccgtstggcggagcagctgagagcctacctggagggcctgtgcgtggagtggctccgcagatacctggagaacgggaaggagacgctgcagcgcgcgggtaccag

SEQ ID NO: 5696 - DNA, 201 bp, Homo sapiens; identical to SEQ ID NO: 5642

SEQ ID NO: 5697 - DNA, 201 bp, Homo sapiens
tggcagcgggatggcgaggaccaaactcaggacactgagcttatgcgggtcatggcgccccgagccctcctcctgctgctctcgggaggcctggccctgaycgagacctgggcctgctcccactccatgaggtatttcgacaccgccgtgtcccggcccggccgcggagagccccgcttcatctcagtgggctacgtggac

SEQ ID NO: 5698 - DNA, 201 bp, Homo sapiens; identical to SEQ ID NO: 5644

SEQ ID NO: 5699 - DNA, 201 bp, Homo sapiens
accgtcctcctgctgctctcggcggccctggccctgaccgagacctgggccgaccccccaaagacacacgtgacccaccaccccatctctgaccatgaggycaccctgaggtgctgggccctgggcttctaccctgcggagatcacactgacctggcagcgggatggcgaggaccaaactcaggacactgagcttatgcgg

SEQ ID NO: 5700 - DNA, 201 bp, Homo sapiens; identical to SEQ ID NO: 5646

SEQ ID NO: 5701 - DNA, 201 bp, Homo sapiens; identical to SEQ ID NO: 5645

SEQ ID NO: 5702 - DNA, 201 bp, Homo sapiens; identical to SEQ ID NO: 5648

SEQ ID NO: 5703 - DNA, 201 bp, Homo sapiens; identical to SEQ ID NO: 5647

SEQ ID NO: 5704 - DNA, 201 bp, Homo sapiens
ctgaccatgaggccaccctgaggtgctgggccctgggcttctaccctgcggagatcacactgacctggcagcgggatggcgaggaccaaactcaggacacygagcttatgcgggtcatggcgccccgagccctcctcctgctgctctcgggaggcctggccctgaccgagacctgggcctgctcccactccatgaggtatt

SEQ ID NO: 5705 - DNA, 201 bp, Homo sapiens
gcttatgcgggtcatggcgccccgagccctcctcctgctgctctcgggaggcctggccctgaccgagacctgggcctgctcccactccatgaggtatttckacaccgccgtgtcccggcccggccgcggagagccccgcttcatctcagtgggctacgtggacgacacgcagttcgtgcggttcgacagcgacgccgcgag

SEQ ID NO: 5706 - DNA, 201 bp, Homo sapiens; identical to SEQ ID NO: 5649

SEQ ID NO: 5707 - DNA, 201 bp, Homo sapiens
cttatgcgggtcatggcgccccgagccctcctcctgctgctctcgggaggcctggccctgaccgagacctgggcctgctcccactccatgaggtatttcghcaccgccgtgtcccggcccggccgcggagagccccgcttcatctcagtgggctacgtggacgacacgcagttcgtgcggttcgacagcgacgccgcgagt

SEQ ID NO: 5708 - DNA, 201 bp, Homo sapiens; identical to SEQ ID NO: 5651

SEQ ID NO: 5709 - DNA, 201 bp, Homo sapiens; identical to SEQ ID NO: 5652

SEQ ID NO: 5710 - DNA, 201 bp, Homo sapiens; identical to SEQ ID NO: 5654

SEQ ID NO: 5711 - DNA, 201 bp, Homo sapiens; identical to SEQ ID NO: 5656

SEQ ID NO: 5712 - DNA, 201 bp, Homo sapiens
gggcttctaccctgcggagatcacactgacctggcagcgggatggcgaggaccaaactcaggacactgagcttatgcgggtcatggcgccccgagccctcmtcctgctgctctcgggaggcctggccctgaccgagacctgggcctgctcccactccatgaggtatttcgacaccgccgtgtcccggcccggccgcggaga

SEQ ID NO: 5713 - DNA, 201 bp, Homo sapiens; identical to SEQ ID NO: 5659

SEQ ID NO: 5714 - DNA, 201 bp, Homo sapiens
ggccctgggcttctaccctgcggagatcacactgacctggcagcgggatggcgaggaccaaactcaggacactgagcttatgcgggtcatggcgccccgarccctcctcctgctgctctcgggaggcctggccctgaccgagacctgggcctgctcccactccatgaggtatttcgacaccgccgtgtcccggcccggccg

SEQ ID NO: 5715 - DNA, 201 bp, Homo sapiens; identical to SEQ ID NO: 5658

SEQ ID NO: 5716 - DNA, 201 bp, Homo sapiens; identical to SEQ ID NO: 5660

SEQ ID NO: 5717 - DNA, 201 bp, Homo sapiens
accgcggcggacaccgcggctcagatcacccagcgcaagtgggaggcggcccgtgtggcggagcagctgagagcctacctggagggcctgtgcgtggagtsgctccgcagatacctggagaacgggaaggagacgctgcagcgcgcgggtaccaggggcagtggggagccttccccatctcctatagacgccgagatgctg

SEQ ID NO: 5718 - DNA, 201 bp, Homo sapiens; identical to SEQ ID NO: 5661

SEQ ID NO: 5719 - DNA, 201 bp, Homo sapiens; identical to SEQ ID NO: 5662

SEQ ID NO: 5720 - DNA, 201 bp, Homo sapiens; identical to SEQ ID NO: 5663

SEQ ID NO: 5721 - DNA, 201 bp, Homo sapiens; identical to SEQ ID NO: 5664

SEQ ID NO: 5722 - DNA, 201 bp, Homo sapiens; identical to SEQ ID NO: 5665

SEQ ID NO: 5723 - DNA, 201 bp, Homo sapiens; identical to SEQ ID NO: 5666

SEQ ID NO: 5724 - DNA, 201 bp, Homo sapiens
ccctggccctgaccgagacctgggccgaccccccaaagacacacgtgacccaccaccccatctctgaccatgaggccaccctgaggtgctgggccctgggyttctaccctgcggagatcacactgacctggcagcgggatggcgaggaccaaactcaggacactgagcttatgcgggtcatggcgccccgagccctcctcc

SEQ ID NO: 5725 - DNA, 201 bp, Homo sapiens; identical to SEQ ID NO: 5667

SEQ ID NO: 5726 - DNA, 201 bp, Homo sapiens; identical to SEQ ID NO: 5581

SEQ ID NO: 5727 - DNA, 201 bp, Homo sapiens; identical to SEQ ID NO: 5584

SEQ ID NO: 5728 - DNA, 201 bp, Homo sapiens; identical to SEQ ID NO: 5585

SEQ ID NO: 5729 - DNA, 201 bp, Homo sapiens; identical to SEQ ID NO: 5586

SEQ ID NO: 5730 - DNA, 201 bp, Homo sapiens
tagacgccgagatgctggtcatggcgccccgaaccgtcctcctgctgctctcggcggccctggccctgaccgagacctgggccgaccccccaaagacacaygtgacccaccaccccatctctgaccatgaggccaccctgaggtgctgggccctgggcttctaccctgcggagatcacactgacctggcagcgggatggcg

SEQ ID NO: 5731 - DNA, 201 bp, Homo sapiens; identical to SEQ ID NO: 5672

SEQ ID NO: 5732 - DNA, 201 bp, Homo sapiens; identical to SEQ ID NO: 5673

SEQ ID NO: 5733 - DNA, 201 bp, Homo sapiens; identical to SEQ ID NO: 5674

SEQ ID NO: 5734 - DNA, 201 bp, Homo sapiens
ggtcatggcgccccgaaccgtcctcctgctgctctcggcggccctggccctgaccgagacctgggccgaccccccaaagacacacgtgacccaccaccccrtctctgaccatgaggccaccctgaggtgctgggccctgggcttctaccctgcggagatcacactgacctggcagcgggatggcgaggaccaaactcagga

SEQ ID NO: 5735 - DNA, 201 bp, Homo sapiens; identical to SEQ ID NO: 5675

SEQ ID NO: 5736 - DNA, 201 bp, Homo sapiens; identical to SEQ ID NO: 1591

SEQ ID NO: 5737 - DNA, 201 bp, Homo sapiens; identical to SEQ ID NO: 1593

SEQ ID NO: 5738 - DNA, 201 bp, Homo sapiens; identical to SEQ ID NO: 5596

SEQ ID NO: 5739 - DNA, 201 bp, Homo sapiens; identical to SEQ ID NO: 1572

SEQ ID NO: 5740 - DNA, 201 bp, Homo sapiens; identical to SEQ ID NO: 5598

SEQ ID NO: 5741 - DNA, 201 bp, Homo sapiens; identical to SEQ ID NO: 5599

SEQ ID NO: 5742 - DNA, 201 bp, Homo sapiens; identical to SEQ ID NO: 5600

SEQ ID NO: 5743 - DNA, 201 bp, Homo sapiens; identical to SEQ ID NO: 5602

SEQ ID NO: 5744 - DNA, 201 bp, Homo sapiens; identical to SEQ ID NO: 1554

SEQ ID NO: 5745 - DNA, 201 bp, Homo sapiens; identical to SEQ ID NO: 1504

SEQ ID NO: 5746 - DNA, 201 bp, Homo sapiens; identical to SEQ ID NO: 1592

SEQ ID NO: 5747 - DNA, 201 bp, Homo sapiens; identical to SEQ ID NO: 1533

SEQ ID NO: 5748 - DNA, 201 bp, Homo sapiens; identical to SEQ ID NO: 1517

SEQ ID NO: 5749 - DNA, 201 bp, Homo sapiens; identical to SEQ ID NO: 1520

SEQ ID NO: 5750 - DNA, 201 bp, Homo sapiens; identical to SEQ ID NO: 1534

SEQ ID NO: 5751 - DNA, 201 bp, Homo sapiens; identical to SEQ ID NO: 1536

SEQ ID NO: 5752 - DNA, 115 bp, Homo sapiens
aatcagtgtcgccgsggtcccagttctaaagtccccacgcacccacccggactcagaatctcctcagacgccgagatgcgggtcacggcgccccgaaccctcctcctgctgctct

SEQ ID NO: 5753 - DNA, 201 bp, Homo sapiens; identical to SEQ ID NO: 5543

SEQ ID NO: 5754 - DNA, 201 bp, Homo sapiens; identical to SEQ ID NO: 5546

SEQ ID NO: 5755 - DNA, 201 bp, Homo sapiens; identical to SEQ ID NO: 5519

SEQ ID NO: 5756 - DNA, 201 bp, Homo sapiens; identical to SEQ ID NO: 1545

SEQ ID NO: 5757 - DNA, 201 bp, Homo sapiens; identical to SEQ ID NO: 5616

SEQ ID NO: 5758 - DNA, 201 bp, Homo sapiens; identical to SEQ ID NO: 1522

SEQ ID NO: 5759 - DNA, 201 bp, Homo sapiens; identical to SEQ ID NO: 5521

SEQ ID NO: 5760 - DNA, 201 bp, Homo sapiens; identical to SEQ ID NO: 1524

SEQ ID NO: 5761 - DNA, 201 bp, Homo sapiens; identical to SEQ ID NO: 1581

SEQ ID NO: 5762 - DNA, 201 bp, Homo sapiens; identical to SEQ ID NO: 1528

SEQ ID NO: 5763 - DNA, 201 bp, Homo sapiens; identical to SEQ ID NO: 5622

SEQ ID NO: 5764 - DNA, 137 bp, Homo sapiens; identical to SEQ ID NO: 5563

SEQ ID NO: 5765 - DNA, 201 bp, Homo sapiens; identical to SEQ ID NO: 5623

SEQ ID NO: 5766 - DNA, 201 bp, Homo sapiens; identical to SEQ ID NO: 1560

SEQ ID NO: 5767 - DNA, 201 bp, Homo sapiens; identical to SEQ ID NO: 5570

SEQ ID NO: 5768 - DNA, 201 bp, Homo sapiens; identical to SEQ ID NO: 5627

SEQ ID NO: 5769 - DNA, 201 bp, Homo sapiens; identical to SEQ ID NO: 5628

SEQ ID NO: 5770 - DNA, 201 bp, Homo sapiens; identical to SEQ ID NO: 5629

SEQ ID NO: 5771 - DNA, 201 bp, Homo sapiens; identical to SEQ ID NO: 5630

SEQ ID NO: 5772 - DNA, 201 bp, Homo sapiens; identical to SEQ ID NO: 5631

SEQ ID NO: 5773 - DNA, 201 bp, Homo sapiens
ggttctaaagtccccagtcacccacccggactcacattctccccagaggccgagatgcgggtcatggcgccccgagccctcctcctgctgctctcgggagscctggccctgaccgagacctgggcctgctcccactccatgaggtatttcgacaccgccgtgtcccggcccggccgcggagagccccgcttcatctcagtg

SEQ ID NO: 5774 - DNA, 148 bp, Homo sapiens
ggttctaaagtccccagtcacccacccggactcacattctccccagasgccgagatgcgggtcatggcgccccgagccctcctcctgctgctctcgggaggcctggccctgaccgagacctgggcctgctcccactccatgaggtatt

SEQ ID NO: 5775 - DNA, 201 bp, Homo sapiens; identical to SEQ ID NO: 5633

SEQ ID NO: 5776 - DNA, 134 bp, Homo sapiens
ggttctaaagtccccagtcacccacccggactcrcattctccccagaggccgagatgcgggtcatggcgccccgagccctcctcctgctgctctcgggaggcctggccctgaccgagacctgggcctgctccca

SEQ ID NO: 5777 - DNA, 201 bp, Homo sapiens
cggactcacattctccccagaggccgagatgcgggtcatggcgccccgagccctcctcctgctgctctcgggaggcctggccctgaccgagacctgggcckgctcccactccatgaggtatttcgacaccgccgtgtcccggcccggccgcggagagccccgcttcatctcagtgggctacgtggacgacacgcagttcgt

SEQ ID NO: 5778 - DNA, 135 bp, Homo sapiens
ggttctaaagtccccagtcacccacccggactcasattctccccagaggccgagatgcgggtcatggcgccccgagccctcctcctgctgctctcgggaggcctggccctgaccgagacctgggcctgctcccac

SEQ ID NO: 5779 - DNA, 201 bp, Homo sapiens; identical to SEQ ID NO: 5635

SEQ ID NO: 5780 - DNA, 201 bp, Homo sapiens; identical to SEQ ID NO: 5636

SEQ ID NO: 5781 - DNA, 201 bp, Homo sapiens; identical to SEQ ID NO: 5637

SEQ ID NO: 5782 - DNA, 201 bp, Homo sapiens; identical to SEQ ID NO: 5638

SEQ ID NO: 5783 - DNA, 201 bp, Homo sapiens; identical to SEQ ID NO: 5639

SEQ ID NO: 5784 - DNA, 201 bp, Homo sapiens; identical to SEQ ID NO: 5640

SEQ ID NO: 5785 - DNA, 201 bp, Homo sapiens; identical to SEQ ID NO: 5641

SEQ ID NO: 5786 - DNA, 201 bp, Homo sapiens; identical to SEQ ID NO: 5642

SEQ ID NO: 5787 - DNA, 201 bp, Homo sapiens
cccagtcacccacccggactcacattctccccagaggccgagatgcgggtcatggcgccccgagccctcctcctgctgctctcgggaggcctggccctgaycgagacctgggcctgctcccactccatgaggtatttcgacaccgccgtgtcccggcccggccgcggagagccccgcttcatctcagtgggctacgtggac

SEQ ID NO: 5788 - DNA, 201 bp, Homo sapiens; identical to SEQ ID NO: 5644

SEQ ID NO: 5789 - DNA, 201 bp, Homo sapiens; identical to SEQ ID NO: 5645

SEQ ID NO: 5790 - DNA, 201 bp, Homo sapiens; identical to SEQ ID NO: 5646

SEQ ID NO: 5791 - DNA, 201 bp, Homo sapiens; identical to SEQ ID NO: 5647

SEQ ID NO: 5792 - DNA, 201 bp, Homo sapiens; identical to SEQ ID NO: 5648

SEQ ID NO: 5793 - DNA, 201 bp, Homo sapiens; identical to SEQ ID NO: 5649

SEQ ID NO: 5794 - DNA, 201 bp, Homo sapiens
cgagatgcgggtcatggcgccccgagccctcctcctgctgctctcgggaggcctggccctgaccgagacctgggcctgctcccactccatgaggtatttckacaccgccgtgtcccggcccggccgcggagagccccgcttcatctcagtgggctacgtggacgacacgcagttcgtgcggttcgacagcgacgccgcgag

SEQ ID NO: 5795 - DNA, 201 bp, Homo sapiens; identical to SEQ ID NO: 5651

SEQ ID NO: 5796 - DNA, 201 bp, Homo sapiens; identical to SEQ ID NO: 5652

SEQ ID NO: 5797 - DNA, 201 bp, Homo sapiens
gagatgcgggtcatggcgccccgagccctcctcctgctgctctcgggaggcctggccctgaccgagacctgggcctgctcccactccatgaggtatttcghcaccgccgtgtcccggcccggccgcggagagccccgcttcatctcagtgggctacgtggacgacacgcagttcgtgcggttcgacagcgacgccgcgagt

SEQ ID NO: 5798 - DNA, 107 bp, Homo sapiens
ggttctraagtccccagtcacccacccggactcacattctccccagaggccgagatgcgggtcatggcgccccgagccctcctcctgctgctctcgggaggcctggc

SEQ ID NO: 5799 - DNA, 201 bp, Homo sapiens; identical to SEQ ID NO: 5654

SEQ ID NO: 5800 - DNA, 182 bp, Homo sapiens
ggttctaaagtccccagtcacccacccggactcacattctccccagaggccgagatgcgggtcatggcgccccgagccctcmtcctgctgctctcgggaggcctggccctgaccgagacctgggcctgctcccactccatgaggtatttcgacaccgccgtgtcccggcccggccgcggaga

SEQ ID NO: 5801 - DNA, 201 bp, Homo sapiens; identical to SEQ ID NO: 5656

SEQ ID NO: 5802 - DNA, 176 bp, Homo sapiens
ggttctaaagtccccagtcacccacccggactcacattctccccagaggccgagatgcgggtcatggcgccccgarccctcctcctgctgctctcgggaggcctggccctgaccgagacctgggcctgctcccactccatgaggtatttcgacaccgccgtgtcccggcccggccg

SEQ ID NO: 5803 - DNA, 201 bp, Homo sapiens; identical to SEQ ID NO: 5658

SEQ ID NO: 5804 - DNA, 201 bp, Homo sapiens; identical to SEQ ID NO: 5659

SEQ ID NO: 5805 - DNA, 201 bp, Homo sapiens; identical to SEQ ID NO: 5660

SEQ ID NO: 5806 - DNA, 201 bp, Homo sapiens; identical to SEQ ID NO: 5661

SEQ ID NO: 5807 - DNA, 201 bp, Homo sapiens; identical to SEQ ID NO: 5662

SEQ ID NO: 5808 - DNA, 201 bp, Homo sapiens; identical to SEQ ID NO: 5663

SEQ ID NO: 5809 - DNA, 201 bp, Homo sapiens; identical to SEQ ID NO: 5664

SEQ ID NO: 5810 - DNA, 201 bp, Homo sapiens; identical to SEQ ID NO: 5665

SEQ ID NO: 5811 - DNA, 201 bp, Homo sapiens; identical to SEQ ID NO: 5666

SEQ ID NO: 5812 - DNA, 201 bp, Homo sapiens; identical to SEQ ID NO: 5667

SEQ ID NO: 5813 - DNA, 201 bp, Homo sapiens; identical to SEQ ID NO: 5581

SEQ ID NO: 5814 - DNA, 201 bp, Homo sapiens; identical to SEQ ID NO: 5584

SEQ ID NO: 5815 - DNA, 201 bp, Homo sapiens; identical to SEQ ID NO: 5585

SEQ ID NO: 5816 - DNA, 201 bp, Homo sapiens; identical to SEQ ID NO: 5586

SEQ ID NO: 5817 - DNA, 201 bp, Homo sapiens; identical to SEQ ID NO: 5672

SEQ ID NO: 5818 - DNA, 201 bp, Homo sapiens; identical to SEQ ID NO: 5673

SEQ ID NO: 5819 - DNA, 201 bp, Homo sapiens; identical to SEQ ID NO: 5674

SEQ ID NO: 5820 - DNA, 201 bp, Homo sapiens; identical to SEQ ID NO: 5675

SEQ ID NO: 5821 - DNA, 201 bp, Homo sapiens
agagcctctggcatctctttctgcaaaggcatctgaatgtgtctgcgttcctgttagcataatgtgaggaggtggagagacagcccacccccgtgtccacygtgacccctgtccccacactgacctgtgttccctccccgatcatctttcctgttccagagaagtgggctggatgtctccatctctgtctcaacttcatgg

SEQ ID NO: 5822 - DNA, 201 bp, Homo sapiens
ggattacatcgccctgaacgaggatctgcgctcctggaccgccgcggacacggcggctcagatcacccagcgcaagtgggaggcggcccgtgaggcggagsagcggagagcctacctggagggcacgtgcgtggagtggctccgcagatacctggagaacgggaaggagacgctgcagcgcgcggaacacccaaagacaca

SEQ ID NO: 5823 - DNA, 201 bp, Homo sapiens
agaggggagccgcgggagccgtgggtggagcaggaggggccggagtattgggaccgggagacacagaagtacaagcgccaggcacaggctgaccgagtgarcctgcggaaactgcgcggctactacaaccagagcgaggacgggtctcacaccctccagaggatgtttggctgcgacctggggccggacgggcgcctcctc

SEQ ID NO: 5824 - DNA, 201 bp, Homo sapiens
tgttgtgatgtgtaggaggaagagctcaggtggaaaaggagggagctgctctcaggctgcgtccagcaacagtgcccagggctctgatgagtctctcatcrcttgtaaagcctgagacagctgcctgtgtgggactgagatgcaggatttcttcacacctctcctttgtgacttcaagagcctctggcatctctttctgca

SEQ ID NO: 5825 - DNA, 201 bp, Homo sapiens
tgggctacgtggacgacacgcagttcgtgcggttcgacagcgacgccgcgagtccaagaggggagccgcgggagccgtgggtggagcaggaggggccggartattgggaccgggagacacagaagtacaagcgccaggcacaggctgaccgagtgaacctgcggaaactgcgcggctactacaaccagagcgaggacgggt

SEQ ID NO: 5826 - DNA, 201 bp, Homo sapiens
ggccgcggggagccccgcttcatcgcagtgggctacgtggacgacacgcagttcgtgcggttcgacagcgacgccgcgagtccaagaggggagccgcgggmgccgtgggtggagcaggaggggccggagtattgggaccgggagacacagaagtacaagcgccaggcacaggctgaccgagtgaacctgcggaaactgcgc

SEQ ID NO: 5827 - DNA, 201 bp, Homo sapiens
cctccgcgggtataaccagttcgcctacgacggcaaggattacatcgccctgaacgaggatctgcgctcctggaccgccgcggacacggcggctcagatcwcccagcgcaagtgggaggcggcccgtgaggcggagcagcggagagcctacctggagggcacgtgcgtggagtggctccgcagatacctggagaacgggaa

SEQ ID NO: 5828 - DNA, 201 bp, Homo sapiens
tggccaagatccagagtgacagggagtacaagaaggactttgagaagtggaagaccaagttcagcagcccagtggacatgctgggggtggtgttggccaasaagtgccagaccttagtcagcgacgtggactacaagaactacctgcaccagtggacatgcctgcccgaccagagcgatgtcatccatgctcggcaggcct

SEQ ID NO: 5829 - DNA, 201 bp, Homo sapiens
acccctgaagttttattagctaaacaaaacaaagtaaattacagtgagaaattgtataagcttggcctagaagaagccaagaggaaaggttatgacatgcrggtagatgccattcctatcaaggcagccaaggcctccagagatattgcaagtgaattcaagtacaaagaaggctatcgtaagcagctcggccaccacatt

SEQ ID NO: 5830 - DNA, 201 bp, Homo sapiens
agaagcttcagagtcagtatctgtatgttgaacttgccaccaaagagagaccccatcatcacgctggaaaccagaccacagccttgaagcatgctaaagaygtgaaggacatggtcagtgagaaaaagtacaagattcaatatgaaaagatgaaagacaagtacactccggttccagatacgccaatcctcatcagagcca

SEQ ID NO: 5831 - DNA, 201 bp, Homo sapiens
  misc_feature (1)...(201): n = A,T,C or G, or insertion/deletion polymorphism (see Tables 1-2)
acctgcgtactacaaaagtcaacaaacaaatcagcgatatcctttataaattggaatacaacaaggccaaacccagaggctacaccacaatccacgacacncccatgttgctgcatgtccgcaaggttaaagatgaagtcagtgatctgaaatacaaagaagtataccaaagaaataaatccaactgcaccattgagccag

SEQ ID NO: 5832 - DNA, 201 bp, Homo sapiens
aagtcagtgatctgaaatacaaagaagtataccaaagaaataaatccaactgcaccattgagccagatgctgttcatatcaaagcagccaaggacgcctayaaagtcaacaccaatctggactataagaaacagtacgaagccaacaaagcccactggaagtggactcctgaccgaccggacttcctccaggctgccaagt

SEQ ID NO: 5833 - DNA, 201 bp, Homo sapiens
cgaagccaacaaagcccactggaagtggactcctgaccgaccggacttcctccaggctgccaagtcatccctgcagcaaagcgattttgaatataagctgraccgggagttcctcaagggttgcaagctttctgtcactgatgacaaaaacacggtgctcgccctcaggaatactttaatagaaagtgatctgaaatacaa

SEQ ID NO: 5834 - DNA, 201 bp, Homo sapiens
cagcttacaaacatgcaaaaaccacagagctcccacaacaacgatcatcttcagttgctacccaacagacaacggtatcttccatcccatctcatccatckactgctggaaaaatcttccgtgccatgtatgactatatggctgctgatgcagatgaggtgtccttcaaggatggagatgccatcataaatgttcaagcaa

SEQ ID NO: 5835 - DNA, 201 bp, Homo sapiens
atacgccagcacaacagatactccagaacttcgcagaatcaaaaaagtacaagatcaactcagtgaggttaagtatcgaatggatggtgatgttgctaagrctatatgtcacgtagatgaaaaagcaaaggatattgaacatgcaaagaaagtgtcgcagcaagtcagtaaggttttatacaagcagaactgggaagacac

SEQ ID NO: 5836 - DNA, 201 bp, Homo sapiens
  misc_feature (1)...(201): n = A,T,C or G, or insertion/deletion polymorphism (see Tables 1-2)
ggagaaggtcaagaaagcaggcgatgcattaaatgagaggaagtatcgacagcacccagataccgtcaagttcacaagtgtgcctgattccatgggcatgntgttggctcagcataacacaaagcagctaagtgatttgaactacaaggtagagggagagaaactgaagcacaagtatactattgaccctgaattgcctca

SEQ ID NO: 5837 - DNA, 201 bp, Homo sapiens
tgaacatgcaaagaaagtgtcgcagcaagtcagtaaggttttatacaagcagaactgggaagacaccaaggataagtacctgcttcctcctgatgcccctsaacttgtccaggccgttaagaacaccgccatgttcagcaagaaactgtacactgaagactgggaagcagacaaaagtttgttttacccctataatgatag

SEQ ID NO: 5838 - DNA, 201 bp, Homo sapiens
catccaggctaaagttaatgcctacaatatcagtgagaatatgtacaaagcagacttgaaagacttgagcaagaagggatatgacctgagaactgatgcgmttcccatcagagctgccaaagctgccaggcaggcggcgagtgacgttcagtacaaaaaagactatgaaaaggctaaagggaaaatggttggcttccaaag

SEQ ID NO: 5839 - DNA, 201 bp, Homo sapiens
gggcatcggatggatccctattggttccctggaggtggagaaggtcaagaaagcaggcgatgcattaaatgagaggaagtatcgacagcacccagataccrtcaagttcacaagtgtgcctgattccatgggcatgatgttggctcagcataacacaaagcagctaagtgatttgaactacaaggtagagggagagaaact

SEQ ID NO: 5840 - DNA, 201 bp, Homo sapiens
tgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaagaggctctacactgaaaaatggaacaaggacaagaccaccattc

SEQ ID NO: 5841 - DNA, 201 bp, Homo sapiens
atgcaggacttcagtgacattaactaccgaggtattcagaggaaagtggtagaaatggaacaaaaacggaatgaccaagatcaggagactattacaggttyacgtgtctggcgtactaatcctggttcggtttttgactatgatccagcagaagacaacatccagtcccgaagcttacacatgattaatgtccaagctcag

SEQ ID NO: 5842 - DNA, 201 bp, Homo sapiens
actggatatagacttccaggtgacactcctcacttcaaacacatcaaggacacccgttacatgagcagttatttcaagtacaaagaagcctatgaacacaycaaggcatatgggtatacacttggccccaaagatgttccatttgtccacgtccggagagtcaacaatgttaccagcgagagactgtatcgggaattgtac

SEQ ID NO: 5843 - DNA, 201 bp, Homo sapiens
ctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaagcatttatacacagaagcttgggat

SEQ ID NO: 5844 - DNA, 201 bp, Homo sapiens
ataaagacgagtataacagcttcttgaagggcatcggatggatccctattggttccctggaggtggagaaggtcaagaaagcaggcgatgcattaaatgasaggaagtatcgacagcacccagataccgtcaagttcacaagtgtgcctgattccatgggcatgatgttggctcagcataacacaaagcagctaagtgatt

SEQ ID NO: 5845 - DNA, 201 bp, Homo sapiens
cctgatgccattgcaataaaggctgcaagagcctctagagacattgccagtgattacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaag

SEQ ID NO: 5846 - DNA, 201 bp, Homo sapiens
aagcatgctgatctggtgaacagtgagcttaaatacaaagagacatatgagaagcagaaaggtcactacctggctggaaaagtgatcggtgaattccctgrtgtggttcactgtctggatttccaaaagatgaggagtgcgttgaactacagaaaacattatgaggataccaaagcaaatgttcatatccccaatgacatg

SEQ ID NO: 5847 - DNA, 201 bp, Homo sapiens
  misc_feature (1)...(201): n = A,T,C or G, or insertion/deletion polymorphism (see Tables 1-2)
gcccggaactgaggagagttgcccaggcccagaaagctctcagtgatgttgcctacaaaaaaggtctcgctgaacagcaagctcaattcacgcctctggcngatcctccagatatagaatttgccaagaaagtaaccaatcaagtgagcaagcaaaaatacaaagaagactatgaaaataaaatcaaaggcaaatggagtg

SEQ ID NO: 5848 - DNA, 201 bp, Homo sapiens
ccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgataatcagtacaaggctgactatgctgacttcatgaagggcattggatggc

SEQ ID NO: 5849 - DNA, 201 bp, Homo sapiens
gtgagcaagcaaaaatacaaagaagactatgaaaataaaatcaaaggcaaatggagtgagacaccttgctttgaagttgcaaatgccagaatgaatgctgrtaacattagcacagttaagaaataccaggaagattttgaaaacatgaaagaccagatctacttcatgcagaccgaaacaccagagtataaaatgaataaa

SEQ ID NO: 5850 - DNA, 201 bp, Homo sapiens
cctcgattgaagatgctccaattacagtacagtctaaaattaaccaggcccagaggagtgatatcgcttacaaagccaaaggagaggaaattattcacaawtacaacctgccaccagacctgccccagttcatccaggctaaagttaatgcctacaatatcagtgagaatatgtacaaagcagacttgaaagacttgagca

SEQ ID NO: 5851 - DNA, 201 bp, Homo sapiens
tggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaacatctctacaaacaagcatgggaggctgacaaaac

SEQ ID NO: 5852 - DNA, 201 bp, Homo sapiens
tccagcagaagacaacatccagtcccgaagcttacacatgattaatgtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacagcttacaa

SEQ ID NO: 5853 - DNA, 201 bp, Homo sapiens
gccaaaaataggagtgatagactttatagagaagcttgggacaaagacaagactcagatccacatcatgcctgatacacctgacattgttctggctaaagmaaacttaatcaacacaagtgataaactctaccgaatgggttatgaggagctgaagagaaaaggttacgatcttcctgttgatgccataccaatcaaagca

SEQ ID NO: 5854 - DNA, 201 bp, Homo sapiens
agatgcgagacaaatacaaagtggtgcttgacactccagaatacagaaaagtgcaagaactgaagacacatctgagtgagctggtctacagagctgcaggsaagaagcagaagtcaatctttacttcagttcctgatactcctgatcttttaagagccaagcgagggcagaagcttcagagtcagtatctgtatgttgaac

SEQ ID NO: 5855 - DNA, 201 bp, Homo sapiens
tatacacttggccccaaagatgttccatttgtccacgtccggagagtcaacaatgttaccagcgagagactgtatcgggaattgtaccacaaactgaaagwcaagatccatacaactcccgatacccctgagatccgccaagtcaagaagacacaagaggctgtcagtgagttgatctacaaatcagacttcttcaagatg

SEQ ID NO: 5856 - DNA, 201 bp, Homo sapiens
caagtgaattcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggcca

SEQ ID NO: 5857 - DNA, 201 bp, Homo sapiens
agtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgacgtcatccatgctcggcaggcctatgacctccagagcgataatatgt

SEQ ID NO: 5858 - DNA, 201 bp, Homo sapiens
agttcctcaagggttgcaagctttctgtcactgatgacaaaaacacggtgctcgccctcaggaatactttaatagaaagtgatctgaaatacaaagagaarcatgtcaaggaaagaggaacctgccatgccgtacctgacacgcctcagatcctgctggcgaagactgtcagcaacctggtgtctgagaacaagtacaagg

SEQ ID NO: 5859 - DNA, 201 bp, Homo sapiens
agaccaccattcatgtcatgcctgacacaccggatattttactctccagagtaaaccaaatcaccatgagtgataaactgtacaaagctggctgggaagargaaaagaagaaaggatatgacctgaggcctgatgccattgcaataaaggctgcaagagcctctagagacattgccagtgattacaaatacaagaaagcct

SEQ ID NO: 5860 - DNA, 201 bp, Homo sapiens
gttttggacaccccagagatacagagagtccgggagaaccaaaagaacttcagccttctccaataccagtgtgaccttaaaaacagtaaaggaaaaattayagttgttcaagacacgccagaaatactgcgtgtaaaagaaaatcagaagaatttcagctcggttttatataaagaggatgtctcaccaggaacggctatc

SEQ ID NO: 5861 - DNA, 201 bp, Homo sapiens
gaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatcgcctctataca

SEQ ID NO: 5862 - DNA, 201 bp, Homo sapiens
ctccccagttatggtccaggcaaaacagaacacgaagcaagtcagtgatatcttatacaaggctaaaggagaagatgtgaaacataaatacaccatgagtmctgatcttcctcagtttctccaggccaagtgcaatgcttacaatataagtgacgtctgttataaacgggattggcatgacttaatagccaagggcaacaa

SEQ ID NO: 5863 - DNA, 201 bp, Homo sapiens
agatacagagagtccgggagaaccaaaagaacttcagccttctccaataccagtgtgaccttaaaaacagtaaaggaaaaattacagttgttcaagacacrccagaaatactgcgtgtaaaagaaaatcagaagaatttcagctcggttttatataaagaggatgtctcaccaggaacggctatcggaaagacacctgaga

SEQ ID NO: 5864 - DNA, 201 bp, Homo sapiens
tgctgggggtggtgctggccaagaagtgccagaccttagtcagcgatgtggactacaagaactacctgcaccagtggacatgcctgcccgaccagagcgaygtcatccatgctcggcaggcctatgacctccagagcgataatatgtacaagtctgatctccagtggatgagaggcattggctgggtgtccattggctctt

SEQ ID NO: 5865 - DNA, 201 bp, Homo sapiens
ttggctggatcccactggattctgtggaccatgtaagggttactaagaaccaggaaatgatgagtcagatcaaatataagaaaaatgcccttgaaaactaycctaactttagaagtgtggtggatcctccagagattgttttagccaagattaattctgtcaatcaaagtgatgtaaaatataaagaaacatttaataaag

SEQ ID NO: 5866 - DNA, 201 bp, Homo sapiens
gtgtctatcggacgcctgtggtgaaccttaagtacacaagcattgttgacacacctgaagtggtccttgctaaatcaaatgctgaaaatattagtattccraagtacagagaggtttgggacaaggataaaacttcaatacacataatgccagatactccagaaattaatctcgctagagcaaatgctcttaatgtgagca

SEQ ID NO: 5867 - DNA, 201 bp, Homo sapiens
  misc_feature (1)...(201): n = A,T,C or G, or insertion/deletion polymorphism (see Tables 1-2)
tgtgaaacataaatacaccatgagtcctgatcttcctcagtttctccaggccaagtgcaatgcttacaatataagtgacgtctgttataaacgggattggnatgacttaatagccaagggcaacaatgtgctgggcgatgctattcccatcactgcagccaaggcatcgagaaacattgccagtgattataaatacaagga

SEQ ID NO: 5868 - DNA, 201 bp, Homo sapiens
cgacattatccaagcaaaaaaggcctatgacctgcagagtgatgccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacac

SEQ ID NO: 5869 - DNA, 201 bp, Homo sapiens
cagctgcaaagatggcccaggatgtcgctaccaatgtcaactacaaacagccattgcatcattacacatacctacctgacgccatgagtcttgagcatacsaggaatgtcaatcaaattcagagtgataatgtgtataaagacgagtataacagcttcttgaagggcatcggatggatccctattggttccctggaggtgg

SEQ ID NO: 5870 - DNA, 201 bp, Homo sapiens
ccctcatagctgacaagctccagaatgaacgagagtaccggctggactgggccaaatggaaggccaagatccagagccctgtggacatgctttccatcctrcactctaaaaattcccaggctctggtcagtgacatggattaccgcaattacctgcaccagtggacctgcatgcccgaccagaacgatgtgattcaggcca

SEQ ID NO: 5871 - DNA, 201 bp, Homo sapiens
ccactggattctgtggaccatgtaagggttactaagaaccaggaaatgatgagtcagatcaaatataagaaaaatgcccttgaaaactatcctaactttasaagtgtggtggatcctccagagattgttttagccaagattaattctgtcaatcaaagtgatgtaaaatataaagaaacatttaataaagcaaagggcaaa

SEQ ID NO: 5872 - DNA, 201 bp, Homo sapiens
gttttagccaagattaattctgtcaatcaaagtgatgtaaaatataaagaaacatttaataaagcaaagggcaaatatacgttttcaccagatacaccacrtatctcccactccaaagacatgggaaaactctacagtactatactgtataaaggggcgtgggagggcaccaaggcctatggctacaccctggatgagcgc

SEQ ID NO: 5873 - DNA, 201 bp, Homo sapiens
tacaccacatatctcccactccaaagacatgggaaaactctacagtactatactgtataaaggggcgtgggagggcaccaaggcctatggctacaccctgratgagcgctacattcccattgttggagccaagcatgctgatctggtgaacagtgagcttaaatacaaagagacatatgagaagcagaaaggtcactacct

SEQ ID NO: 5874 - DNA, 201 bp, Homo sapiens
gcccatcactgcaatgacgttcagagtgagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgat

SEQ ID NO: 5875 - DNA, 201 bp, Homo sapiens
  misc_feature (1)...(201): n = A,T,C or G, or insertion/deletion polymorphism (see Tables 1-2)
cgaccagagcgacgtcatccatgctcggcaggcctatgacctccagagcgataatatgtacaagtctgatctccagtggatgagaggcattggctgggtgnccattggctctttggatgtggaaaaatgcaaaagggcaactgaaattttgagtgataaaatctatcgccagcctccagacagattcaaatttaccagtgt

SEQ ID NO: 5876 - DNA, 201 bp, Homo sapiens
tatgaactgcaaagtgagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagaca

SEQ ID NO: 5877 - DNA, 201 bp, Homo sapiens; identical to SEQ ID NO: 5841

SEQ ID NO: 5878 - DNA, 201 bp, Homo sapiens; identical to SEQ ID NO: 5831
  misc_feature (1)...(201): n = A,T,C or G, or insertion/deletion polymorphism (see Tables 1-2)

SEQ ID NO: 5879 - DNA, 201 bp, Homo sapiens; identical to SEQ ID NO: 5832

SEQ ID NO: 5880 - DNA, 201 bp, Homo sapiens; identical to SEQ ID NO: 5833

SEQ ID NO: 5881 - DNA, 201 bp, Homo sapiens; identical to SEQ ID NO: 5858

SEQ ID NO: 5882 - DNA, 201 bp, Homo sapiens; identical to SEQ ID NO: 5834

SEQ ID NO: 5883 - DNA, 201 bp, Homo sapiens
cccaacacctatcactccagagatggagagagtcaaacgcaatcaagagaactttagctcggtgttatacaaagaaaacatgggcaagggaactcctttasctgtcactcccgagatggagcgagtcaaacacaatcaagaaaatattagctcggttttgtacaaagaaaatgtggggaaagccaccgcaacccctgtcac

SEQ ID NO: 5884 - DNA, 201 bp, Homo sapiens; identical to SEQ ID NO: 5860

SEQ ID NO: 5885 - DNA, 201 bp, Homo sapiens; identical to SEQ ID NO: 5863

SEQ ID NO: 5886 - DNA, 201 bp, Homo sapiens; identical to SEQ ID NO: 5852

SEQ ID NO: 5887 - DNA, 201 bp, Homo sapiens; identical to SEQ ID NO: 5828

SEQ ID NO: 5888 - DNA, 201 bp, Homo sapiens; identical to SEQ ID NO: 5829

SEQ ID NO: 5889 - DNA, 201 bp, Homo sapiens; identical to SEQ ID NO: 5830

SEQ ID NO: 5890 - DNA, 201 bp, Homo sapiens; identical to SEQ ID NO: 5831
  misc_feature (1)...(201): n = A,T,C or G, or insertion/deletion polymorphism (see Tables 1-2)

SEQ ID NO: 5891 - DNA, 201 bp, Homo sapiens; identical to SEQ ID NO: 5832

SEQ ID NO: 5892 - DNA, 201 bp, Homo sapiens; identical to SEQ ID NO: 5833

SEQ ID NO: 5893 - DNA, 201 bp, Homo sapiens; identical to SEQ ID NO: 5834

SEQ ID NO: 5894 - DNA, 201 bp, Homo sapiens; identical to SEQ ID NO: 5835

SEQ ID NO: 5895 - DNA, 201 bp, Homo sapiens; identical to SEQ ID NO: 5836
  misc_feature (1)...(201): n = A,T,C or G, or insertion/deletion polymorphism (see Tables 1-2)

SEQ ID NO: 5896 - DNA, 201 bp, Homo sapiens; identical to SEQ ID NO: 5837

SEQ ID NO: 5897 - DNA, 201 bp, Homo sapiens; identical to SEQ ID NO: 5838

SEQ ID NO: 5898 - DNA, 201 bp, Homo sapiens; identical to SEQ ID NO: 5839

SEQ ID NO: 5899 - DNA, 201 bp, Homo sapiens; identical to SEQ ID NO: 5840

SEQ ID NO: 5900 - DNA, 201 bp, Homo sapiens; identical to SEQ ID NO: 5841

SEQ ID NO: 5901 - DNA, 201 bp, Homo sapiens; identical to SEQ ID NO: 5842

SEQ ID NO: 5902 - DNA, 201 bp, Homo sapiens; identical to SEQ ID NO: 5843

SEQ ID NO: 5903 - DNA, 201 bp, Homo sapiens; identical to SEQ ID NO: 5844

SEQ ID NO: 5904 - DNA, 201 bp, Homo sapiens; identical to SEQ ID NO: 5845

SEQ ID NO: 5905 - DNA, 201 bp, Homo sapiens; identical to SEQ ID NO: 5846

SEQ ID NO: 5906 - DNA, 201 bp, Homo sapiens; identical to SEQ ID NO: 5847
  misc_feature (1)...(201): n = A,T,C or G, or insertion/deletion polymorphism (see Tables 1-2)

SEQ ID NO: 5907 - DNA, 201 bp, Homo sapiens; identical to SEQ ID NO: 5848

SEQ ID NO: 5908 - DNA, 201 bp, Homo sapiens
gtgagcaagcaaaaatacaaagaagactatgaaaataaaatcaaaggcaaatggagtgagacaccttgctttgaagttgcaaatgccagaatgaatgctgrtaacattagcacaaggaaataccaggaagattttgaaaacatgaaagaccagatctacttcatgcagaccgaaacaccagagtataaaatgaataaaaaa

SEQ ID NO: 5909 - DNA, 201 bp, Homo sapiens; identical to SEQ ID NO: 5850

SEQ ID NO: 5910 - DNA, 201 bp, Homo sapiens; identical to SEQ ID NO: 5851

SEQ ID NO: 5911 - DNA, 201 bp, Homo sapiens; identical to SEQ ID NO: 5852

SEQ ID NO: 5912 - DNA, 201 bp, Homo sapiens; identical to SEQ ID NO: 5853

SEQ ID NO: 5913 - DNA, 201 bp, Homo sapiens; identical to SEQ ID NO: 5854

SEQ ID NO: 5914 - DNA, 201 bp, Homo sapiens; identical to SEQ ID NO: 5855

SEQ ID NO: 5915 - DNA, 201 bp, Homo sapiens; identical to SEQ ID NO: 5856

SEQ ID NO: 5916 - DNA, 201 bp, Homo sapiens; identical to SEQ ID NO: 5857

SEQ ID NO: 5917 - DNA, 201 bp, Homo sapiens; identical to SEQ ID NO: 5858

SEQ ID NO: 5918 - DNA, 201 bp, Homo sapiens; identical to SEQ ID NO: 5859

SEQ ID NO: 5919 - DNA, 201 bp, Homo sapiens; identical to SEQ ID NO: 5860

SEQ ID NO: 5920 - DNA, 201 bp, Homo sapiens; identical to SEQ ID NO: 5861

SEQ ID NO: 5921 - DNA, 201 bp, Homo sapiens; identical to SEQ ID NO: 5862

SEQ ID NO: 5922 - DNA, 201 bp, Homo sapiens; identical to SEQ ID NO: 5863

SEQ ID NO: 5923 - DNA, 201 bp, Homo sapiens; identical to SEQ ID NO: 5864

SEQ ID NO: 5924 - DNA, 201 bp, Homo sapiens; identical to SEQ ID NO: 5865

SEQ ID NO: 5925 - DNA, 201 bp, Homo sapiens; identical to SEQ ID NO: 5866

SEQ ID NO: 5926 - DNA, 201 bp, Homo sapiens; identical to SEQ ID NO: 5867
  misc_feature (1)...(201): n = A,T,C or G, or insertion/deletion polymorphism (see Tables 1-2)

SEQ ID NO: 5927 - DNA, 201 bp, Homo sapiens; identical to SEQ ID NO: 5868

SEQ ID NO: 5928 - DNA, 201 bp, Homo sapiens; identical to SEQ ID NO: 5869

SEQ ID NO: 5929 - DNA, 201 bp, Homo sapiens; identical to SEQ ID NO: 5870

SEQ ID NO: 5930 - DNA, 201 bp, Homo sapiens; identical to SEQ ID NO: 5871

SEQ ID NO: 5931 - DNA, 201 bp, Homo sapiens; identical to SEQ ID NO: 5872

SEQ ID NO: 5932 - DNA, 201 bp, Homo sapiens; identical to SEQ ID NO: 5873

SEQ ID NO: 5933 - DNA, 201 bp, Homo sapiens; identical to SEQ ID NO: 5874

SEQ ID NO: 5934 - DNA, 201 bp, Homo sapiens; identical to SEQ ID NO: 5875
  misc_feature (1)...(201): n = A,T,C or G, or insertion/deletion polymorphism (see Tables 1-2)

SEQ ID NO: 5935 - DNA, 201 bp, Homo sapiens; identical to SEQ ID NO: 5876

SEQ ID NO: 5936 - DNA, 201 bp, Homo sapiens; identical to SEQ ID NO: 5828

SEQ ID NO: 5937 - DNA, 201 bp, Homo sapiens; identical to SEQ ID NO: 5829

SEQ ID NO: 5938 - DNA, 201 bp, Homo sapiens; identical to SEQ ID NO: 5830

SEQ ID NO: 5939 - DNA, 201 bp, Homo sapiens; identical to SEQ ID NO: 5831
  misc_feature (1)...(201): n = A,T,C or G, or insertion/deletion polymorphism (see Tables 1-2)

SEQ ID NO: 5940 - DNA, 201 bp, Homo sapiens; identical to SEQ ID NO: 5832

SEQ ID NO: 5941 - DNA, 201 bp, Homo sapiens; identical to SEQ ID NO: 5833

SEQ ID NO: 5942 - DNA, 201 bp, Homo sapiens
cagcttacaaacatgcaaaaaccacagagctcccacaacaacgatcatcttcagttgctacccaacagacaacggtatcttccatcccatctcatccatckactgctggaagacagggtctcactctatcacccaggctgcagtgtggtggcatgatcacagctcgctgcagtctcgacttcatggactcaagcaatcctc

SEQ ID NO: 5943 - DNA, 201 bp, Homo sapiens; identical to SEQ ID NO: 5836
  misc_feature (1)...(201): n = A,T,C or G, or insertion/deletion polymorphism (see Tables 1-2)

SEQ ID NO: 5944 - DNA, 201 bp, Homo sapiens; identical to SEQ ID NO: 5838

SEQ ID NO: 5945 - DNA, 201 bp, Homo sapiens; identical to SEQ ID NO: 5839

SEQ ID NO: 5946 - DNA, 201 bp, Homo sapiens; identical to SEQ ID NO: 5840

SEQ ID NO: 5947 - DNA, 201 bp, Homo sapiens; identical to SEQ ID NO: 5841

SEQ ID NO: 5948 - DNA, 201 bp, Homo sapiens; identical to SEQ ID NO: 5842

SEQ ID NO: 5949 - DNA, 201 bp, Homo sapiens; identical to SEQ ID NO: 5843

SEQ ID NO: 5950 - DNA, 201 bp, Homo sapiens; identical to SEQ ID NO: 5844

SEQ ID NO: 5951 - DNA, 201 bp, Homo sapiens; identical to SEQ ID NO: 5845

SEQ ID NO: 5952 - DNA, 201 bp, Homo sapiens; identical to SEQ ID NO: 5846

SEQ ID NO: 5953 - DNA, 201 bp, Homo sapiens; identical to SEQ ID NO: 5848

SEQ ID NO: 5954 - DNA, 177 bp, Homo sapiens
gactatgaaaataaaatcaaaggcaaatggagtgagacaccttgctttgaagttgcaaatgccagaatgaatgctgrtaacattagcacagttaagaaataccaggaagattttgaaaacatgaaagaccagatctacttcatgcagaccgaaacaccagagtataaaatgaataaa

SEQ ID NO: 5955 - DNA, 201 bp, Homo sapiens; identical to SEQ ID NO: 5850

SEQ ID NO: 5956 - DNA, 201 bp, Homo sapiens; identical to SEQ ID NO: 5851

SEQ ID NO: 5957 - DNA, 201 bp, Homo sapiens; identical to SEQ ID NO: 5852

SEQ ID NO: 5958 - DNA, 201 bp, Homo sapiens; identical to SEQ ID NO: 5853

SEQ ID NO: 5959 - DNA, 201 bp, Homo sapiens; identical to SEQ ID NO: 5854

SEQ ID NO: 5960 - DNA, 201 bp, Homo sapiens; identical to SEQ ID NO: 5855

SEQ ID NO: 5961 - DNA, 201 bp, Homo sapiens; identical to SEQ ID NO: 5856

SEQ ID NO: 5962 - DNA, 201 bp, Homo sapiens; identical to SEQ ID NO: 5857

SEQ ID NO: 5963 - DNA, 201 bp, Homo sapiens; identical to SEQ ID NO: 5858

SEQ ID NO: 5964 - DNA, 201 bp, Homo sapiens; identical to SEQ ID NO: 5859

SEQ ID NO: 5965 - DNA, 201 bp, Homo sapiens
ccctctacctgtcactcctgagatggagagagtcaaacacaatcaagaaaatattagctcggtgttatacaaagaaaacatgggcaagggaactcctttasctgtcactcccgagatggagcgagtcaaacacaatcaagaaaatattagctcggttttgtacaaagaaaatgtggggaaagccaccgcaacccctgtcac

SEQ ID NO: 5966 - DNA, 201 bp, Homo sapiens; identical to SEQ ID NO: 5860

SEQ ID NO: 5967 - DNA, 201 bp, Homo sapiens; identical to SEQ ID NO: 5861

SEQ ID NO: 5968 - DNA, 201 bp, Homo sapiens; identical to SEQ ID NO: 5862

SEQ ID NO: 5969 - DNA, 201 bp, Homo sapiens; identical to SEQ ID NO: 5863

SEQ ID NO: 5970 - DNA, 201 bp, Homo sapiens; identical to SEQ ID NO: 5864

SEQ ID NO: 5971 - DNA, 201 bp, Homo sapiens; identical to SEQ ID NO: 5865

SEQ ID NO: 5972 - DNA, 201 bp, Homo sapiens; identical to SEQ ID NO: 5866

SEQ ID NO: 5973 - DNA, 201 bp, Homo sapiens; identical to SEQ ID NO: 5867
  misc_feature (1)...(201): n = A,T,C or G, or insertion/deletion polymorphism (see Tables 1-2)

SEQ ID NO: 5974 - DNA, 201 bp, Homo sapiens; identical to SEQ ID NO: 5868

SEQ ID NO: 5975 - DNA, 201 bp, Homo sapiens; identical to SEQ ID NO: 5869

SEQ ID NO: 5976 - DNA, 201 bp, Homo sapiens; identical to SEQ ID NO: 5870

SEQ ID NO: 5977 - DNA, 201 bp, Homo sapiens; identical to SEQ ID NO: 5871

SEQ ID NO: 5978 - DNA, 201 bp, Homo sapiens; identical to SEQ ID NO: 5872

SEQ ID NO: 5979 - DNA, 201 bp, Homo sapiens; identical to SEQ ID NO: 5873

SEQ ID NO: 5980 - DNA, 201 bp, Homo sapiens; identical to SEQ ID NO: 5874

SEQ ID NO: 5981 - DNA, 201 bp, Homo sapiens; identical to SEQ ID NO: 5875
  misc_feature (1)...(201): n = A,T,C or G, or insertion/deletion polymorphism (see Tables 1-2)

SEQ ID NO: 5982 - DNA, 201 bp, Homo sapiens; identical to SEQ ID NO: 5876

SEQ ID NO: 5983 - DNA, 201 bp, Homo sapiens; identical to SEQ ID NO: 5828

SEQ ID NO: 5984 - DNA, 201 bp, Homo sapiens; identical to SEQ ID NO: 5829

SEQ ID NO: 5985 - DNA, 201 bp, Homo sapiens; identical to SEQ ID NO: 5830

SEQ ID NO: 5986 - DNA, 201 bp, Homo sapiens; identical to SEQ ID NO: 5831
  misc_feature (1)...(201): n = A,T,C or G, or insertion/deletion polymorphism (see Tables 1-2)

SEQ ID NO: 5987 - DNA, 201 bp, Homo sapiens; identical to SEQ ID NO: 5832

SEQ ID NO: 5988 - DNA, 201 bp, Homo sapiens; identical to SEQ ID NO: 5833

SEQ ID NO: 5989 - DNA, 201 bp, Homo sapiens; identical to SEQ ID NO: 5942

SEQ ID NO: 5990 - DNA, 201 bp, Homo sapiens; identical to SEQ ID NO: 5835

SEQ ID NO: 5991 - DNA, 201 bp, Homo sapiens; identical to SEQ ID NO: 5836
  misc_feature (1)...(201): n = A,T,C or G, or insertion/deletion polymorphism (see Tables 1-2)

SEQ ID NO: 5992 - DNA, 201 bp, Homo sapiens; identical to SEQ ID NO: 5837

SEQ ID NO: 5993 - DNA, 201 bp, Homo sapiens; identical to SEQ ID NO: 5838

SEQ ID NO: 5994 - DNA, 201 bp, Homo sapiens; identical to SEQ ID NO: 5839

SEQ ID NO: 5995 - DNA, 201 bp, Homo sapiens; identical to SEQ ID NO: 5840

SEQ ID NO: 5996 - DNA, 201 bp, Homo sapiens; identical to SEQ ID NO: 5841

SEQ ID NO: 5997 - DNA, 201 bp, Homo sapiens; identical to SEQ ID NO: 5842

SEQ ID NO: 5998 - DNA, 201 bp, Homo sapiens; identical to SEQ ID NO: 5843

SEQ ID NO: 5999 - DNA, 201 bp, Homo sapiens; identical to SEQ ID NO: 5844

SEQ ID NO: 6000 - DNA, 201 bp, Homo sapiens; identical to SEQ ID NO: 5845

SEQ ID NO: 6001 - DNA, 201 bp, Homo sapiens; identical to SEQ ID NO: 5846

SEQ ID NO: 6002 - DNA, 201 bp, Homo sapiens; identical to SEQ ID NO: 5847
  misc_feature (1)...(201): n = A,T,C or G, or insertion/deletion polymorphism (see Tables 1-2)

SEQ ID NO: 6003 - DNA, 201 bp, Homo sapiens; identical to SEQ ID NO: 5848

SEQ ID NO: 6004 - DNA, 201 bp, Homo sapiens; identical to SEQ ID NO: 5908

SEQ ID NO: 6005 - DNA, 201 bp, Homo sapiens; identical to SEQ ID NO: 5850

SEQ ID NO: 6006 - DNA, 201 bp, Homo sapiens; identical to SEQ ID NO: 5851

SEQ ID NO: 6007 - DNA, 201 bp, Homo sapiens; identical to SEQ ID NO: 5852

SEQ ID NO: 6008 - DNA, 201 bp, Homo sapiens; identical to SEQ ID NO: 5853

SEQ ID NO: 6009 - DNA, 201 bp, Homo sapiens; identical to SEQ ID NO: 5854

SEQ ID NO: 6010 - DNA, 201 bp, Homo sapiens; identical to SEQ ID NO: 5855

SEQ ID NO: 6011 - DNA, 201 bp, Homo sapiens; identical to SEQ ID NO: 5856

SEQ ID NO: 6012 - DNA, 201 bp, Homo sapiens; identical to SEQ ID NO: 5857

SEQ ID NO: 6013 - DNA, 201 bp, Homo sapiens; identical to SEQ ID NO: 5858

SEQ ID NO: 6014 - DNA, 201 bp, Homo sapiens; identical to SEQ ID NO: 5859

SEQ ID NO: 6015 - DNA, 201 bp, Homo sapiens; identical to SEQ ID NO: 5965

SEQ ID NO: 6016 - DNA, 201 bp, Homo sapiens
gtggttgatactccagagatcattcatgcccaacaagtcaagaatctttcaagccagctccaataccagtgtgaccttaaaaacagtaaaggaaaaattayagttgttcaagacacgccagaaatactgcgtgtaaaagaaaatcagaagaatttcagctcggttttatataaagaggatgtctcaccaggaacggctatc

SEQ ID NO: 6017 - DNA, 201 bp, Homo sapiens; identical to SEQ ID NO: 5861

SEQ ID NO: 6018 - DNA, 201 bp, Homo sapiens; identical to SEQ ID NO: 5862

SEQ ID NO: 6019 - DNA, 201 bp, Homo sapiens
agatcattcatgcccaacaagtcaagaatctttcaagccagctccaataccagtgtgaccttaaaaacagtaaaggaaaaattacagttgttcaagacacrccagaaatactgcgtgtaaaagaaaatcagaagaatttcagctcggttttatataaagaggatgtctcaccaggaacggctatcggaaagacacctgaga

SEQ ID NO: 6020 - DNA, 201 bp, Homo sapiens; identical to SEQ ID NO: 5864

SEQ ID NO: 6021 - DNA, 201 bp, Homo sapiens; identical to SEQ ID NO: 5865

SEQ ID NO: 6022 - DNA, 201 bp, Homo sapiens; identical to SEQ ID NO: 5866

SEQ ID NO: 6023 - DNA, 201 bp, Homo sapiens; identical to SEQ ID NO: 5867
  misc_feature (1)...(201): n = A,T,C or G, or insertion/deletion polymorphism (see Tables 1-2)

SEQ ID NO: 6024 - DNA, 201 bp, Homo sapiens; identical to SEQ ID NO: 5868

SEQ ID NO: 6025 - DNA, 201 bp, Homo sapiens; identical to SEQ ID NO: 5869

SEQ ID NO: 6026 - DNA, 201 bp, Homo sapiens; identical to SEQ ID NO: 5870

SEQ ID NO: 6027 - DNA, 201 bp, Homo sapiens; identical to SEQ ID NO: 5871

SEQ ID NO: 6028 - DNA, 201 bp, Homo sapiens; identical to SEQ ID NO: 5872

SEQ ID NO: 6029 - DNA, 201 bp, Homo sapiens; identical to SEQ ID NO: 5873

SEQ ID NO: 6030 - DNA, 201 bp, Homo sapiens; identical to SEQ ID NO: 5874

SEQ ID NO: 6031 - DNA, 201 bp, Homo sapiens; identical to SEQ ID NO: 5875
  misc_feature (1)...(201): n = A,T,C or G, or insertion/deletion polymorphism (see Tables 1-2)

SEQ ID NO: 6032 - DNA, 201 bp, Homo sapiens; identical to SEQ ID NO: 5876

SEQ ID NO: 6033 - DNA, 201 bp, Homo sapiens; identical to SEQ ID NO: 5854

SEQ ID NO: 6034 - DNA, 201 bp, Homo sapiens; identical to SEQ ID NO: 5855

SEQ ID NO: 6035 - DNA, 201 bp, Homo sapiens; identical to SEQ ID NO: 5830

SEQ ID NO: 6036 - DNA, 201 bp, Homo sapiens; identical to SEQ ID NO: 5831
  misc_feature (1)...(201): n = A,T,C or G, or insertion/deletion polymorphism (see Tables 1-2)

SEQ ID NO: 6037 - DNA, 201 bp, Homo sapiens; identical to SEQ ID NO: 5832

SEQ ID NO: 6038 - DNA, 201 bp, Homo sapiens; identical to SEQ ID NO: 5858

SEQ ID NO: 6039 - DNA, 201 bp, Homo sapiens; identical to SEQ ID NO: 5833

SEQ ID NO: 6040 - DNA, 201 bp, Homo sapiens; identical to SEQ ID NO: 5834

SEQ ID NO: 6041 - DNA, 201 bp, Homo sapiens; identical to SEQ ID NO: 5860

SEQ ID NO: 6042 - DNA, 201 bp, Homo sapiens; identical to SEQ ID NO: 5863

SEQ ID NO: 6043 - DNA, 201 bp, Homo sapiens; identical to SEQ ID NO: 5865

SEQ ID NO: 6044 - DNA, 201 bp, Homo sapiens; identical to SEQ ID NO: 5866

SEQ ID NO: 6045 - DNA, 201 bp, Homo sapiens; identical to SEQ ID NO: 5841

SEQ ID NO: 6046 - DNA, 201 bp, Homo sapiens; identical to SEQ ID NO: 5842

SEQ ID NO: 6047 - DNA, 201 bp, Homo sapiens
tgatgtgatccaagccaggaaagcctacgacctacagagcgacgccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacac

SEQ ID NO: 6048 - DNA, 201 bp, Homo sapiens; identical to SEQ ID NO: 5870

SEQ ID NO: 6049 - DNA, 201 bp, Homo sapiens; identical to SEQ ID NO: 5871

SEQ ID NO: 6050 - DNA, 201 bp, Homo sapiens; identical to SEQ ID NO: 5872

SEQ ID NO: 6051 - DNA, 201 bp, Homo sapiens; identical to SEQ ID NO: 5846

SEQ ID NO: 6052 - DNA, 201 bp, Homo sapiens; identical to SEQ ID NO: 5873

SEQ ID NO: 6053 - DNA, 201 bp, Homo sapiens; identical to SEQ ID NO: 5874

SEQ ID NO: 6054 - DNA, 201 bp, Homo sapiens; identical to SEQ ID NO: 5852

SEQ ID NO: 6055 - DNA, 201 bp, Homo sapiens; identical to SEQ ID NO: 5828

SEQ ID NO: 6056 - DNA, 201 bp, Homo sapiens; identical to SEQ ID NO: 5829

SEQ ID NO: 6057 - DNA, 201 bp, Homo sapiens; identical to SEQ ID NO: 5830

SEQ ID NO: 6058 - DNA, 201 bp, Homo sapiens; identical to SEQ ID NO: 5831
  misc_feature (1)...(201): n = A,T,C or G, or insertion/deletion polymorphism (see Tables 1-2)

SEQ ID NO: 6059 - DNA, 201 bp, Homo sapiens; identical to SEQ ID NO: 5832

SEQ ID NO: 6060 - DNA, 201 bp, Homo sapiens; identical to SEQ ID NO: 5833

SEQ ID NO: 6061 - DNA, 201 bp, Homo sapiens; identical to SEQ ID NO: 5834

SEQ ID NO: 6062 - DNA, 201 bp, Homo sapiens; identical to SEQ ID NO: 5835

SEQ ID NO: 6063 - DNA, 201 bp, Homo sapiens; identical to SEQ ID NO: 5836
  misc_feature (1)...(201): n = A,T,C or G, or insertion/deletion polymorphism (see Tables 1-2)

SEQ ID NO: 6064 - DNA, 201 bp, Homo sapiens; identical to SEQ ID NO: 5837

SEQ ID NO: 6065 - DNA, 201 bp, Homo sapiens; identical to SEQ ID NO: 5838

SEQ ID NO: 6066 - DNA, 201 bp, Homo sapiens; identical to SEQ ID NO: 5839

SEQ ID NO: 6067 - DNA, 201 bp, Homo sapiens; identical to SEQ ID NO: 5840

SEQ ID NO: 6068 - DNA, 201 bp, Homo sapiens; identical to SEQ ID NO: 5841

SEQ ID NO: 6069 - DNA, 201 bp, Homo sapiens; identical to SEQ ID NO: 5842

SEQ ID NO: 6070 - DNA, 201 bp, Homo sapiens; identical to SEQ ID NO: 5843

SEQ ID NO: 6071 - DNA, 201 bp, Homo sapiens; identical to SEQ ID NO: 5844

SEQ ID NO: 6072 - DNA, 201 bp, Homo sapiens; identical to SEQ ID NO: 5845

SEQ ID NO: 6073 - DNA, 201 bp, Homo sapiens; identical to SEQ ID NO: 5846

SEQ ID NO: 6074 - DNA, 201 bp, Homo sapiens; identical to SEQ ID NO: 5847
  misc_feature (1)...(201): n = A,T,C or G, or insertion/deletion polymorphism (see Tables 1-2)

SEQ ID NO: 6075 - DNA, 201 bp, Homo sapiens; identical to SEQ ID NO: 5848

SEQ ID NO: 6076 - DNA, 201 bp, Homo sapiens; identical to SEQ ID NO: 5908

SEQ ID NO: 6077 - DNA, 201 bp, Homo sapiens; identical to SEQ ID NO: 5850

SEQ ID NO: 6078 - DNA, 201 bp, Homo sapiens; identical to SEQ ID NO: 5851

SEQ ID NO: 6079 - DNA, 201 bp, Homo sapiens; identical to SEQ ID NO: 5852

SEQ ID NO: 6080 - DNA, 201 bp, Homo sapiens; identical to SEQ ID NO: 5853

SEQ ID NO: 6081 - DNA, 201 bp, Homo sapiens; identical to SEQ ID NO: 5854

SEQ ID NO: 6082 - DNA, 201 bp, Homo sapiens; identical to SEQ ID NO: 5855

SEQ ID NO: 6083 - DNA, 201 bp, Homo sapiens; identical to SEQ ID NO: 5856

SEQ ID NO: 6084 - DNA, 201 bp, Homo sapiens; identical to SEQ ID NO: 5857

SEQ ID NO: 6085 - DNA, 201 bp, Homo sapiens; identical to SEQ ID NO: 5858

SEQ ID NO: 6086 - DNA, 201 bp, Homo sapiens; identical to SEQ ID NO: 5859

SEQ ID NO: 6087 - DNA, 201 bp, Homo sapiens; identical to SEQ ID NO: 5883

SEQ ID NO: 6088 - DNA, 201 bp, Homo sapiens; identical to SEQ ID NO: 5860

SEQ ID NO: 6089 - DNA, 201 bp, Homo sapiens; identical to SEQ ID NO: 5861

SEQ ID NO: 6090 - DNA, 201 bp, Homo sapiens; identical to SEQ ID NO: 5862

SEQ ID NO: 6091 - DNA, 201 bp, Homo sapiens; identical to SEQ ID NO: 5863

SEQ ID NO: 6092 - DNA, 201 bp, Homo sapiens; identical to SEQ ID NO: 5864

SEQ ID NO: 6093 - DNA, 201 bp, Homo sapiens; identical to SEQ ID NO: 5865

SEQ ID NO: 6094 - DNA, 201 bp, Homo sapiens; identical to SEQ ID NO: 5866

SEQ ID NO: 6095 - DNA, 201 bp, Homo sapiens; identical to SEQ ID NO: 5867
  misc_feature (1)...(201): n = A,T,C or G, or insertion/deletion polymorphism (see Tables 1-2)

SEQ ID NO: 6096 - DNA, 201 bp, Homo sapiens; identical to SEQ ID NO: 5868

SEQ ID NO: 6097 - DNA, 201 bp, Homo sapiens; identical to SEQ ID NO: 5869

SEQ ID NO: 6098 - DNA, 201 bp, Homo sapiens; identical to SEQ ID NO: 5870

SEQ ID NO: 6099 - DNA, 201 bp, Homo sapiens; identical to SEQ ID NO: 5871

SEQ ID NO: 6100 - DNA, 201 bp, Homo sapiens; identical to SEQ ID NO: 5872

SEQ ID NO: 6101 - DNA, 201 bp, Homo sapiens; identical to SEQ ID NO: 5873

SEQ ID NO: 6102 - DNA, 201 bp, Homo sapiens; identical to SEQ ID NO: 5874

SEQ ID NO: 6103 - DNA, 201 bp, Homo sapiens; identical to SEQ ID NO: 5875
  misc_feature (1)...(201): n = A,T,C or G, or insertion/deletion polymorphism (see Tables 1-2)

SEQ ID NO: 6104 - DNA, 201 bp, Homo sapiens; identical to SEQ ID NO: 5876

SEQ ID NO: 6105 - DNA, 201 bp, Homo sapiens; identical to SEQ ID NO: 5828

SEQ ID NO: 6106 - DNA, 201 bp, Homo sapiens; identical to SEQ ID NO: 5829

SEQ ID NO: 6107 - DNA, 201 bp, Homo sapiens; identical to SEQ ID NO: 5830

SEQ ID NO: 6108 - DNA, 201 bp, Homo sapiens; identical to SEQ ID NO: 5831
  misc_feature (1)...(201): n = A,T,C or G, or insertion/deletion polymorphism (see Tables 1-2)

SEQ ID NO: 6109 - DNA, 201 bp, Homo sapiens; identical to SEQ ID NO: 5832

SEQ ID NO: 6110 - DNA, 201 bp, Homo sapiens; identical to SEQ ID NO: 5833

SEQ ID NO: 6111 - DNA, 201 bp, Homo sapiens; identical to SEQ ID NO: 5834

SEQ ID NO: 6112 - DNA, 201 bp, Homo sapiens; identical to SEQ ID NO: 5835

SEQ ID NO: 6113 - DNA, 201 bp, Homo sapiens; identical to SEQ ID NO: 5836
  misc_feature (1)...(201): n = A,T,C or G, or insertion/deletion polymorphism (see Tables 1-2)

SEQ ID NO: 6114 - DNA, 201 bp, Homo sapiens; identical to SEQ ID NO: 5837

SEQ ID NO: 6115 - DNA, 201 bp, Homo sapiens; identical to SEQ ID NO: 5838

SEQ ID NO: 6116 - DNA, 201 bp, Homo sapiens; identical to SEQ ID NO: 5839

SEQ ID NO: 6117 - DNA, 201 bp, Homo sapiens; identical to SEQ ID NO: 5840

SEQ ID NO: 6118 - DNA, 201 bp, Homo sapiens; identical to SEQ ID NO: 5841

SEQ ID NO: 6119 - DNA, 201 bp, Homo sapiens; identical to SEQ ID NO: 5842

SEQ ID NO: 6120 - DNA, 201 bp, Homo sapiens; identical to SEQ ID NO: 5843

SEQ ID NO: 6121 - DNA, 201 bp, Homo sapiens; identical to SEQ ID NO: 5844

SEQ ID NO: 6122 - DNA, 201 bp, Homo sapiens; identical to SEQ ID NO: 5845

SEQ ID NO: 6123 - DNA, 201 bp, Homo sapiens; identical to SEQ ID NO: 5846

SEQ ID NO: 6124 - DNA, 201 bp, Homo sapiens; identical to SEQ ID NO: 5847
  misc_feature (1)...(201): n = A,T,C or G, or insertion/deletion polymorphism (see Tables 1-2)

SEQ ID NO: 6125 - DNA, 201 bp, Homo sapiens; identical to SEQ ID NO: 5848

SEQ ID NO: 6126 - DNA, 201 bp, Homo sapiens; identical to SEQ ID NO: 5908

SEQ ID NO: 6127 - DNA, 201 bp, Homo sapiens; identical to SEQ ID NO: 5850

SEQ ID NO: 6128 - DNA, 201 bp, Homo sapiens; identical to SEQ ID NO: 5851

SEQ ID NO: 6129 - DNA, 201 bp, Homo sapiens; identical to SEQ ID NO: 5852

SEQ ID NO: 6130 - DNA, 201 bp, Homo sapiens; identical to SEQ ID NO: 5853

SEQ ID NO: 6131 - DNA, 201 bp, Homo sapiens; identical to SEQ ID NO: 5854

SEQ ID NO: 6132 - DNA, 201 bp, Homo sapiens; identical to SEQ ID NO: 5855

SEQ ID NO: 6133 - DNA, 201 bp, Homo sapiens; identical to SEQ ID NO: 5856

SEQ ID NO: 6134 - DNA, 201 bp, Homo sapiens; identical to SEQ ID NO: 5857

SEQ ID NO: 6135 - DNA, 201 bp, Homo sapiens; identical to SEQ ID NO: 5858

SEQ ID NO: 6136 - DNA, 201 bp, Homo sapiens; identical to SEQ ID NO: 5859

SEQ ID NO: 6137 - DNA, 201 bp, Homo sapiens; identical to SEQ ID NO: 5965

SEQ ID NO: 6138 - DNA, 201 bp, Homo sapiens; identical to SEQ ID NO: 5860

SEQ ID NO: 6139 - DNA, 201 bp, Homo sapiens; identical to SEQ ID NO: 5861

SEQ ID NO: 6140 - DNA, 201 bp, Homo sapiens; identical to SEQ ID NO: 5862

SEQ ID NO: 6141 - DNA, 201 bp, Homo sapiens; identical to SEQ ID NO: 5863

SEQ ID NO: 6142 - DNA, 201 bp, Homo sapiens; identical to SEQ ID NO: 5864

SEQ ID NO: 6143 - DNA, 201 bp, Homo sapiens; identical to SEQ ID NO: 5865

SEQ ID NO: 6144 - DNA, 201 bp, Homo sapiens; identical to SEQ ID NO: 5866

SEQ ID NO: 6145 - DNA, 201 bp, Homo sapiens; identical to SEQ ID NO: 5867
  misc_feature (1)...(201): n = A,T,C or G, or insertion/deletion polymorphism (see Tables 1-2)

SEQ ID NO: 6146 - DNA, 201 bp, Homo sapiens; identical to SEQ ID NO: 5868

SEQ ID NO: 6147 - DNA, 201 bp, Homo sapiens; identical to SEQ ID NO: 5869

SEQ ID NO: 6148 - DNA, 201 bp, Homo sapiens; identical to SEQ ID NO: 5870

SEQ ID NO: 6149 - DNA, 201 bp, Homo sapiens; identical to SEQ ID NO: 5871

SEQ ID NO: 6150 - DNA, 201 bp, Homo sapiens; identical to SEQ ID NO: 5872

SEQ ID NO: 6151 - DNA, 201 bp, Homo sapiens; identical to SEQ ID NO: 5873

SEQ ID NO: 6152 - DNA, 201 bp, Homo sapiens; identical to SEQ ID NO: 5874

SEQ ID NO: 6153 - DNA, 201 bp, Homo sapiens; identical to SEQ ID NO: 5875
  misc_feature (1)...(201): n = A,T,C or G, or insertion/deletion polymorphism (see Tables 1-2)

SEQ ID NO: 6154 - DNA, 201 bp, Homo sapiens; identical to SEQ ID NO: 5876

SEQ ID NO: 6155 - DNA, 201 bp, Homo sapiens
  misc_feature (1)...(201): n = A,T,C or G, or insertion/deletion polymorphism (see Tables 1-2)
gacagcagctgaattgtctaaaaacttatcttcacccagttcttacccgccagctcttgaggccgagggcgaggccatggaagatgcagccgcgccagggnacgaccgaggcggcacacaggagccagccccagtgcctgctgagccgtttgacaacactacctacaagaacctgcagcatcatgactacagcacgtacac

SEQ ID NO: 6156 - DNA, 201 bp, Homo sapiens
ggaaccaaaggagaggggcaagctcctagccacccagacagcagctgaattgtctaaaaacttatcttcacccagttcttacccgccagctcttgaggccragggcgaggccatggaagatgcagccgcgccaggggacgaccgaggcggcacacaggagccagccccagtgcctgctgagccgtttgacaacactaccta

SEQ ID NO: 6157 - DNA, 201 bp, Homo sapiens
agggtcagccacagaattccaagaagcaaagtccaccaaaaaatgtagtggaaccaaaggagaggggcaagctcctagccacccagacagcagctgaattrtctaaaaacttatcttcacccagttcttacccgccagctcttgaggccgagggcgaggccatggaagatgcagccgcgccaggggacgaccgaggcggca

SEQ ID NO: 6158 - DNA, 201 bp, Homo sapiens
  misc_feature (1)...(201): n = A,T,C or G, or insertion/deletion polymorphism (see Tables 1-2)
gacagttcctgttgagaataaccacggtttccatgaaaagacagcagcgctgaagcttgaggccgagggcgaggccatggaagatgcagccgcgccagggnacgaccgaggcggcacacaggagccagccccagtgcctgctgagccgtttgacaacactacctacaagaacctgcagcatcatgactacagcacgtacac

SEQ ID NO: 6159 - DNA, 201 bp, Homo sapiens
aatcgtggaagatcagataccaccaagcaatttggagacagttcctgttgagaataaccacggtttccatgaaaagacagcagcgctgaagcttgaggccragggcgaggccatggaagatgcagccgcgccaggggacgaccgaggcggcacacaggagccagccccagtgcctgctgagccgtttgacaacactaccta

SEQ ID NO: 6160 - DNA, 201 bp, Homo sapiens
tgcagaaaacatttagattaaatgaaatagataaagaaagccaaaagccatttgaagttaaaggacccttacctgtccacacaaaatcagggttgtctgcrccaccgaagggcagcccagcgcctgctgtgttggcagaagaggccagagcagaggggcagctgcaagccagtcctcctggggcggcagaggggcatctgg

SEQ ID NO: 6161 - DNA, 201 bp, Homo sapiens
tgaggctgacgtttcagaggtcactcctcgagtggtgagcaaaggcagaggggggcttcgaaaaccagaggcctctcattcctttgaaaacagagcccccygagttacagtatcagcaaaagagaaaaccttgctgcagaagccgcatgtggacattactgatccagagaagccccaccagccaaagaagaaagggtcccc

SEQ ID NO: 6162 - DNA, 201 bp, Homo sapiens
tatcttcacccagttcttacccgccagctgtgaataagggcaggaaggtagctagtcccagtcccagtggcagcgtgctattcacagatgaaggggttccraaatttttgtcaagaaagactttggtagagtttccacagaaagttctgtctccattcagaaaacagggctctgattcagaagctcgtcaggtgggtcgga

SEQ ID NO: 6163 - DNA, 201 bp, Homo sapiens
agggtcagccacagaattccaagaagcaaagtccaccaaaaaatgtagtggaaccaaaggagaggggcaagctcctagccacccagacagcagctgaattrtctaaaaacttatcttcacccagttcttacccgccagctgtgaataagggcaggaaggtagctagtcccagtcccagtggcagcgtgctattcacagatg

SEQ ID NO: 6164 - DNA, 201 bp, Homo sapiens
  misc_feature (1)...(201): n = A,T,C or G, or insertion/deletion polymorphism (see Tables 1-2)
agtttccacagaaagttctgtctccattcagaaaacagggctctgattcagaagctcgtcaggtgggtcggaaagtgacgtcgccttcgtcttcatcctcntccagctcctctgattctgaatctgatgatgaggctgacgtttcagaggtcactcctcgagtggtgagcaaaggcagaggggggcttcgaaaaccagagg

SEQ ID NO: 6165 - DNA, 201 bp, Homo sapiens
aggggcaagctcctagccacccagacagcagctgaattgtctaaaaacttatcttcacccagttcttacccgccagctgtgaataagggcaggaaggtagytagtcccagtcccagtggcagcgtgctattcacagatgaaggggttccgaaatttttgtcaagaaagactttggtagagtttccacagaaagttctgtct

SEQ ID NO: 6166 - DNA, 201 bp, Homo sapiens; identical to SEQ ID NO: 6158
  misc_feature (1)...(201): n = A,T,C or G, or insertion/deletion polymorphism (see Tables 1-2)

SEQ ID NO: 6167 - DNA, 201 bp, Homo sapiens; identical to SEQ ID NO: 6159

SEQ ID NO: 6168 - DNA, 201 bp, Homo sapiens; identical to SEQ ID NO: 6160

SEQ ID NO: 6169 - DNA, 201 bp, Homo sapiens
gagattgaagttatgtggccataattcaaggattgctggcaacaccagaagccaagagaaagatgaggaagaattctcccctagacctttcagaaggagcrtggcccagccaacaccctgacttcagacttctggcctccagaactcagcctcctggccggggatagccaatagccccagcccactgaaagcctggtgagc

SEQ ID NO: 6170 - DNA, 201 bp, Homo sapiens
ttcatcctttcctctagacggggtagggctggttctggatctttttccgcggtagctggagagacgtaggacctgatgatggctactagatgcctgagaarggagaagacagaggagaatgccagatgaagacagaaacagagattgaagttatgtggccataattcaaggattgctggcaacaccagaagccaagagaaa

SEQ ID NO: 6171 - DNA, 201 bp, Homo sapiens; identical to SEQ ID NO: 6161

SEQ ID NO: 6172 - DNA, 201 bp, Homo sapiens; identical to SEQ ID NO: 6162

SEQ ID NO: 6173 - DNA, 201 bp, Homo sapiens; identical to SEQ ID NO: 6163

SEQ ID NO: 6174 - DNA, 201 bp, Homo sapiens; identical to SEQ ID NO: 6165

SEQ ID NO: 6175 - DNA, 201 bp, Homo sapiens; identical to SEQ ID NO: 6164
  misc_feature (1)...(201): n = A,T,C or G, or insertion/deletion polymorphism (see Tables 1-2)

SEQ ID NO: 6176 - DNA, 201 bp, Homo sapiens
  misc_feature (1)...(201): n = A,T,C or G, or insertion/deletion polymorphism (see Tables 1-2)
ggggagcggagcggcagaagctgatgcgagcagacctgcaccaccagcacagcgtgctgcacagggcgctgcaggcatgggtgacttaccagggcagggtncgaagcatcctccgggaggtggcagccagggagagccagcacaacaggcagctgctgcgcggggcattacgtcgctggaaagagaacaccatggcccgag

SEQ ID NO: 6177 - DNA, 201 bp, Homo sapiens
aacagaacacagttttaagtttgattttttttatttcaaaatgctttgcaattaaatgaattactgttcagaagtctcccacttttcatacaaaaatactrtgctactgatacagttgaaaaaattcaatgatgtctctcctgcaggagaaattcacagcatccccagggtcaacatgaaatctggccctgtccccgccac

SEQ ID NO: 6178 - DNA, 201 bp, Homo sapiens
gctgtgtcagtgcagatgtattaccgacagcaggaggactgtgccatctgggaggcccagaaggtgctggacaggggctgtctgcggacctggtttcagcrctggtgggactgcagccggaggtcagcccagcagagactgcagctggagagggcagtgcaacaccaccaccggcagctgctgctggaggggctggcccgg

SEQ ID NO: 6179 - DNA, 201 bp, Homo sapiens
atttctaaaggcctggcttgaatacctgcaagtccgcagagtgaagagacagcagaatgagatggctgagcgattccatcatgtcactgtgctccagatayacttctgtgactggcagcaggcctgggagcggagggagagcttgtacgctcaccatgcccaggtggagaaactggccaggaagatggccctgcggcgcgc

SEQ ID NO: 6180 - DNA, 201 bp, Homo sapiens
agcaactactgcactaccagaccaccaagcagaacctctggtcctgtcggcggcaagcgagcagcctgcgcaggtggctggagctgaacagagaggagccrgggcctgaggaccaggaagtagagcagcaggtgcagaaagagctggaacaggtggaaatgcagatccagctgctggcagaggagctccaggctcagcgcc

SEQ ID NO: 6181 - DNA, 201 bp, Homo sapiens
tgcgttgggcctggagccagtggagggagtgcctggccctgcggggagcggagcggcagaagctgatgcgagcagacctgcaccaccagcacagcgtgctscacagggcgctgcaggcatgggtgacttaccagggcagggtgcgaagcatcctccgggaggtggcagccagggagagccagcacaacaggcagctgctgc

SEQ ID NO: 6182 - DNA, 201 bp, Homo sapiens
tgtggcaccagcaggcagcagcacgtcaccaggagcaggagtggcaaacagtggcctgtgcccaccaccgccacgggcggctcaagaaagctttctgcctytggagggaaagtgcccaagggctcagaacagagaggacgggcagggtgcgggcagcagaattccacatggcccagctcctgcgttgggcctggagccagt

SEQ ID NO: 6183 - DNA, 201 bp, Homo sapiens
ggtgcgaagcatcctccgggaggtggcagccagggagagccagcacaacaggcagctgctgcgcggggcattacgtcgctggaaagagaacaccatggccsgagtggatgaagccaaaaaaacctttcaagcaagtactcattacagaaggaccatatgttccaaggtcctggtccagtggcgggaagctgtgtcagtgca

SEQ ID NO: 6184 - DNA, 201 bp, Homo sapiens
cctgcaagtccgcagagtgaagagacagcagaatgagatggctgagcgattccatcatgtcactgtgctccagatacacttctgtgactggcagcaggccygggagcggagggagagcttgtacgctcaccatgcccaggtggagaaactggccaggaagatggccctgcggcgcgcctttactcactggaaacactacat

SEQ ID NO: 6185 - DNA, 201 bp, Homo sapiens
tgacgcggcccttcctggcagaggccccgacagcactggtcccacacagccccctgcctggggccctgtcaagcgcccctggcccgaagcagcccccgacrgcaagcacaggcccggagctgctgctgctgcctctttcctccttcatgccctgcggggcggctgcaccagccagggtgtcagcacagcgggctactccta

SEQ ID NO: 6186 - DNA, 201 bp, Homo sapiens
acgagtggaaactctgtgttcgagctgactgtcactacaggtattacctgtacaacctgatgttccagacgtggaagacctatgtgcgtcagcagcaggaratgaggaacaagtacattagagccgaggttcatgatgcaaagcaaaagatgcgacaggcctggaagtcctggttgatctacgtggttgttcgtaggacca

SEQ ID NO: 6187 - DNA, 201 bp, Homo sapiens
gcacagggcgctgcaggcatgggtgacttaccagggcagggtgcgaagcatcctccgggaggtggcagccagggagagccagcacaacaggcagctgctgygcggggcattacgtcgctggaaagagaacaccatggcccgagtggatgaagccaaaaaaacctttcaagcaagtactcattacagaaggaccatatgttc

SEQ ID NO: 6188 - DNA, 201 bp, Homo sapiens
  misc_feature (1)...(201): n = A,T,C or G, or insertion/deletion polymorphism (see Tables 1-2)
gagacattagagaagcaagtattttctctctggaggcagaagatgtttcagcatcgagaaaaccgcctggcagagagaatggccatccttcacgcagagcnacagcttctgtataggtcttggttcatgtggcaccagcaggcagcagcacgtcaccaggagcaggagtggcaaacagtggcctgtgcccaccaccgccac

SEQ ID NO: 6189 - DNA, 201 bp, Homo sapiens
tgcagccggaggtcagcccagcagagactgcagctggagagggcagtgcaacaccaccaccggcagctgctgctggaggggctggcccggtggaagacgcwccatctgcagtgtgtcaggaagaggctcctgcacaggcagagcacccaactgctggcacagagactcagccggacctgcttccgccagtggagacaacag

SEQ ID NO: 6190 - DNA, 201 bp, Homo sapiens
ctggtcccacacagccccctgcctggggccctgtcaagcgcccctggcccgaagcagcccccgacggcaagcacaggcccggagctgctgctgctgcctcyttcctccttcatgccctgcggggcggctgcaccagccagggtgtcagcacagcgggctactcctagggataagcccccggtcccctcatccctggccagt

SEQ ID NO: 6191 - DNA, 201 bp, Homo sapiens
gtcgctggaaagagaacaccatggcccgagtggatgaagccaaaaaaacctttcaagcaagtactcattacagaaggaccatatgttccaaggtcctggtscagtggcgggaagctgtgtcagtgcagatgtattaccgacagcaggaggactgtgccatctgggaggcccagaaggtgctggacaggggctgtctgcgga

SEQ ID NO: 6192 - DNA, 201 bp, Homo sapiens; identical to SEQ ID NO: 6176
  misc_feature (1)...(201): n = A,T,C or G, or insertion/deletion polymorphism (see Tables 1-2)

SEQ ID NO: 6193 - DNA, 201 bp, Homo sapiens; identical to SEQ ID NO: 6177

SEQ ID NO: 6194 - DNA, 201 bp, Homo sapiens; identical to SEQ ID NO: 6178

SEQ ID NO: 6195 - DNA, 201 bp, Homo sapiens; identical to SEQ ID NO: 6179

SEQ ID NO: 6196 - DNA, 189 bp, Homo sapiens
catcaggtcctgcaaaggtctgtatcattaatcagtgtcatcagtgtcctcagaagacactagcagagtccagggtgatgcgttcagccacaagcacaaaractgctttttctaaagagcaggatgaggtgaatgtgggaacggaaagcagttgtcacgaaggctgtgtggctctgctgggggagaggc

SEQ ID NO: 6197 - DNA, 201 bp, Homo sapiens; identical to SEQ ID NO: 6180

SEQ ID NO: 6198 - DNA, 201 bp, Homo sapiens; identical to SEQ ID NO: 6181

SEQ ID NO: 6199 - DNA, 201 bp, Homo sapiens; identical to SEQ ID NO: 6182

SEQ ID NO: 6200 - DNA, 201 bp, Homo sapiens; identical to SEQ ID NO: 6183

SEQ ID NO: 6201 - DNA, 201 bp, Homo sapiens; identical to SEQ ID NO: 6184

SEQ ID NO: 6202 - DNA, 201 bp, Homo sapiens; identical to SEQ ID NO: 6185

SEQ ID NO: 6203 - DNA, 201 bp, Homo sapiens; identical to SEQ ID NO: 6186

SEQ ID NO: 6204 - DNA, 201 bp, Homo sapiens; identical to SEQ ID NO: 6187

SEQ ID NO: 6205 - DNA, 201 bp, Homo sapiens; identical to SEQ ID NO: 6188
  misc_feature (1)...(201): n = A,T,C or G, or insertion/deletion polymorphism (see Tables 1-2)

SEQ ID NO: 6206 - DNA, 201 bp, Homo sapiens; identical to SEQ ID NO: 6189

SEQ ID NO: 6207 - DNA, 201 bp, Homo sapiens; identical to SEQ ID NO: 6190

SEQ ID NO: 6208 - DNA, 201 bp, Homo sapiens; identical to SEQ ID NO: 6191

SEQ ID NO: 6209 - DNA, 201 bp, Homo sapiens; identical to SEQ ID NO: 6176
  misc_feature (1)...(201): n = A,T,C or G, or insertion/deletion polymorphism (see Tables 1-2)

SEQ ID NO: 6210 - DNA, 201 bp, Homo sapiens; identical to SEQ ID NO: 6177

SEQ ID NO: 6211 - DNA, 201 bp, Homo sapiens; identical to SEQ ID NO: 6178

SEQ ID NO: 6212 - DNA, 201 bp, Homo sapiens; identical to SEQ ID NO: 6179

SEQ ID NO: 6213 - DNA, 201 bp, Homo sapiens; identical to SEQ ID NO: 6180

SEQ ID NO: 6214 - DNA, 201 bp, Homo sapiens; identical to SEQ ID NO: 6181

SEQ ID NO: 6215 - DNA, 201 bp, Homo sapiens; identical to SEQ ID NO: 6182

SEQ ID NO: 6216 - DNA, 201 bp, Homo sapiens; identical to SEQ ID NO: 6183

SEQ ID NO: 6217 - DNA, 201 bp, Homo sapiens; identical to SEQ ID NO: 6184

SEQ ID NO: 6218 - DNA, 201 bp, Homo sapiens; identical to SEQ ID NO: 6185

SEQ ID NO: 6219 - DNA, 201 bp, Homo sapiens; identical to SEQ ID NO: 6186

SEQ ID NO: 6220 - DNA, 201 bp, Homo sapiens; identical to SEQ ID NO: 6188
  misc_feature (1)...(201): n = A,T,C or G, or insertion/deletion polymorphism (see Tables 1-2)

SEQ ID NO: 6221 - DNA, 201 bp, Homo sapiens; identical to SEQ ID NO: 6187

SEQ ID NO: 6222 - DNA, 201 bp, Homo sapiens; identical to SEQ ID NO: 6189

SEQ ID NO: 6223 - DNA, 201 bp, Homo sapiens; identical to SEQ ID NO: 6190

SEQ ID NO: 6224 - DNA, 201 bp, Homo sapiens; identical to SEQ ID NO: 6191

SEQ ID NO: 6225 - DNA, 201 bp, Homo sapiens
acagatgccagaaaaatccacactgcccctgcccgaaccatgttcctgctgcgtcccctgcccattctgttggtgacaggcggcgggtatgcagggtaccrgcagtatgagaagtacagggagcgagagctggagaagctgggattggagattccacccaaacttgctggtcactgggaggtggctttgtacaagtcagtg

SEQ ID NO: 6226 - DNA, 189 bp, Homo sapiens
gtggcggggacagggccagatttcatgttgaccctggggatgctgtgaatttctcctgcaggagagacatcattgaattttttcaactgtatcagtagcayagtatttttgtatgaaaagtgggagacttctgaacagtaattcatttaattgcaaagcattttgaaataaaaaaaatcaaacttaaaa

SEQ ID NO: 6227 - DNA, 201 bp, Homo sapiens
tgagggtcttttcaagagggaggcccatgaggccatccaggtaagggcctgcctcagcgtggttgggagtctgaccaggtaggacttgaatgattcggctmccacctgttccagaggtgcagacaagaggtggcgagagcccccatcatgcccctcaacctatcccgttccttctgcctacaaataaaaagtgcaggctgg

SEQ ID NO: 6228 - DNA, 201 bp, Homo sapiens
cagactgtggatgcctctcccccagcagagccacacagccttcgtgacaactgctttccgttcccacattcacctcatcctgctctttagaaaaagcagtytttgtgcttgtggctgaacgcatcaccctggactctgctagtgtcttctgaggacactgatgacactgattaatgatacagacctttgcaggacctgatg

SEQ ID NO: 6229 - DNA, 201 bp, Homo sapiens
tgtcgttttttcttgctgctcctccccccatcacctgagctgttttctgttggccccttttgttttttggccttaacgctcctgctgcacagggtgaggtrcctccttggcacagactgtggatgcctctcccccagcagagccacacagccttcgtgacaactgctttccgttcccacattcacctcatcctgctcttta

SEQ ID NO: 6230 - DNA, 201 bp, Homo sapiens
gggggccaccaacgtgggctccattcgcatctactttgaccgggacctgcacacaaacagcccaaggcacagcaagggctcctacaatgacttcagcttcstgacgcacaccaatagagagggcgtccccatgcgtaagggcgagcacctgggcgagttcaacctgggctccaccatcgtgctcatcttcgaggcccccaa

SEQ ID NO: 6231 - DNA, 201 bp, Homo sapiens
tgggggccaccaacgtgggctccattcgcatctactttgaccgggacctgcacacaaacagcccaaggcacagcaagggctcctacaatgacttcagcttygtgacgcacaccaatagagagggcgtccccatgcgtaagggcgagcacctgggcgagttcaacctgggctccaccatcgtgctcatcttcgaggccccca

SEQ ID NO: 6232 - DNA, 201 bp, Homo sapiens
tcccaccggcgccacttcccaggctccctgatgtcagtgaaccctggcatggctcgctggatcaaagagctcttctgccataacgagcgggtggtcctgaygggggactggaaacatggcttcttctcactgacagctgtgggggccaccaacgtgggctccattcgcatctactttgaccgggacctgcacacaaacagc

SEQ ID NO: 6233 - DNA, 201 bp, Homo sapiens
gggcctgcctcagcgtggttgggagtctgaccaggtaggacttgaatgattcggctaccacctgttccagaggtgcagacaagaggtggcgagagcccccrtcatgcccctcaacctatcccgttccttctgcctacaaataaaaagtgcaggctggaatgatctcagtcacatttggatctttttaaacactgtatagac

SEQ ID NO: 6234 - DNA, 189 bp, Homo sapiens; identical to SEQ ID NO: 6226

SEQ ID NO: 6235 - DNA, 201 bp, Homo sapiens; identical to SEQ ID NO: 6227

SEQ ID NO: 6236 - DNA, 201 bp, Homo sapiens; identical to SEQ ID NO: 6228

SEQ ID NO: 6237 - DNA, 201 bp, Homo sapiens
ccctccctgcgccggcccatgatgtgtcagtcagaggcgcggcaaggaccagagctccgcgcggcgaaatggttgcacttcccccagctggccctgaggcrgaggctggggcagctgagctgcatgtccagacccgctctgaaactgcgctcctggcccttgaccgtcctctactacctcctgcccttcggcgccctcaga

SEQ ID NO: 6238 - DNA, 201 bp, Homo sapiens; identical to SEQ ID NO: 6229

SEQ ID NO: 6239 - DNA, 201 bp, Homo sapiens; identical to SEQ ID NO: 6230

SEQ ID NO: 6240 - DNA, 201 bp, Homo sapiens; identical to SEQ ID NO: 6231

SEQ ID NO: 6241 - DNA, 201 bp, Homo sapiens; identical to SEQ ID NO: 6232

SEQ ID NO: 6242 - DNA, 201 bp, Homo sapiens
caaccagcctcgcagaggcagaggccctggagcagtgacagcacaggagatctgctggctcgggggaaggggaggaaagaggaaaacaaagggagtgatcragtgagcctcgccccgccctccctgcgccggcccatgatgtgtcagtcagaggcgcggcaaggaccagagctccgcgcggcgaaatggttgcacttcccc

SEQ ID NO: 6243 - DNA, 201 bp, Homo sapiens; identical to SEQ ID NO: 6233

SEQ ID NO: 6244 - DNA, 189 bp, Homo sapiens; identical to SEQ ID NO: 6226

SEQ ID NO: 6245 - DNA, 201 bp, Homo sapiens; identical to SEQ ID NO: 6227

SEQ ID NO: 6246 - DNA, 113 bp, Homo sapiens
caagctcctcatycagggcctgaggctcccacctcgtgtcacctcaagacagccagagaggatgaaatctttggcttgggcttccagggctgtcataggcagagggcaagcca

SEQ ID NO: 6247 - DNA, 201 bp, Homo sapiens; identical to SEQ ID NO: 6228

SEQ ID NO: 6248 - DNA, 201 bp, Homo sapiens; identical to SEQ ID NO: 6237

SEQ ID NO: 6249 - DNA, 201 bp, Homo sapiens; identical to SEQ ID NO: 6230

SEQ ID NO: 6250 - DNA, 201 bp, Homo sapiens; identical to SEQ ID NO: 6229

SEQ ID NO: 6251 - DNA, 201 bp, Homo sapiens; identical to SEQ ID NO: 6232

SEQ ID NO: 6252 - DNA, 201 bp, Homo sapiens; identical to SEQ ID NO: 6231

SEQ ID NO: 6253 - DNA, 201 bp, Homo sapiens; identical to SEQ ID NO: 6233

SEQ ID NO: 6254 - DNA, 201 bp, Homo sapiens; identical to SEQ ID NO: 6242

SEQ ID NO: 6255 - DNA, 201 bp, Homo sapiens
acagatgccagaaaaatccacactgcccctgcccgaaccatgttcctgctgcgtcccctgcccattctgttggtgacaggcggcgggtatgcagggtaccrgcagtatgagaagtacagggagcgagagctggagaagctgggattggagattccacccaaacttgctggtcactgggagccctgaccctctattctgcac

SEQ ID NO: 6256 - DNA, 189 bp, Homo sapiens; identical to SEQ ID NO: 6226

SEQ ID NO: 6257 - DNA, 201 bp, Homo sapiens; identical to SEQ ID NO: 6227

SEQ ID NO: 6258 - DNA, 201 bp, Homo sapiens; identical to SEQ ID NO: 6228

SEQ ID NO: 6259 - DNA, 201 bp, Homo sapiens; identical to SEQ ID NO: 6237

SEQ ID NO: 6260 - DNA, 201 bp, Homo sapiens; identical to SEQ ID NO: 6229

SEQ ID NO: 6261 - DNA, 201 bp, Homo sapiens; identical to SEQ ID NO: 6230

SEQ ID NO: 6262 - DNA, 201 bp, Homo sapiens; identical to SEQ ID NO: 6232

SEQ ID NO: 6263 - DNA, 201 bp, Homo sapiens; identical to SEQ ID NO: 6231

SEQ ID NO: 6264 - DNA, 201 bp, Homo sapiens; identical to SEQ ID NO: 6242

SEQ ID NO: 6265 - DNA, 201 bp, Homo sapiens; identical to SEQ ID NO: 6233

SEQ ID NO: 6266 - DNA, 201 bp, Homo sapiens; identical to SEQ ID NO: 6237

SEQ ID NO: 6267 - DNA, 201 bp, Homo sapiens; identical to SEQ ID NO: 6229

SEQ ID NO: 6268 - DNA, 201 bp, Homo sapiens; identical to SEQ ID NO: 6232

SEQ ID NO: 6269 - DNA, 201 bp, Homo sapiens; identical to SEQ ID NO: 6233

SEQ ID NO: 6270 - DNA, 201 bp, Homo sapiens; identical to SEQ ID NO: 6242

SEQ ID NO: 6271 - DNA, 201 bp, Homo sapiens; identical to SEQ ID NO: 6227

SEQ ID NO: 6272 - DNA, 201 bp, Homo sapiens; identical to SEQ ID NO: 6228

SEQ ID NO: 6273 - DNA, 189 bp, Homo sapiens; identical to SEQ ID NO: 6226

SEQ ID NO: 6274 - DNA, 201 bp, Homo sapiens; identical to SEQ ID NO: 6227

SEQ ID NO: 6275 - DNA, 201 bp, Homo sapiens; identical to SEQ ID NO: 6228

SEQ ID NO: 6276 - DNA, 201 bp, Homo sapiens; identical to SEQ ID NO: 6237

SEQ ID NO: 6277 - DNA, 201 bp, Homo sapiens; identical to SEQ ID NO: 6229

SEQ ID NO: 6278 - DNA, 201 bp, Homo sapiens; identical to SEQ ID NO: 6230

SEQ ID NO: 6279 - DNA, 201 bp, Homo sapiens; identical to SEQ ID NO: 6231

SEQ ID NO: 6280 - DNA, 201 bp, Homo sapiens; identical to SEQ ID NO: 6232

SEQ ID NO: 6281 - DNA, 201 bp, Homo sapiens; identical to SEQ ID NO: 6242

SEQ ID NO: 6282 - DNA, 201 bp, Homo sapiens; identical to SEQ ID NO: 6233

SEQ ID NO: 6283 - DNA, 189 bp, Homo sapiens; identical to SEQ ID NO: 6226

SEQ ID NO: 6284 - DNA, 201 bp, Homo sapiens; identical to SEQ ID NO: 6227

SEQ ID NO: 6285 - DNA, 201 bp, Homo sapiens; identical to SEQ ID NO: 6228

SEQ ID NO: 6286 - DNA, 201 bp, Homo sapiens; identical to SEQ ID NO: 6237

SEQ ID NO: 6287 - DNA, 201 bp, Homo sapiens; identical to SEQ ID NO: 6229

SEQ ID NO: 6288 - DNA, 201 bp, Homo sapiens; identical to SEQ ID NO: 6230

SEQ ID NO: 6289 - DNA, 201 bp, Homo sapiens; identical to SEQ ID NO: 6231

SEQ ID NO: 6290 - DNA, 201 bp, Homo sapiens; identical to SEQ ID NO: 6232

SEQ ID NO: 6291 - DNA, 201 bp, Homo sapiens; identical to SEQ ID NO: 6242

SEQ ID NO: 6292 - DNA, 201 bp, Homo sapiens; identical to SEQ ID NO: 6233

SEQ ID NO: 6293 - DNA, 201 bp, Homo sapiens
ggtccgagctcggagcagcgacggccggctccgccacccggcctggcgcgcaggcagcggcgggcgaggagggcgtgggcccagcgcggaactggcctccsgatactggggcagacggcgcgctctgcccggggccgccgacctccggccgaagggagcgcgggcggacgacaggcgaccactgcgcgcaggccggaagct

SEQ ID NO: 6294 - DNA, 201 bp, Homo sapiens
accaggcatctcctgatctgcggctgacctggctccagaacatggcagagaaacacaccaagaagaagtgctacacggaggctgccatgtgcctggtgcaygccgctgcgttagtggctgagtatctgagcatgctggaggaccacagctacctgcccgtgggcagtgtcagcttccagaatatttcttccaatgtgctgg

SEQ ID NO: 6295 - DNA, 201 bp, Homo sapiens
aaccctttcctgaaaaccggacacgcccgcacaaagagattttggaatttccaacacgagaagtatatgtccctcacactgtgtacagaaaccttctctaygtctacccacagaggctgaactttgtaaacaaactagcatcagcccggaacattacaataaagatccagtttatgtgtggagaagatgctagcaatgcga

SEQ ID NO: 6296 - DNA, 201 bp, Homo sapiens
tatgttttgagtataagggaaaacagagttctgacaaagtcagtacccaagtcctgcagaagtcaagggatgtcaaggcccggctggaagaggctttgctscgtggggaaggggccagaggggagatgatgcgccgccgggctccagggaacgaccgatttccaggcctaaatgaaaatttgagatggaagaaagagcaga

SEQ ID NO: 6297 - DNA, 201 bp, Homo sapiens
actccctggagagccaggtgaccttccccatccgcgtgctggatcagaaaatcagcgagatggcgctggagcatgagctgaagctcagcatcatctgcctsaactcctcccgcctggagccgctcgtgctcttcctgcacctggtgctggacaagctcttccagctgtccgtgcagcccatggtcatcgctggccagacag

SEQ ID NO: 6298 - DNA, 201 bp, Homo sapiens
tgaatgctgatactgctccaacatctccttgtccttccatatcttcccagaactcaagctcctgctccagcttccaggaccagaagatcgccagcatgttygatctgacttccgagtaccgccagcagcacttcctcaccgggctcctcttcacagaactggctgctgccctggatgccgaaggggaaggaatcagcaaag

SEQ ID NO: 6299 - DNA, 201 bp, Homo sapiens
ctttgaaggacttctgatgacacacctgaacagcctggatgtgcagcttgcccaggagctcggggacttcactgatgacgacttggacgtggtgttcacgmcaaaggaatgtaggactttgcagccctctttgccggaggaaggggttgaactggaccctcatgtcagggactgtgttcagacctacatccgtgagtggct

SEQ ID NO: 6300 - DNA, 201 bp, Homo sapiens
agcagtacagaaggaacacagtcctgaccactatgcacgccttcccctacatcaagaccaggatcagcgtcatccagaaggaggagtttgttttgacaccrattgaagttgccattgaagacatgaagaagaagaccctgcagttagcagttgccattaaccaggagccgcctgatgcaaagatgcttcagatggtgctgc

SEQ ID NO: 6301 - DNA, 201 bp, Homo sapiens
aacatctccttgtccttccatatcttcccagaactcaagctcctgctccagcttccaggaccagaagatcgccagcatgttcgatctgacttccgagtacygccagcagcacttcctcaccgggctcctcttcacagaactggctgctgccctggatgccgaaggggaaggaatcagcaaagtacaaaggaaagctgtcag

SEQ ID NO: 6302 - DNA, 201 bp, Homo sapiens
gtttgccagcattgccctctacgatgttaaagaaaggaaaaagatctcagaaaattttcactgtgacctgaactctgaccagttcaaaggatttctgcgarctcacacgccttcagtggccgcatcaagtcaggcgagatctgcagtcttctcagtcacctacccgtcctcagacatctacctggtagtcaagattgaaaa

SEQ ID NO: 6303 - DNA, 201 bp, Homo sapiens
gaaggaggagtttgttttgacaccgattgaagttgccattgaagacatgaagaagaagaccctgcagttagcagttgccattaaccaggagccgcctgatscaaagatgcttcagatggtgctgcaaggctctgtgggagctactgtaaatcagggaccactggaagtagcccaagtgtttttggctgaaattcctgctga

SEQ ID NO: 6304 - DNA, 201 bp, Homo sapiens
caggcggaaaagatgaacatcagcctggctttcttcttgtatgaccttctctccctcatggatcggggctttgtgtttaacctcatcagacattattgcarccagctgtcagccaagctcagtaaccttccaacgctcatttccatgaggctagagttcctgagaatcctctgtagccatgagcattacctcaatctgaac

SEQ ID NO: 6305 - DNA, 201 bp, Homo sapiens
tacacacccaggacaaccacctggagaagttcttcaccctctgccactccctggagagccaggtgaccttccccatccgcgtgctggatcagaaaatcagygagatggcgctggagcatgagctgaagctcagcatcatctgcctcaactcctcccgcctggagccgctcgtgctcttcctgcacctggtgctggacaagc

SEQ ID NO: 6306 - DNA, 201 bp, Homo sapiens
agtttactctcccaccaaaccttggccagtaccatcgacagagcataagtacctctggcttcccctctcttcaactacctcagttttatgaccctgtggakccagtggactttgaaggacttctgatgacacacctgaacagcctggatgtgcagcttgcccaggagctcggggacttcactgatgacgacttggacgtgg

SEQ ID NO: 6307 - DNA, 201 bp, Homo sapiens
ccgcgaccctagaagccaccgaaccgccggcgggccatggccactctgccgagcgcagagcgccgcgcgttcgcgctcaagatcaacaggtattcttcagyggaaataaggaaacagtttactctcccaccaaaccttggccagtaccatcgacagagcataagtacctctggcttcccctctcttcaactacctcagttt

SEQ ID NO: 6308 - DNA, 201 bp, Homo sapiens
acctccgcagcctgcagcctgacaagcggctagaaaacctcctgcagcaagtgagtgccgaggactttgagaagcagaacgaggaggcccggaggaccaayaggcaggccgagctctttgccctttacccatcagtggacgaggaggatgctgtggaaatacgtccagtaccagaatgtcccaaggaacacctgggcaaca

SEQ ID NO: 6309 - DNA, 201 bp, Homo sapiens
tggtgagagaaacagtcttcaagtatgcctggttcttctttgagcttctggtgaaaagcatggcccagcacgtacataacatggacaaacgggacagtttycggaggactcgtttttctgaccgtttcatggatgacataactactattgttaatgtggtcacctcggaaattgcagcccttttagtaaaaccacagaagg

SEQ ID NO: 6310 - DNA, 201 bp, Homo sapiens
attgaaaaactaaaactccaagctgaatccttctgccagcgtttggggaaataccggatgccctttgcctgggcacccataagcttatcaagcttcttcartgtctccacccttgagagggaggtaactgatgtggactctgtggttgggagaagctcagtgggtgaacggaggacattggcccaatctagaaggctttct

SEQ ID NO: 6311 - DNA, 201 bp, Homo sapiens
cctgcagcctgacaagcggctagaaaacctcctgcagcaagtgagtgccgaggactttgagaagcagaacgaggaggcccggaggaccaataggcaggccragctctttgccctttacccatcagtggacgaggaggatgctgtggaaatacgtccagtaccagaatgtcccaaggaacacctgggcaacagaatattggt

SEQ ID NO: 6312 - DNA, 201 bp, Homo sapiens
tctcccaccaaaccttggccagtaccatcgacagagcataagtacctctggcttcccctctcttcaactacctcagttttatgaccctgtggagccagtgractttgaaggacttctgatgacacacctgaacagcctggatgtgcagcttgcccaggagctcggggacttcactgatgacgacttggacgtggtgttcac

SEQ ID NO: 6313 - DNA, 201 bp, Homo sapiens
caagctaaaagagaacctcaggccaatgatcgagcggaaaattccagaactgtacaagccaatattcagagttgagagtcaaaagagaacattgtgctgtytgtcagcatatgtatatcagctacaaaatatattcaactttgacttcttttgacaaaggactttaggaaaaagaggaacaaagacattatttgagaatta

SEQ ID NO: 6314 - DNA, 201 bp, Homo sapiens
tatgtctacccacagaggctgaactttgtaaacaaactagcatcagcccggaacattacaataaagatccagtttatgtgtggagaagatgctagcaatgygatgccggtcatctttggaaagtccagcgggcctgaatttctgcaggaagtgtacacagctgttacataccataataagtctcctgacttttatgaagaa

SEQ ID NO: 6315 - DNA, 201 bp, Homo sapiens
actttgtaaacaaactagcatcagcccggaacattacaataaagatccagtttatgtgtggagaagatgctagcaatgcgatgccggtcatctttggaaartccagcgggcctgaatttctgcaggaagtgtacacagctgttacataccataataagtctcctgacttttatgaagaagtgaaaattaagctccccgcta

SEQ ID NO: 6316 - DNA, 201 bp, Homo sapiens
gctctggcagtagtgatgctccaagttcacctgcagccccaaggccagccagcaaaaagcatttccatgaggagcttgcccttcagatggtggtcagcacyggaatggtgagagaaacagtcttcaagtatgcctggttcttctttgagcttctggtgaaaagcatggcccagcacgtacataacatggacaaacgggaca

SEQ ID NO: 6317 - DNA, 201 bp, Homo sapiens
ccttcgacagcatcgttaacaaggatcataagagaatgtttggaacctacttccgagttggtttctttggatccaaatttggggatttggatgaacaggartttgtctacaaagagcctgcaattaccaagcttcctgagatctcacatagactagaggcattttatggtcaatgttttggtgcagaatttgtggaagtga

SEQ ID NO: 6318 - DNA, 201 bp, Homo sapiens
acctgaactctgaccagttcaaaggatttctgcgagctcacacgccttcagtggccgcatcaagtcaggcgagatctgcagtcttctcagtcacctacccrtcctcagacatctacctggtagtcaagattgaaaaagtcctgcagcagggagagattggagactgtgcagagccctacacggttatcaaagaaagtgatg

SEQ ID NO: 6319 - DNA, 201 bp, Homo sapiens
tggtctctgaggacaccctgtcacctgacgaggatggggtgtgcgcaggccagtacttcaccgagagtggcctggtaggcctcctggagcaggccgcggarctcttcagcacgggaggcttatatgagacagttaatgaggtctacaagctggtcatccccatcctagaagcgcatcgagaattccggaagctgacactca

SEQ ID NO: 6320 - DNA, 201 bp, Homo sapiens
agcttccggcctgcgcgcagtggtcgcctgtcgtccgcccgcgctcccttcggccggaggtcggcggccccgggcagagcgcgccgtctgccccagtatcsggaggccagttccgcgctgggcccacgccctcctcgcccgccgctgcctgcgcgccaggccgggtggcggagccggccgtcgctgctccgagctcggacc

SEQ ID NO: 6321 - DNA, 201 bp, Homo sapiens
tttgaggcaagtctgagcgcggggggaagaagtgaagtggctgaaattagagttgcgtttgaggcaggctgcaagccttctgtcgtcctgagcaaggctcygtcctcgcctgcttcattattccagaaagagcttggctcctggtggcatcgctatttttataccctggtccaaaggagccatgaagtggaaaaagtgatt

SEQ ID NO: 6322 - DNA, 145 bp, Homo sapiens
aggtgtggttgcatgcacctgtagccccagctattcaagaggctgagacaagagcatcgcttgagcccaggaggatcacagctgtgatcatgccactgcaytccagcctgggtgagagagtgaaaccttgtctcaaaaaacagac

SEQ ID NO: 6323 - DNA, 201 bp, Homo sapiens; identical to SEQ ID NO: 6294

SEQ ID NO: 6324 - DNA, 201 bp, Homo sapiens; identical to SEQ ID NO: 6295

SEQ ID NO: 6325 - DNA, 201 bp, Homo sapiens; identical to SEQ ID NO: 6296

SEQ ID NO: 6326 - DNA, 201 bp, Homo sapiens
ataatgctttgctttttttcttatgtcactcttgtgtactatctatttttctcctctctgggaccaagtttctttttataaagcaataatatctctgtttycatttcagaacattgtgctgtctgtcagcatatgtatatcagctacaaaatatattcaactttgacttcttttgacaaaggactttaggaaaaagaggaa

SEQ ID NO: 6327 - DNA, 201 bp, Homo sapiens; identical to SEQ ID NO: 6297

SEQ ID NO: 6328 - DNA, 201 bp, Homo sapiens; identical to SEQ ID NO: 6298

SEQ ID NO: 6329 - DNA, 201 bp, Homo sapiens; identical to SEQ ID NO: 6299

SEQ ID NO: 6330 - DNA, 201 bp, Homo sapiens; identical to SEQ ID NO: 6300

SEQ ID NO: 6331 - DNA, 201 bp, Homo sapiens; identical to SEQ ID NO: 6301

SEQ ID NO: 6332 - DNA, 201 bp, Homo sapiens; identical to SEQ ID NO: 6302

SEQ ID NO: 6333 - DNA, 201 bp, Homo sapiens; identical to SEQ ID NO: 6303

SEQ ID NO: 6334 - DNA, 201 bp, Homo sapiens; identical to SEQ ID NO: 6304

SEQ ID NO: 6335 - DNA, 201 bp, Homo sapiens; identical to SEQ ID NO: 6305

SEQ ID NO: 6336 - DNA, 201 bp, Homo sapiens; identical to SEQ ID NO: 6306

SEQ ID NO: 6337 - DNA, 201 bp, Homo sapiens; identical to SEQ ID NO: 6307

SEQ ID NO: 6338 - DNA, 201 bp, Homo sapiens
acctccgcagcctgcagcctgacaagcggctagaaaacctcctgcagcaagtgagtgccgaggactttgagaagcagaacgaggaggcccggaggaccaayaggaggatgctgtggaaatacgtccagtaccagaatgtcccaaggaacacctgggcaacagaatattggtcaagttgctgaccttgaagttcgagattga

SEQ ID NO: 6339 - DNA, 201 bp, Homo sapiens; identical to SEQ ID NO: 6309

SEQ ID NO: 6340 - DNA, 201 bp, Homo sapiens; identical to SEQ ID NO: 6312

SEQ ID NO: 6341 - DNA, 201 bp, Homo sapiens; identical to SEQ ID NO: 6310

SEQ ID NO: 6342 - DNA, 201 bp, Homo sapiens
atgtcactcttgtgtactatctatttttctcctctctgggaccaagtttctttttataaagcaataatatctctgttttcatttcagaacattgtgctgtytgtcagcatatgtatatcagctacaaaatatattcaactttgacttcttttgacaaaggactttaggaaaaagaggaacaaagacattatttgagaatta

SEQ ID NO: 6343 - DNA, 201 bp, Homo sapiens; identical to SEQ ID NO: 6314

SEQ ID NO: 6344 - DNA, 201 bp, Homo sapiens; identical to SEQ ID NO: 6315

SEQ ID NO: 6345 - DNA, 201 bp, Homo sapiens; identical to SEQ ID NO: 6316

SEQ ID NO: 6346 - DNA, 201 bp, Homo sapiens; identical to SEQ ID NO: 6317

SEQ ID NO: 6347 - DNA, 201 bp, Homo sapiens; identical to SEQ ID NO: 6319

SEQ ID NO: 6348 - DNA, 201 bp, Homo sapiens; identical to SEQ ID NO: 6318

SEQ ID NO: 6349 - DNA, 201 bp, Homo sapiens; identical to SEQ ID NO: 6294

SEQ ID NO: 6350 - DNA, 201 bp, Homo sapiens; identical to SEQ ID NO: 6295

SEQ ID NO: 6351 - DNA, 201 bp, Homo sapiens; identical to SEQ ID NO: 6296

SEQ ID NO: 6352 - DNA, 201 bp, Homo sapiens; identical to SEQ ID NO: 6326

SEQ ID NO: 6353 - DNA, 201 bp, Homo sapiens; identical to SEQ ID NO: 6297

SEQ ID NO: 6354 - DNA, 201 bp, Homo sapiens; identical to SEQ ID NO: 6298

SEQ ID NO: 6355 - DNA, 201 bp, Homo sapiens; identical to SEQ ID NO: 6299

SEQ ID NO: 6356 - DNA, 201 bp, Homo sapiens; identical to SEQ ID NO: 6300

SEQ ID NO: 6357 - DNA, 201 bp, Homo sapiens; identical to SEQ ID NO: 6301

SEQ ID NO: 6358 - DNA, 201 bp, Homo sapiens; identical to SEQ ID NO: 6302

SEQ ID NO: 6359 - DNA, 201 bp, Homo sapiens; identical to SEQ ID NO: 6303

SEQ ID NO: 6360 - DNA, 201 bp, Homo sapiens; identical to SEQ ID NO: 6304

SEQ ID NO: 6361 - DNA, 201 bp, Homo sapiens; identical to SEQ ID NO: 6305

SEQ ID NO: 6362 - DNA, 176 bp, Homo sapiens
attttgtctcctgtaacaatttacgcgccgtgtaactgtgaatctttcaaagcctcagttttatgaccctgtggakccagtggactttgaaggacttctgatgacacacctgaacagcctggatgtgcagcttgcccaggagctcggggacttcactgatgacgacttggacgtgg

SEQ ID NO: 6363 - DNA, 201 bp, Homo sapiens; identical to SEQ ID NO: 6308

SEQ ID NO: 6364 - DNA, 201 bp, Homo sapiens
tggtgagagaaacagtcttcaagtatgcctggttcttctttgagcttctggtgaaaagcatggcccagcacgtacataacatggacaaacgggacagtttycggaggactcgtttttctgaccgtttcatggatgacataactactattgttaatgtggaaaatgaacaggcggaaaagatgaacatcagcctggctttct

SEQ ID NO: 6365 - DNA, 183 bp, Homo sapiens
attttgtctcctgtaacaatttacgcgccgtgtaactgtgaatctttcaaagcctcagttttatgaccctgtggagccagtgractttgaaggacttctgatgacacacctgaacagcctggatgtgcagcttgcccaggagctcggggacttcactgatgacgacttggacgtggtgttcac

SEQ ID NO: 6366 - DNA, 201 bp, Homo sapiens; identical to SEQ ID NO: 6310

SEQ ID NO: 6367 - DNA, 201 bp, Homo sapiens; identical to SEQ ID NO: 6311

SEQ ID NO: 6368 - DNA, 201 bp, Homo sapiens; identical to SEQ ID NO: 6342

SEQ ID NO: 6369 - DNA, 201 bp, Homo sapiens; identical to SEQ ID NO: 6314

SEQ ID NO: 6370 - DNA, 201 bp, Homo sapiens; identical to SEQ ID NO: 6315

SEQ ID NO: 6371 - DNA, 201 bp, Homo sapiens; identical to SEQ ID NO: 6316

SEQ ID NO: 6372 - DNA, 201 bp, Homo sapiens; identical to SEQ ID NO: 6317

SEQ ID NO: 6373 - DNA, 201 bp, Homo sapiens; identical to SEQ ID NO: 6318

SEQ ID NO: 6374 - DNA, 201 bp, Homo sapiens; identical to SEQ ID NO: 6319

SEQ ID NO: 6375 - DNA, 201 bp, Homo sapiens
ggcgcccctcctaccccggctgcttggcagttgcagtgctgctgtctcgggggggttttcatctatgagggtgtttcctctaaacctacgagggaggaacmcctgatcttacagaaaataccacctcgagatgggtgctggtcctgttgatcccagtctctgccagaccaaggcgagtttccccactaataaagtgccggg

SEQ ID NO: 6376 - DNA, 152 bp, Homo sapiens
ttcatctatgagggtgtttcctctaaacctacgagggaggaacacctgatcttacagaaaataccacctcgagatgggtgctggtcctgttgatcccagtytctgccagaccaaggcgagtttccccactaataaagtgccgggtgtcagca

SEQ ID NO: 6377 - DNA, 150 bp, Homo sapiens
catctatgagggtgtttcctctaaacctacgagggaggaacacctgatcttacagaaaataccacctcgagatgggtgctggtcctgttgatcccagtctytgccagaccaaggcgagtttccccactaataaagtgccgggtgtcagca

SEQ ID NO: 6378 - DNA, 186 bp, Homo sapiens
ttggcagttgcagtgctgctgtctcgggggggttttcatctatgagggtgtttcctctaaacctacgagggaggaacacctgatcttacagaaaataccayctcgagatgggtgctggtcctgttgatcccagtctctgccagaccaaggcgagtttccccactaataaagtgccgggtgtcagca

SEQ ID NO: 6379 - DNA, 201 bp, Homo sapiens
gggggccggatgaggcgggaccctcaggcccggaaaactgcctgtgccacgtgacccgccgccggccagttaaaaggaggcgcctgctggcctccccttayagtgcttgttcggggcgctccgctggcttcttggacaattgcgccatgtgtgctgctcggctagcggcggcggcggcggcccagtcggtgtatgccttct

SEQ ID NO: 6380 - DNA, 201 bp, Homo sapiens
ttcctggtgggccctgacggtgtgcccctacgcaggtacagccgccgcttccagaccattgacatcgagcctgacatcgaagccctgctgtctcaagggcycagctgtgcctagggcgcccctcctaccccggctgcttggcagttgcagtgctgctgtctcgggggggttttcatctatgagggtgtttcctctaaacct

SEQ ID NO: 6381 - DNA, 201 bp, Homo sapiens; identical to SEQ ID NO: 6375

SEQ ID NO: 6382 - DNA, 155 bp, Homo sapiens
ttcatctatgagggtgtttcctctaaacctacgagggaggaacacctgatcttacagaaaataccacctcgagatgggtgctggtcctgttgatcccagtytctgccagaccaaggcgagtttccccactaataaagtgccgggtgtcagcagaa

SEQ ID NO: 6383 - DNA, 153 bp, Homo sapiens
catctatgagggtgtttcctctaaacctacgagggaggaacacctgatcttacagaaaataccacctcgagatgggtgctggtcctgttgatcccagtctytgccagaccaaggcgagtttccccactaataaagtgccgggtgtcagcagaa

SEQ ID NO: 6384 - DNA, 189 bp, Homo sapiens
ttggcagttgcagtgctgctgtctcgggggggttttcatctatgagggtgtttcctctaaacctacgagggaggaacacctgatcttacagaaaataccayctcgagatgggtgctggtcctgttgatcccagtctctgccagaccaaggcgagtttccccactaataaagtgccgggtgtcagcagaa

SEQ ID NO: 6385 - DNA, 201 bp, Homo sapiens; identical to SEQ ID NO: 6379

SEQ ID NO: 6386 - DNA, 201 bp, Homo sapiens; identical to SEQ ID NO: 6380

SEQ ID NO: 6387 - DNA, 201 bp, Homo sapiens
gggggccggatgaggcgggacctcaggcccggaaaactgcctgtgccacgtgacccgccgccggccagttaaaaggaggcgcctgctggcctccccttacygtgcttgttcggggcgctccgctggcttcttggacaattgcgccatgtgtgctgctcggctagcggcggcggcggcccagtcggtgtatgccttctcggc

SEQ ID NO: 6388 - DNA, 201 bp, Homo sapiens; identical to SEQ ID NO: 6380

SEQ ID NO: 6389 - DNA, 186 bp, Homo sapiens
tggcagttgcagtgctgctgtctcgggggggttttcatctatgagggtgtttcctctaaacctacgagggaggaacaccttgatcttacagaaaataccayctcgagatgggtgctggtcctgttgatcccagtctctgccagaccaaggcgagtttccccactaataaagtgccgggtgtcagca

SEQ ID NO: 6390 - DNA, 201 bp, Homo sapiens
ggcgcccctcctaccccggctgcttggcagttgcagtgctgctgtctcgggggggttttcatctatgagggtgtttcctctaaacctacgagggaggaacmccttgatcttacagaaaataccacctcgagatgggtgctggtcctgttgatcccagtctctgccagaccaaggcgagtttccccactaataaagtgccgg

SEQ ID NO: 6391 - DNA, 201 bp, Homo sapiens; identical to SEQ ID NO: 6390

SEQ ID NO: 6392 - DNA, 201 bp, Homo sapiens
ggcaatggtgtgagtgtcttggccctgtccctgccctggggtccagcaggtcatccctcccttcttctctctcctttggcgtttgttcctgtagtcactgsgctaatctccccctagcttcaagctgtacatagggcctcccagtgcaaatcctcctgcccataccgtgcacccttagaagcctgcgtgtgcatagagcgc

SEQ ID NO: 6393 - DNA, 201 bp, Homo sapiens
gtgggccacctgctggaagctgccagctgcccggctggcaatggtgtgagtgtcttggccctgtccctgccctggggtccagcaggtcatccctcccttcwtctctctcctttggcgtttgttcctgtagtcactgggctaatctccccctagcttcaagctgtacatagggcctcccagtgcaaatcctcctgcccatac

SEQ ID NO: 6394 - DNA, 201 bp, Homo sapiens
ccatccaggtgctggagaattcgatgtccatcacctcccagtactgtgctccaggggatgcctgcaggcctgggaacttcacctaccacatccctgtcagyagtggcaccccactgcacctcagcctgactctgcagatgaactcctcctcccccgtgtctgtggtgctgtgcagcctgaggtcaaaggaggaaccatgtg

SEQ ID NO: 6395 - DNA, 201 bp, Homo sapiens
aaggtaagtgggccacctgctggaagctgccagctgcccggctggcaatggtgtgagtgtcttggccctgtccctgccctggggtccagcaggtcatcccwcccttcttctctctcctttggcgtttgttcctgtagtcactgggctaatctccccctagcttcaagctgtacatagggcctcccagtgcaaatcctcctg

SEQ ID NO: 6396 - DNA, 201 bp, Homo sapiens
acacccagcagtcccagatgctgcaccagctcctgcagcagcacggagctgagctccctacacacccctccaagaagaggaagcactctgaatcccccccsagcaccctcaatgcccagatgctgaatggaatgatcaaacaggagcctgggaccgtgacagccctgcctctgcaccccactcgagccccatcgccaccct

SEQ ID NO: 6397 - DNA, 201 bp, Homo sapiens
tgttcctcacccactaccaaccctaccactggtcctagtcttggccccagctttaaccctggccatgttctcagcccaagtcccagccccagcaccaaccrctcaggccccagccagatggcccttctgccagtcaccaacatcagagccaagtcctggggtctttcagtcaatggcattggccactccaagcatcacaag

SEQ ID NO: 6398 - DNA, 201 bp, Homo sapiens
  misc_feature (1)...(201): n = A,T,C or G, or insertion/deletion polymorphism (see Tables 1-2)
aaaagggcttcagggaaggtaagtgggccacctgctggaagctgccagctgcccggctggcaatggtgtgagtgtcttggccctgtccctgccctggggtncagcaggtcatccctcccttcttctctctcctttggcgtttgttcctgtagtcactgggctaatctccccctagcttcaagctgtacatagggcctccca

SEQ ID NO: 6399 - DNA, 201 bp, Homo sapiens
  misc_feature (1)...(201): n = A,T,C or G, or insertion/deletion polymorphism (see Tables 1-2)
ccaggcctcctgcaggacagtgacagcctcagtggctcctacctggaccccaactaccagtccatcaagtggcagcctcatcagcagaacaagtgggcgancctgtacgatgctaactacaaggagctgcccatgctcacctaccgcgtggatgcggacaagggcttcaacttttcggtgggcgacgacgcctttgtgtgc

SEQ ID NO: 6400 - DNA, 201 bp, Homo sapiens
gaggaaccatgtgaggaggggagccttccacagagtctccacacccaccaggacacccagggcacctctcaccggtggccaataaccatcctgtccttccrtgaattcacctaccacttccgggtggcactgctgggtcaggccaactgcagttcagaggctctcgcccagccagccacagactaccacttccacttctac

SEQ ID NO: 6401 - DNA, 201 bp, Homo sapiens
agacaacctggagacgcgcattgatgagctggagcgctggagccacaagctggccaagctgcggcggctcgacagcctcaagtccaccggcagctcgggcrccttcagccatgcagggagccagttcagtcgggcgggcagcgtcccccacaagaagaggccccccaaggtggccagcaagtcatcgtccgtggttccgga

SEQ ID NO: 6402 - DNA, 201 bp, Homo sapiens
ggatagggaagagcagggggatgcaggaatagcagggatagcttgctcccagccccctcccttcttctctctcctttggcgtttgttcctgtagtcactgsgctaatctccccctagcttcaagctgtacatagggcctcccagtgcaaatcctcctgcccataccgtgcacccttagaagcctgcgtgtgcatagagcgc

SEQ ID NO: 6403 - DNA, 201 bp, Homo sapiens
ccccttttgccattgatctcaaagcacttgtcctcaggatagggaagagcagggggatgcaggaatagcagggatagcttgctcccagccccctcccttcwtctctctcctttggcgtttgttcctgtagtcactgggctaatctccccctagcttcaagctgtacatagggcctcccagtgcaaatcctcctgcccatac

SEQ ID NO: 6404 - DNA, 201 bp, Homo sapiens; identical to SEQ ID NO: 6394

SEQ ID NO: 6405 - DNA, 201 bp, Homo sapiens
tgcaggcccccttttgccattgatctcaaagcacttgtcctcaggatagggaagagcagggggatgcaggaatagcagggatagcttgctcccagcccccwcccttcttctctctcctttggcgtttgttcctgtagtcactgggctaatctccccctagcttcaagctgtacatagggcctcccagtgcaaatcctcctg

SEQ ID NO: 6406 - DNA, 201 bp, Homo sapiens; identical to SEQ ID NO: 6396

SEQ ID NO: 6407 - DNA, 201 bp, Homo sapiens; identical to SEQ ID NO: 6397

SEQ ID NO: 6408 - DNA, 201 bp, Homo sapiens; identical to SEQ ID NO: 6399
  misc_feature (1)...(201): n = A,T,C or G, or insertion/deletion polymorphism (see Tables 1-2)

SEQ ID NO: 6409 - DNA, 201 bp, Homo sapiens; identical to SEQ ID NO: 6400

SEQ ID NO: 6410 - DNA, 201 bp, Homo sapiens; identical to SEQ ID NO: 6401

SEQ ID NO: 6411 - DNA, 201 bp, Homo sapiens; identical to SEQ ID NO: 6392

SEQ ID NO: 6412 - DNA, 201 bp, Homo sapiens; identical to SEQ ID NO: 6393

SEQ ID NO: 6413 - DNA, 201 bp, Homo sapiens; identical to SEQ ID NO: 6394

SEQ ID NO: 6414 - DNA, 201 bp, Homo sapiens; identical to SEQ ID NO: 6395

SEQ ID NO: 6415 - DNA, 201 bp, Homo sapiens; identical to SEQ ID NO: 6396

SEQ ID NO: 6416 - DNA, 201 bp, Homo sapiens; identical to SEQ ID NO: 6397

SEQ ID NO: 6417 - DNA, 201 bp, Homo sapiens; identical to SEQ ID NO: 6398
  misc_feature (1)...(201): n = A,T,C or G, or insertion/deletion polymorphism (see Tables 1-2)

SEQ ID NO: 6418 - DNA, 201 bp, Homo sapiens; identical to SEQ ID NO: 6399
  misc_feature (1)...(201): n = A,T,C or G, or insertion/deletion polymorphism (see Tables 1-2)

SEQ ID NO: 6419 - DNA, 201 bp, Homo sapiens; identical to SEQ ID NO: 6400

SEQ ID NO: 6420 - DNA, 201 bp, Homo sapiens; identical to SEQ ID NO: 6401

SEQ ID NO: 6421 - DNA, 201 bp, Homo sapiens; identical to SEQ ID NO: 6402

SEQ ID NO: 6422 - DNA, 201 bp, Homo sapiens; identical to SEQ ID NO: 6403

SEQ ID NO: 6423 - DNA, 201 bp, Homo sapiens; identical to SEQ ID NO: 6394

SEQ ID NO: 6424 - DNA, 201 bp, Homo sapiens; identical to SEQ ID NO: 6405

SEQ ID NO: 6425 - DNA, 201 bp, Homo sapiens; identical to SEQ ID NO: 6396

SEQ ID NO: 6426 - DNA, 201 bp, Homo sapiens; identical to SEQ ID NO: 6397

SEQ ID NO: 6427 - DNA, 201 bp, Homo sapiens; identical to SEQ ID NO: 6399
  misc_feature (1)...(201): n = A,T,C or G, or insertion/deletion polymorphism (see Tables 1-2)

SEQ ID NO: 6428 - DNA, 201 bp, Homo sapiens; identical to SEQ ID NO: 6400

SEQ ID NO: 6429 - DNA, 201 bp, Homo sapiens; identical to SEQ ID NO: 6401

SEQ ID NO: 6430 - DNA, 201 bp, Homo sapiens; identical to SEQ ID NO: 6399
  misc_feature (1)...(201): n = A,T,C or G, or insertion/deletion polymorphism (see Tables 1-2)

SEQ ID NO: 6431 - DNA, 201 bp, Homo sapiens; identical to SEQ ID NO: 6396

SEQ ID NO: 6432 - DNA, 201 bp, Homo sapiens
agacaacctggagacgcgcattgatgagctggagcgctggagccacaagctggccaagctgcggcggctcgacagcctcaagtccaccggcagctcgggcrccttcagccatgcagggagccagttcagtcgggcgggcagcgtcccccacaagaagaggccccccaaggtggccagcaaggtagggtcatcgtccgtggt

SEQ ID NO: 6433 - DNA, 201 bp, Homo sapiens
ggaagagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcagg

SEQ ID NO: 6434 - DNA, 201 bp, Homo sapiens
gatactcaactcattattgaaaaggccgaacatggagatcaagattatatctggcactgcattgatctcttcttagatttcattactgtcttcagaaaacycatgatgatcctggccatgaatgaaaaggataagaagaaagagaagaaatgaagtgaccatccagcctttcccaattagacttcctctccttccacccct

SEQ ID NO: 6435 - DNA, 201 bp, Homo sapiens
gcagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccattgttaactcagcctcaaatctcaac

SEQ ID NO: 6436 - DNA, 201 bp, Homo sapiens
ttgctggatttgcattccttacaggagttggcctgggccctgccctggagttttgtattgctgtcaaccccagcatccttcccactgctttcatgggcacrgcaatgatctttacctgcttcaccctcagtgcactctatgccaggcgccgtagctacctctttctgggaggtatcttgatgtcagccctgagcttgttgc

SEQ ID NO: 6437 - DNA, 201 bp, Homo sapiens
aatatagtttggagtttggcttcatcttcctggggttcccctcactcccttttttgtcaaccccatctgtagcctcttcctctactcaggcagtcgacccrccacgatgagaagtgggaccagcagagggcgccaacttcaggagtccgctttcccaccaggcttcattcacccagtggacctgaactgtttggtagagcc

SEQ ID NO: 6438 - DNA, 201 bp, Homo sapiens
ttacaggagttggcctgggccctgccctggagttttgtattgctgtcaaccccagcatccttcccactgctttcatgggcacggcaatgatctttacctgyttcaccctcagtgcactctatgccaggcgccgtagctacctctttctgggaggtatcttgatgtcagccctgagcttgttgcttttgtcttccctgggga

SEQ ID NO: 6439 - DNA, 201 bp, Homo sapiens
tcctctattttgaattttttgatcaaaaaactgattagcagaatatagtttggagtttggcttcatcttcctggggttcccctcactcccttttttgtcarccccatctgtagcctcttcctctactcaggcagtcgacccgccacgatgagaagtgggaccagcagagggcgccaacttcaggagtccgctttcccacca

SEQ ID NO: 6440 - DNA, 201 bp, Homo sapiens
ctgagagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcagg

SEQ ID NO: 6441 - DNA, 201 bp, Homo sapiens; identical to SEQ ID NO: 6434

SEQ ID NO: 6442 - DNA, 201 bp, Homo sapiens; identical to SEQ ID NO: 6435

SEQ ID NO: 6443 - DNA, 201 bp, Homo sapiens; identical to SEQ ID NO: 6436

SEQ ID NO: 6444 - DNA, 201 bp, Homo sapiens; identical to SEQ ID NO: 6437

SEQ ID NO: 6445 - DNA, 201 bp, Homo sapiens; identical to SEQ ID NO: 6438

SEQ ID NO: 6446 - DNA, 201 bp, Homo sapiens; identical to SEQ ID NO: 6439

SEQ ID NO: 6447 - DNA, 201 bp, Homo sapiens
aacctagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcagg

SEQ ID NO: 6448 - DNA, 201 bp, Homo sapiens; identical to SEQ ID NO: 6434

SEQ ID NO: 6449 - DNA, 201 bp, Homo sapiens; identical to SEQ ID NO: 6435

SEQ ID NO: 6450 - DNA, 201 bp, Homo sapiens; identical to SEQ ID NO: 6436

SEQ ID NO: 6451 - DNA, 201 bp, Homo sapiens
gtactttgtggtttcctctattttgaattttttggttcccctcactcccttttttgtcaaccccatctgtagcctcttcctctactcaggcagtcgacccrccacgatgagaagtgggaccagcagagggcgccaacttcaggagtccgctttcccaccaggcttcattcacccagtggacctgaactgtttggtagagcc

SEQ ID NO: 6452 - DNA, 201 bp, Homo sapiens; identical to SEQ ID NO: 6438

SEQ ID NO: 6453 - DNA, 201 bp, Homo sapiens
tggtgtgttctgtgataatgaaaagcatcagaaaagcttttgtactttgtggtttcctctattttgaattttttggttcccctcactcccttttttgtcarccccatctgtagcctcttcctctactcaggcagtcgacccgccacgatgagaagtgggaccagcagagggcgccaacttcaggagtccgctttcccacca

SEQ ID NO: 6454 - DNA, 201 bp, Homo sapiens; identical to SEQ ID NO: 6440

SEQ ID NO: 6455 - DNA, 129 bp, Homo sapiens
ctgatggcaacacctcatagccatgaaactgaacagaaaagactgggacttcttgctggatttgcattccttacagatttcattactgtcttcagaaaacycatgatgatcctggccatgaatgaaaag

SEQ ID NO: 6456 - DNA, 201 bp, Homo sapiens; identical to SEQ ID NO: 6440

SEQ ID NO: 6457 - DNA, 201 bp, Homo sapiens; identical to SEQ ID NO: 6434

SEQ ID NO: 6458 - DNA, 201 bp, Homo sapiens; identical to SEQ ID NO: 6435

SEQ ID NO: 6459 - DNA, 201 bp, Homo sapiens; identical to SEQ ID NO: 6436

SEQ ID NO: 6460 - DNA, 201 bp, Homo sapiens; identical to SEQ ID NO: 6451

SEQ ID NO: 6461 - DNA, 201 bp, Homo sapiens; identical to SEQ ID NO: 6438

SEQ ID NO: 6462 - DNA, 201 bp, Homo sapiens; identical to SEQ ID NO: 6453

SEQ ID NO: 6463 - DNA, 196 bp, Homo sapiens
agtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcagg

SEQ ID NO: 6464 - DNA, 201 bp, Homo sapiens; identical to SEQ ID NO: 6434

SEQ ID NO: 6465 - DNA, 201 bp, Homo sapiens; identical to SEQ ID NO: 6435

SEQ ID NO: 6466 - DNA, 201 bp, Homo sapiens; identical to SEQ ID NO: 6436

SEQ ID NO: 6467 - DNA, 201 bp, Homo sapiens; identical to SEQ ID NO: 6437

SEQ ID NO: 6468 - DNA, 201 bp, Homo sapiens; identical to SEQ ID NO: 6438

SEQ ID NO: 6469 - DNA, 201 bp, Homo sapiens; identical to SEQ ID NO: 6439

SEQ ID NO: 6470 - DNA, 201 bp, Homo sapiens; identical to SEQ ID NO: 6447

SEQ ID NO: 6471 - DNA, 201 bp, Homo sapiens; identical to SEQ ID NO: 6434

SEQ ID NO: 6472 - DNA, 201 bp, Homo sapiens; identical to SEQ ID NO: 6435

SEQ ID NO: 6473 - DNA, 201 bp, Homo sapiens; identical to SEQ ID NO: 6436

SEQ ID NO: 6474 - DNA, 201 bp, Homo sapiens; identical to SEQ ID NO: 6437

SEQ ID NO: 6475 - DNA, 201 bp, Homo sapiens; identical to SEQ ID NO: 6438

SEQ ID NO: 6476 - DNA, 201 bp, Homo sapiens; identical to SEQ ID NO: 6439

SEQ ID NO: 6477 - DNA, 201 bp, Homo sapiens; identical to SEQ ID NO: 6434

SEQ ID NO: 6478 - DNA, 201 bp, Homo sapiens
ttacaggagttggcctgggccctgccctggagttttgtattgctgtcaaccccagcatccttcccactgctttcatgggcacagcaatgatctttacctgyttcaccctcagtgcactctatgccaggcgccgtagctacctctttctgggaggtatcttgatgtcagccctgagcttgttgcttttgtcttccctgggga

SEQ ID NO: 6479 - DNA, 201 bp, Homo sapiens
tcctctattttgaattttttgatcaaaaaactgattagcagaatatagtttggagtttggcttcatcttcctggggttcccctcactcccttttttgtcarccccatctgtagcctcttcctctactcaggcagtcgacccgccacgatgagaagtgggaccagccagagggcgccaacttcaggagtccgctttcccacc

SEQ ID NO: 6480 - DNA, 201 bp, Homo sapiens; identical to SEQ ID NO: 6433

SEQ ID NO: 6481 - DNA, 201 bp, Homo sapiens
aatatagtttggagtttggcttcatcttcctggggttcccctcactcccttttttgtcaaccccatctgtagcctcttcctctactcaggcagtcgacccrccacgatgagaagtgggaccagccagagggcgccaacttcaggagtccgctttcccaccaggcttcattcacccagtggacctgaactgtttggtagagc

SEQ ID NO: 6482 - DNA, 201 bp, Homo sapiens; identical to SEQ ID NO: 6436

SEQ ID NO: 6483 - DNA, 201 bp, Homo sapiens
ccagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccattgttaactcagcctcaaatctcaac

SEQ ID NO: 6484 - DNA, 201 bp, Homo sapiens
ggaagcattttcaggctggtcatgtctgtggggacaatatggacctcatagatgggcagcccacaggatctgtgaggatttcatttggatacatgtcgacrctggatgatgtccaggcctttcttaggttcatcatagacactcgcctgcactcatcaggggactggcctgtccctcaggcccatgctgacaccggggaga

SEQ ID NO: 6485 - DNA, 201 bp, Homo sapiens
ttactcccaggtggacaaaatggccagtctttacaacatccacctgcgaactggctgcttctgtaacactggggcctgccagaggcacctgggcataagcracgagatggtcaggaagcattttcaggctggtcatgtctgtggggacaatatggacctcatagatgggcagcccacaggatctgtgaggatttcatttgg

SEQ ID NO: 6486 - DNA, 201 bp, Homo sapiens
tgttatcgcgctaaaacatggatttgacaccctagagcgcctcacaggtggaatggagaatataaagcagcacaccttcaccttggctcagtatacctacrtggccctgtcctctctccagtaccccaatggagcccctgtggtgcggatttacagcgattctgagttcagcagccctgaggttcagggcccgatcatcaa

SEQ ID NO: 6487 - DNA, 201 bp, Homo sapiens
ggcccagagagcagtgggagtcgcttctgttacctcaccgacagccacacctccgtagtgggtatgaggaacgtgaccatggctataaatgtcatatccaycccggtcaggccagaggacctgtggtctgcagaggaacgtggtgcttcagccagcaacccagactgccagctgccgcatctcttctgctacccagctcag

SEQ ID NO: 6488 - DNA, 201 bp, Homo sapiens
agtcgtgaaacaaaggtgaactttggcatgtacctgatgcatgcatcattggatttatcctccccatgtttcctgtctgtaggatctcaggtgctccctgygttgaaagagaatgtggaaggtcatgatttacctgcatctgagaaacaccaggatgttacctcctaaaaaaaatttttagcatacattaaagtttctctt

SEQ ID NO: 6489 - DNA, 201 bp, Homo sapiens
cctcatagatgggcagcccacaggatctgtgaggatttcatttggatacatgtcgacgctggatgatgtccaggcctttcttaggttcatcatagacactygcctgcactcatcaggggactggcctgtccctcaggcccatgctgacaccggggagactggagccccatcagcagacagccaggctgatgttatacctgc

SEQ ID NO: 6490 - DNA, 201 bp, Homo sapiens
tcagattcgccaaagcagggtctgtgctgacagagtaagtacttatgattgtggagaaaaaatttcaagctggttgtcaacattttttggccgtccttgtmatttgatcaaacaaagttcaaactctcaaaggaatgcaaagaagaaacatggaaaagatcaacttcctggtacaatggccaccctttctctggtgaatga

SEQ ID NO: 6491 - DNA, 201 bp, Homo sapiens
tcagataccccctgtcctggatagaagaggtcaagtctgggcggttgcgccctgtgagcacgcctgggaagtggtttgtgctgctggatgcagcctcctaygtgagcacctcgcctttggacctgtcagctcaccaggccgactttgtccccatctccttctataagatcttcgggtttcctacaggcctgggcgctctgc

SEQ ID NO: 6492 - DNA, 201 bp, Homo sapiens
tgccagctgccgcatctcttctgctacccagctcagagtaacttttctggagtcagataccccctgtcctggatagaagaggtcaagtctgggcggttgcrccctgtgagcacgcctgggaagtggtttgtgctgctggatgcagcctcctacgtgagcacctcgcctttggacctgtcagctcaccaggccgactttgtc

SEQ ID NO: 6493 - DNA, 136 bp, Homo sapiens
ctggatggactagccggggccatggccggcgcggcrgcggagtcagggcgggagctgtggaccttcgcgggttcccgggacccgagcgcaccgcggctagcctacggctacggcccgggcagcctgcgcgagctgc

SEQ ID NO: 6494 - DNA, 201 bp, Homo sapiens
cagcctctgcgtacctagcaggagaagacttctacatcccgaggcagtcggtagctcagaggtttgaagatggcaccatctcattccttgatgttatcgcrctaaaacatggatttgacaccctagagcgcctcacaggtggaatggagaatataaagcagcacaccttcaccttggctcagtatacctacatggccctgt

SEQ ID NO: 6495 - DNA, 201 bp, Homo sapiens
ccatggctataaatgtcatatccatcccggtcaggccagaggacctgtggtctgcagaggaacgtggtgcttcagccagcaacccagactgccagctgccrcatctcttctgctacccagctcagagtaacttttctggagtcagataccccctgtcctggatagaagaggtcaagtctgggcggttgcgccctgtgagca

SEQ ID NO: 6496 - DNA, 201 bp, Homo sapiens
ctcccgtgacttcctgcggcacttcggctgccctgtcggctcccccatgaacccagggcagctgtgtgaggtgtggtagacctggatcaggggagaaatgsccagctgtcaccagacctggggcagctctcctgacaaagctgtttgctcttgggttgggaggaagcaaatgcaagctgggctgggtctagtccctccccc

SEQ ID NO: 6497 - DNA, 201 bp, Homo sapiens
aagaagtcctgtgtgccgaggtggcagacctgcatctccaacacggatgacgcccttggctttgctttggggtccctcttcgtgaaggccacgtttgaccrgcaaagcaaagaaattgcagaggggatgatcagcgaaatccggaccgcatttgaggaggccctgggacagctggtttggatggatgagaagacccgccag

SEQ ID NO: 6498 - DNA, 201 bp, Homo sapiens
tgggtctagtccctcccccccacaggtgacatgagtacagaccctcctcaatcaccacattgtgcctctgctttgggggtgcccctgcctccagcagagcycccaccattcactgtgacatctttccgtgtcaccctgcctggaagaggtctgggtggggaggccagttcccataggaaggagtctgcctcttctgtcccc

SEQ ID NO: 6499 - DNA, 201 bp, Homo sapiens
acattacggggccctgggaccaggacaactttatggaggtgttgaaggcagtagcagggacctacagggccaccccattcttcaccgtctacatcagtgcygactctaagagttccaacagcaatgttatccaggtggaccagtctgggctctttctgccctctcgggattactacttaaacagaactgccaatgagaaag

SEQ ID NO: 6500 - DNA, 201 bp, Homo sapiens
gccaggcagccaaggagaaagcagatgccatctatgatatgattggtttcccagactttatcctggagcccaaagagctggatgatgtttatgacgggtaygaaatttctgaagattctttcttccaaaacatgttgaatttgtacaacttctctgccaaggttatggctgaccagctccgcaagcctcccagccgagacc

SEQ ID NO: 6501 - DNA, 201 bp, Homo sapiens; identical to SEQ ID NO: 6496

SEQ ID NO: 6502 - DNA, 201 bp, Homo sapiens
ggggatgatcagcgaaatccggaccgcatttgaggaggccctgggacagctggtttggatggatgagaagacccgccaggcagccaaggagaaagtgagcratgccatctatgatatgattggtttcccagactttatcctggagcccaaagagctggatgatgtttatgacgggtacgaaatttctgaagattctttctt

SEQ ID NO: 6503 - DNA, 201 bp, Homo sapiens; identical to SEQ ID NO: 6497

SEQ ID NO: 6504 - DNA, 201 bp, Homo sapiens; identical to SEQ ID NO: 6498

SEQ ID NO: 6505 - DNA, 201 bp, Homo sapiens; identical to SEQ ID NO: 6499

SEQ ID NO: 6506 - DNA, 201 bp, Homo sapiens
aggcagccaaggagaaagtgagcgatgccatctatgatatgattggtttcccagactttatcctggagcccaaagagctggatgatgtttatgacgggtaygaaatttctgaagattctttcttccaaaacatgttgaatttgtacaacttctctgccaaggttatggctgaccagctccgcaagcctcccagccgagacc

SEQ ID NO: 6507 - DNA, 201 bp, Homo sapiens; identical to SEQ ID NO: 6496

SEQ ID NO: 6508 - DNA, 201 bp, Homo sapiens; identical to SEQ ID NO: 6502

SEQ ID NO: 6509 - DNA, 201 bp, Homo sapiens; identical to SEQ ID NO: 6497

SEQ ID NO: 6510 - DNA, 201 bp, Homo sapiens; identical to SEQ ID NO: 6498

SEQ ID NO: 6511 - DNA, 201 bp, Homo sapiens; identical to SEQ ID NO: 6499

SEQ ID NO: 6512 - DNA, 201 bp, Homo sapiens; identical to SEQ ID NO: 6506

SEQ ID NO: 6513 - DNA, 201 bp, Homo sapiens
tagttttcccagccggaggattcttcgaagagcgcttagtaaaggacggaagttccacgtgtttgtgttgagcaactgcaggtggtgggcggagacaccarcgccccgccttctgcatcctgccttccgtattggctgaagggccggcggctctggctgcccggcggttgagagcatggcctctccaggggcaggtagggc

SEQ ID NO: 6514 - DNA, 201 bp, Homo sapiens
tggtccgctttcctcccgcctgtctatccctcttggaggacgcctgcgttgggacgcgagatccagctccttcagagtcccggctgtatttagtcaaggcwaacaggagtaagagattgttggtcccggggccctctggagaaagacagtccctcagagtttgagcgttgggggtacccaagaccctgtccggaccctcgg

SEQ ID NO: 6515 - DNA, 103 bp, Homo sapiens
camcaggctaagcgccgatccgagtagccagtcttcatttactccactaaaatgtaatttttctgcatttgtctcctctgatgcactccacgctccataggag

SEQ ID NO: 6516 - DNA, 201 bp, Homo sapiens
agacaccagcgccccgccttctgcatcctgccttccgtattggctgaagggccggcggctctggctgcccggcggttgagagcatggcctctccaggggcmggtagggcgcctccggagttaccggagcggaactgcgggtaccgcgaagtcgagtactgggatcagcgctaccaaggcgcagccgattctgccccctacg

SEQ ID NO: 6517 - DNA, 201 bp, Homo sapiens
tttgtgttgagcaactgcaggtggtgggcggagacaccagcgccccgccttctgcatcctgccttccgtattggctgaagggccggcggctctggctgccmggcggttgagagcatggcctctccaggggcaggtagggcgcctccggagttaccggagcggaactgcgggtaccgcgaagtcgagtactgggatcagcgc

SEQ ID NO: 6518 - DNA, 160 bp, Homo sapiens
ggctgaagggccggcggctctggctgcccggcggttgagagcatggcctctccaggggcmggtagggcgcctccggagttaccggagcggaactgcgggtaccgcgaagtcgagtactgggatcagcgctaccaaggcgcagccgattctgccccctacg

SEQ ID NO: 6519 - DNA, 201 bp, Homo sapiens
gggccacagatgtcatccaaaggttcagagcagtccccatttgggttcccaggggcaagacgcaggggtccaaggtaaaatcggatctgggcccttggaargtgatgataccttggggagaaggggtctgccagaaagcctcctggggtcaggcctgggcagactggccatgtggttggtaaccgtgtcgggggcttgtct

SEQ ID NO: 6520 - DNA, 129 bp, Homo sapiens
ggctgaagggccggcggctctggctgccmggcggttgagagcatggcctctccaggggcaggtagggcgcctccggagttaccggagcggaactgcgggtaccgcgaagtcgagtactgggatcagcgc

SEQ ID NO: 6521 - DNA, 201 bp, Homo sapiens
gttccccaacctcctctgccaccacaccaaaccaccagtgatgcatcccctggggcaaagctcatcataacccctctgcacaccagccagcctggagaccrttgttcctggggcctgttactgatcctcatctagccttgatttatccacaggagactgcaggctttgaacctagattgctttatgtttctcaccctagct

SEQ ID NO: 6522 - DNA, 201 bp, Homo sapiens
gccattctgccctgggctcctcaggtagttggaattcctgacttaggacttggggttgggtccaaggtgcttacatcccaggggcctcatgcctaagataragggtgggagcgaacccacatgaaccaatacagcccagctccaactagatccagattccaggtttcttgcttctttcttgggttcctcagttctctcctg

SEQ ID NO: 6523 - DNA, 201 bp, Homo sapiens
tcctgccattctgccctgggctcctcaggtagttggaattcctgacttaggacttggggttgggtccaaggtgcttacatcccaggggcctcatgcctaaratagagggtgggagcgaacccacatgaaccaatacagcccagctccaactagatccagattccaggtttcttgcttctttcttgggttcctcagttctct

SEQ ID NO: 6524 - DNA, 201 bp, Homo sapiens
ttatggctggtccctgaggcatgctacctatggcagcggtttccacttccatctctacctcatgcacaagggcgggaagctcagtgtggcccagctggctytgggggcccaaatcctctcaccccccagacctcccacctcaccttgcttccttcaggactcagatcatgaggacttccttagtgccattcagctctgagg

SEQ ID NO: 6525 - DNA, 201 bp, Homo sapiens
  misc_feature (1)...(201): n = A,T,C or G, or insertion/deletion polymorphism (see Tables 1-2)
ctggggaacgagatccctggaccgtgtcctctgaaggtgtccacactgtggaccaggtgttgagtgaggtgagccgcgtgcttgtccctggaggccggttnatctcaatgacttctgctgccccccactttcggaccagacactatgcccaagcctattatggctggtccctgaggcatgctacctatggcagcggtttcc

SEQ ID NO: 6526 - DNA, 201 bp, Homo sapiens; identical to SEQ ID NO: 6496

SEQ ID NO: 6527 - DNA, 201 bp, Homo sapiens; identical to SEQ ID NO: 6502

SEQ ID NO: 6528 - DNA, 201 bp, Homo sapiens; identical to SEQ ID NO: 6497

SEQ ID NO: 6529 - DNA, 201 bp, Homo sapiens; identical to SEQ ID NO: 6498

SEQ ID NO: 6530 - DNA, 201 bp, Homo sapiens; identical to SEQ ID NO: 6499

SEQ ID NO: 6531 - DNA, 201 bp, Homo sapiens; identical to SEQ ID NO: 6506

SEQ ID NO: 6532 - DNA, 201 bp, Homo sapiens
gcgctgcgagaactcaccaggcagcttccgctgcgtgtgcggcccgggcttccgagccggcccacgggctgcggaatgcctggatgtggacgagtgccacsgcgtgccgccgccgtgtgacctcgggcgctgcgagaacacgccaggcagcttcctgtgcgtgtgccccgccgggtaccaggctgcaccgcacggagccag

SEQ ID NO: 6533 - DNA, 201 bp, Homo sapiens
caggctcgcagccccaggcacctgctagccccgttctgcccgccaggccacctccgccacccctgccccgccgacccagcacacctaggcagggccctgtrgggagtgggcgccgggagtgctactttgacacagcggccccggatgcatgtgacaacatcctggctcggaatgtgacatggcaggagtgctgctgtactg

SEQ ID NO: 6534 - DNA, 201 bp, Homo sapiens
gagaacacccctggctcctaccgctgcacaccagcctgtgaccctggctatcagcccacgccagggggcggatgccaggatgtggacgaatgccggaaccrgtccttctgcggtgcccacgccgtgtgccagaacctgcccggctccttccagtgcctctgtgaccagggttacgagggggcacgggatgggcgtcactgc

SEQ ID NO: 6535 - DNA, 201 bp, Homo sapiens
agggttacgagggggcacgggatgggcgtcactgcgtggatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgctggcacgttcccaggct

SEQ ID NO: 6536 - DNA, 201 bp, Homo sapiens
tccttccgctgcatctgccgcccgggattcgcacccacgcaccagccgcaccactgtgcgcccgcacggccccgggcctgagccctggcacccgctggccrcccacccgcgcccgccactcggggcccctgccgcgcatcctgcagcccgcttatgcgtatgtgcacggggccgcccgcctggacctggagaagggaccta

SEQ ID NO: 6537 - DNA, 201 bp, Homo sapiens
gccgccctgtgggcccggccgctgtgacaacacggcaggctcctttcactgtgcctgccctgctggcttccgctcccgagggcccggggccccctgccaaratgtggatgagtgtgcccgaagccccccaccctgcacctacggccggtgtgagaacacagaaggcagcttccagtgtgtctgccccatgggcttccaacc

SEQ ID NO: 6538 - DNA, 201 bp, Homo sapiens
gaaaatgtcgaaggctccttcctctgtgtctgccccaacagcccggaagagtttgaccccatgactggacgctgtgttcccccacgaacttctgctggcaygttcccaggctcgcagccccaggcacctgctagccccgttctgcccgccaggccacctccgccacccctgccccgccgacccagcacacctaggcagggc

SEQ ID NO: 6539 - DNA, 201 bp, Homo sapiens
cgagaacacgccaggcagcttcctgtgcgtgtgccccgccgggtaccaggctgcaccgcacggagccagctgccaggatgtggatgaatgcacccagagcscaggcctgtgtggccgaggggcctgcaagaacctgcctggctctttccgctgtgtttgcccggctggcttccggggctcggcgtgtgaagaggatgtgga

SEQ ID NO: 6540 - DNA, 201 bp, Homo sapiens
ctcggcctccgacctccgctacaacaccagacccctgggccaggagccaccccgagtgtcactcagccagcctcgtaccctgccagccacctctcggccawctgcaggctttctgcccacccatcgcctggagccccggcctgaaccccggcccgatccccggcccggccctgagcttcccttgcccagcatccctgcctg

SEQ ID NO: 6541 - DNA, 201 bp, Homo sapiens
ccccggtcctgtgtcccttgatctgtcacaatggcggtgtgtgcgtgaagcctgaccgctgcctctgtcccccggacttcgctggcaagttctgccagttrcactcctcgggcgcccggcccccggccccggctataccaggcctcacccgctccgtgtacactatgccactggccaaccaccgcgacgacgagcacggcg

SEQ ID NO: 6542 - DNA, 201 bp, Homo sapiens
tccctcacggcgagtgcctcaacactgacggctcctttgcctgtacttgtgcccctggctaccgacccggaccccgcggagcctcttgcctcgacgttgaygagtgcagcgaggaggacctttgccagagcggcatctgtaccaacaccgacggctccttcgagtgcatctgtcctccgggacaccgcgctggcccggacc

SEQ ID NO: 6543 - DNA, 201 bp, Homo sapiens
aggtgtgcaagagtggcgtgtgtgtgaacacggccccgggctactcatgctattgcagcaacggctactactaccacacacagcggctggagtgcatcgayaatgacgagtgcgccgatgaggaaccggcctgtgagggcggccgctgtgtcaacactgtgggctcttatcactgtacctgcgagcccccactggtgctgg

SEQ ID NO: 6544 - DNA, 201 bp, Homo sapiens
ctgccgcatccagcagtgcccgggcaccgagacagctgagtaccagtcattgtgccctcacggccggggctacctggcgcccagtggagacctgagcctcyggagagacgtggacgaatgtcagctcttccgagaccaggtgtgcaagagtggcgtgtgtgtgaacacggccccgggctactcatgctattgcagcaacgg

SEQ ID NO: 6545 - DNA, 201 bp, Homo sapiens
ggatgagtgtgcccgaagccccccaccctgcacctacggccggtgtgagaacacagaaggcagcttccagtgtgtctgccccatgggcttccaacccaacrctgctggctccgagtgcgaggatgtggatgagtgtgagaaccacctcgcatgccctgggcaggagtgtgtgaactcgcccggctccttccagtgcagggc

SEQ ID NO: 6546 - DNA, 201 bp, Homo sapiens
cgctgctggctccgagtgcgaggatgtggatgagtgtgagaaccacctcgcatgccctgggcaggagtgtgtgaactcgcccggctccttccagtgcaggrcctgtccttctggccaccacctgcaccgtggcagatgcactgatgtggacgaatgcagttcgggtgcccctccctgtggtccccacggccactgcactaa

SEQ ID NO: 6547 - DNA, 201 bp, Homo sapiens
  misc_feature (1)...(201): n = A,T,C or G, or insertion/deletion polymorphism (see Tables 1-2)
cggtgtgtgcgtgaagcctgaccgctgcctctgtcccccggacttcgctggcaagttctgccagttgcactcctcgggcgcccggcccccggccccggctntaccaggcctcacccgctccgtgtacactatgccactggccaaccaccgcgacgacgagcacggcgtggcatctatggtgagcgtccacgtggagcaccc

SEQ ID NO: 6548 - DNA, 201 bp, Homo sapiens
ggggcaccccgcttcgacatgccagactttgaggacgatggtggcccctatggcgaatctgaggctcctgcgccacctggcccgggcacccgctggccctwtcggtcccgggacacccgccgctccttcccagagcccgaggagcctcctgaaggtggaagctatgctggttccctggctgagccctacgaggagctggag

SEQ ID NO: 6549 - DNA, 201 bp, Homo sapiens
cctgcgagcccccactggtgctggatggctcgcagcgccgctgcgtctccaacgagagccagagcctcgatgacaatctgggagtgtgctggcaggaagtrggggctgacctcgtgtgcagccaccctcggctggaccgtcaggccacctacacagagtgctgctgcctgtatggagaggcctggggcatggactgcgccc

SEQ ID NO: 6550 - DNA, 201 bp, Homo sapiens; identical to SEQ ID NO: 6532

SEQ ID NO: 6551 - DNA, 201 bp, Homo sapiens; identical to SEQ ID NO: 6533

SEQ ID NO: 6552 - DNA, 201 bp, Homo sapiens
atcctgggtaccacgcgggccccgagggcacctgtgacgatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgctggcacgttcccaggct

SEQ ID NO: 6553 - DNA, 201 bp, Homo sapiens
aacgcgcgttgcctcaacacggatggctccttccgctgcatctgccgcccgggattcgcacccacgcaccagccgcaccactccctggcacccgctggccrcccacccgcgcccgccactcggggcccctgccgcgcatcctgcagcccgcttatgcgtatgtgcacggggccgcccgcctggacctggagaagggaccta

SEQ ID NO: 6554 - DNA, 201 bp, Homo sapiens; identical to SEQ ID NO: 6537

SEQ ID NO: 6555 - DNA, 201 bp, Homo sapiens
agaatccagaatatagaagtttctgacaaaaaggacctgaaaaatcactgattctagaataggggagtgtcaaggggagttcatacccatgaatctccacyggtaggaatatcttgcatgccaggatgtctggaatgctgagaattataggatacagaaaggaacctggattactaggaaatctagagaatgggagagatc

SEQ ID NO: 6556 - DNA, 201 bp, Homo sapiens; identical to SEQ ID NO: 6538

SEQ ID NO: 6557 - DNA, 201 bp, Homo sapiens; identical to SEQ ID NO: 6539

SEQ ID NO: 6558 - DNA, 201 bp, Homo sapiens; identical to SEQ ID NO: 6540

SEQ ID NO: 6559 - DNA, 201 bp, Homo sapiens; identical to SEQ ID NO: 6541

SEQ ID NO: 6560 - DNA, 201 bp, Homo sapiens; identical to SEQ ID NO: 6542

SEQ ID NO: 6561 - DNA, 201 bp, Homo sapiens; identical to SEQ ID NO: 6543

SEQ ID NO: 6562 - DNA, 201 bp, Homo sapiens
gggacagactaggagtagagaatactagaacatgctaattctagaattccatagtttctggaatgccagagcttctgaaacatagtagagaggggtctcgmacattaggacatctcggacacaaggatattctggagtgctcatggattaacaatattagagttctcccctgcttatcagagaatccagaatatagaagtt

SEQ ID NO: 6563 - DNA, 201 bp, Homo sapiens; identical to SEQ ID NO: 6544

SEQ ID NO: 6564 - DNA, 201 bp, Homo sapiens; identical to SEQ ID NO: 6545

SEQ ID NO: 6565 - DNA, 201 bp, Homo sapiens; identical to SEQ ID NO: 6546

SEQ ID NO: 6566 - DNA, 201 bp, Homo sapiens; identical to SEQ ID NO: 6547
  misc_feature (1)...(201): n = A,T,C or G, or insertion/deletion polymorphism (see Tables 1-2)

SEQ ID NO: 6567 - DNA, 201 bp, Homo sapiens; identical to SEQ ID NO: 6548

SEQ ID NO: 6568 - DNA, 201 bp, Homo sapiens; identical to SEQ ID NO: 6549

SEQ ID NO: 6569 - DNA, 201 bp, Homo sapiens; identical to SEQ ID NO: 6532

SEQ ID NO: 6570 - DNA, 201 bp, Homo sapiens; identical to SEQ ID NO: 6533

SEQ ID NO: 6571 - DNA, 201 bp, Homo sapiens; identical to SEQ ID NO: 6534

SEQ ID NO: 6572 - DNA, 201 bp, Homo sapiens; identical to SEQ ID NO: 6535

SEQ ID NO: 6573 - DNA, 201 bp, Homo sapiens; identical to SEQ ID NO: 6536

SEQ ID NO: 6574 - DNA, 201 bp, Homo sapiens; identical to SEQ ID NO: 6537

SEQ ID NO: 6575 - DNA, 201 bp, Homo sapiens; identical to SEQ ID NO: 6538

SEQ ID NO: 6576 - DNA, 201 bp, Homo sapiens; identical to SEQ ID NO: 6539

SEQ ID NO: 6577 - DNA, 201 bp, Homo sapiens; identical to SEQ ID NO: 6540

SEQ ID NO: 6578 - DNA, 201 bp, Homo sapiens
gcgccttcctgtgtcccttgatctgtcacaatggcggtgtgtgcgtgaagcctgaccgctgcctctgtcccccggacttcgctggcaagttctgccagttrcactcctcgggcgcccggcccccggccccggctataccaggcctcacccgctccgtgtacactatgccactggccaaccaccgcgacgacgagcacggcg

SEQ ID NO: 6579 - DNA, 201 bp, Homo sapiens; identical to SEQ ID NO: 6542

SEQ ID NO: 6580 - DNA, 201 bp, Homo sapiens; identical to SEQ ID NO: 6543

SEQ ID NO: 6581 - DNA, 201 bp, Homo sapiens; identical to SEQ ID NO: 6544

SEQ ID NO: 6582 - DNA, 201 bp, Homo sapiens; identical to SEQ ID NO: 6545

SEQ ID NO: 6583 - DNA, 201 bp, Homo sapiens; identical to SEQ ID NO: 6546

SEQ ID NO: 6584 - DNA, 201 bp, Homo sapiens; identical to SEQ ID NO: 6548

SEQ ID NO: 6585 - DNA, 201 bp, Homo sapiens; identical to SEQ ID NO: 6547
  misc_feature (1)...(201): n = A,T,C or G, or insertion/deletion polymorphism (see Tables 1-2)

SEQ ID NO: 6586 - DNA, 201 bp, Homo sapiens; identical to SEQ ID NO: 6549

SEQ ID NO: 6587 - DNA, 201 bp, Homo sapiens; identical to SEQ ID NO: 6532

SEQ ID NO: 6588 - DNA, 201 bp, Homo sapiens; identical to SEQ ID NO: 6533

SEQ ID NO: 6589 - DNA, 201 bp, Homo sapiens
accctggctatcagcccacgccagggggcggatgccaggatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgctggcacgttcccaggct

SEQ ID NO: 6590 - DNA, 201 bp, Homo sapiens; identical to SEQ ID NO: 6553

SEQ ID NO: 6591 - DNA, 201 bp, Homo sapiens; identical to SEQ ID NO: 6537

SEQ ID NO: 6592 - DNA, 201 bp, Homo sapiens; identical to SEQ ID NO: 6538

SEQ ID NO: 6593 - DNA, 201 bp, Homo sapiens; identical to SEQ ID NO: 6539

SEQ ID NO: 6594 - DNA, 201 bp, Homo sapiens; identical to SEQ ID NO: 6540

SEQ ID NO: 6595 - DNA, 201 bp, Homo sapiens; identical to SEQ ID NO: 6541

SEQ ID NO: 6596 - DNA, 201 bp, Homo sapiens; identical to SEQ ID NO: 6542

SEQ ID NO: 6597 - DNA, 201 bp, Homo sapiens; identical to SEQ ID NO: 6543

SEQ ID NO: 6598 - DNA, 201 bp, Homo sapiens; identical to SEQ ID NO: 6544

SEQ ID NO: 6599 - DNA, 201 bp, Homo sapiens; identical to SEQ ID NO: 6545

SEQ ID NO: 6600 - DNA, 201 bp, Homo sapiens; identical to SEQ ID NO: 6546

SEQ ID NO: 6601 - DNA, 201 bp, Homo sapiens; identical to SEQ ID NO: 6548

SEQ ID NO: 6602 - DNA, 201 bp, Homo sapiens; identical to SEQ ID NO: 6547
  misc_feature (1)...(201): n = A,T,C or G, or insertion/deletion polymorphism (see Tables 1-2)

SEQ ID NO: 6603 - DNA, 201 bp, Homo sapiens; identical to SEQ ID NO: 6549

SEQ ID NO: 6604 - DNA, 201 bp, Homo sapiens; identical to SEQ ID NO: 6532

SEQ ID NO: 6605 - DNA, 201 bp, Homo sapiens; identical to SEQ ID NO: 6533

SEQ ID NO: 6606 - DNA, 201 bp, Homo sapiens; identical to SEQ ID NO: 6534

SEQ ID NO: 6607 - DNA, 201 bp, Homo sapiens; identical to SEQ ID NO: 6535

SEQ ID NO: 6608 - DNA, 201 bp, Homo sapiens; identical to SEQ ID NO: 6536

SEQ ID NO: 6609 - DNA, 201 bp, Homo sapiens; identical to SEQ ID NO: 6537

SEQ ID NO: 6610 - DNA, 201 bp, Homo sapiens; identical to SEQ ID NO: 6555

SEQ ID NO: 6611 - DNA, 201 bp, Homo sapiens; identical to SEQ ID NO: 6538

SEQ ID NO: 6612 - DNA, 201 bp, Homo sapiens; identical to SEQ ID NO: 6539

SEQ ID NO: 6613 - DNA, 201 bp, Homo sapiens; identical to SEQ ID NO: 6540

SEQ ID NO: 6614 - DNA, 201 bp, Homo sapiens; identical to SEQ ID NO: 6541

SEQ ID NO: 6615 - DNA, 201 bp, Homo sapiens; identical to SEQ ID NO: 6542

SEQ ID NO: 6616 - DNA, 201 bp, Homo sapiens; identical to SEQ ID NO: 6543

SEQ ID NO: 6617 - DNA, 201 bp, Homo sapiens; identical to SEQ ID NO: 6562

SEQ ID NO: 6618 - DNA, 201 bp, Homo sapiens; identical to SEQ ID NO: 6544

SEQ ID NO: 6619 - DNA, 201 bp, Homo sapiens; identical to SEQ ID NO: 6545

SEQ ID NO: 6620 - DNA, 201 bp, Homo sapiens; identical to SEQ ID NO: 6546

SEQ ID NO: 6621 - DNA, 201 bp, Homo sapiens; identical to SEQ ID NO: 6548

SEQ ID NO: 6622 - DNA, 201 bp, Homo sapiens; identical to SEQ ID NO: 6547
  misc_feature (1)...(201): n = A,T,C or G, or insertion/deletion polymorphism (see Tables 1-2)

SEQ ID NO: 6623 - DNA, 201 bp, Homo sapiens; identical to SEQ ID NO: 6549

SEQ ID NO: 6624 - DNA, 201 bp, Homo sapiens; identical to SEQ ID NO: 6532

SEQ ID NO: 6625 - DNA, 201 bp, Homo sapiens; identical to SEQ ID NO: 6533

SEQ ID NO: 6626 - DNA, 201 bp, Homo sapiens; identical to SEQ ID NO: 6534

SEQ ID NO: 6627 - DNA, 201 bp, Homo sapiens; identical to SEQ ID NO: 6535

SEQ ID NO: 6628 - DNA, 201 bp, Homo sapiens; identical to SEQ ID NO: 6536

SEQ ID NO: 6629 - DNA, 201 bp, Homo sapiens; identical to SEQ ID NO: 6537

SEQ ID NO: 6630 - DNA, 201 bp, Homo sapiens; identical to SEQ ID NO: 6538

SEQ ID NO: 6631 - DNA, 201 bp, Homo sapiens; identical to SEQ ID NO: 6539

SEQ ID NO: 6632 - DNA, 201 bp, Homo sapiens; identical to SEQ ID NO: 6540

SEQ ID NO: 6633 - DNA, 201 bp, Homo sapiens; identical to SEQ ID NO: 6578

SEQ ID NO: 6634 - DNA, 201 bp, Homo sapiens; identical to SEQ ID NO: 6542

SEQ ID NO: 6635 - DNA, 201 bp, Homo sapiens; identical to SEQ ID NO: 6543

SEQ ID NO: 6636 - DNA, 201 bp, Homo sapiens; identical to SEQ ID NO: 6544

SEQ ID NO: 6637 - DNA, 201 bp, Homo sapiens; identical to SEQ ID NO: 6545

SEQ ID NO: 6638 - DNA, 201 bp, Homo sapiens; identical to SEQ ID NO: 6546

SEQ ID NO: 6639 - DNA, 201 bp, Homo sapiens; identical to SEQ ID NO: 6548

SEQ ID NO: 6640 - DNA, 201 bp, Homo sapiens; identical to SEQ ID NO: 6547
  misc_feature (1)...(201): n = A,T,C or G, or insertion/deletion polymorphism (see Tables 1-2)

SEQ ID NO: 6641 - DNA, 201 bp, Homo sapiens; identical to SEQ ID NO: 6549

SEQ ID NO: 6642 - DNA, 201 bp, Homo sapiens; identical to SEQ ID NO: 6543

SEQ ID NO: 6643 - DNA, 201 bp, Homo sapiens
ctgtgcgtgtgccccgccgggtaccaggctgcaccgcacggagccagctgccaggatgtggatgaatgcacccagagcccaggcctgtgtggccgaggggsctgcaagaacctgcctggctctttccgctgtgtttgcccggctggcttccggggctcggcgtgtgaagaggatgtggatgagtgtgcccaggaaccgccg

SEQ ID NO: 6644 - DNA, 201 bp, Homo sapiens
gagggggctgcaagaacctgcctggctctttccgctgtgtttgcccggctggcttccggggctcggcgtgtgaagaggatgtggatgagtgtgcccaggarccgccgccctgtgggcccggccgctgtgacaacacggcaggctcctttcactgtgcctgccctgctggcttccgctcccgagggcccggggccccctgcc

SEQ ID NO: 6645 - DNA, 201 bp, Homo sapiens
ttcactgtgcctgccctgctggcttccgctcccgagggcccggggccccctgccaagatgtggatgagtgtgcccgaagccccccaccctgcacctacggscggtgtgagaacacagaaggcagcttccagtgtgtctgccccatgggcttccaacccaacactgctggctccgagtgcgaagatgtggatgaatgtgaaa

SEQ ID NO: 6646 - DNA, 201 bp, Homo sapiens
tccagtgtgtctgccccatgggcttccaacccaacactgctggctccgagtgcgaagatgtggatgaatgtgaaaaccacctcgcatgccctgggcaggartgtgtgaactcgcccggctccttccagtgcaggacctgtccttctggccaccacctgcaccgtggcagatgcactgatgtggacgaatgcagttcgggtg

SEQ ID NO: 6647 - DNA, 201 bp, Homo sapiens
cactgctggctccgagtgcgaagatgtggatgaatgtgaaaaccacctcgcatgccctgggcaggaatgtgtgaactcgcccggctccttccagtgcaggrcctgtccttctggccaccacctgcaccgtggcagatgcactgatgtggacgaatgcagttcgggtgcccctccctgtggtccccacggccactgcactaa

SEQ ID NO: 6648 - DNA, 201 bp, Homo sapiens
acgttgacgagtgcagcgaggaggacctttgccagagcggcatctgtaccaacaccgacggctccttcgagtgcatctgtcctccgggacaccgcgctggyccggacctcgcctcctgtctcgacgtggacgaatgtcgcgagcgaggtccagccctgtgcgggtcgcagcgttgtgagaactctcccggctcctaccgct

SEQ ID NO: 6649 - DNA, 201 bp, Homo sapiens
aggaggacctttgccagagcggcatctgtaccaacaccgacggctccttcgagtgcatctgtcctccgggacaccgcgctggtccggacctcgcctcctgyctcgacgtggacgaatgtcgcgagcgaggtccagccctgtgcgggtcgcagcgttgtgagaactctcccggctcctaccgctgtgtccgggactgcgatc

SEQ ID NO: 6650 - DNA, 201 bp, Homo sapiens; identical to SEQ ID NO: 6549

SEQ ID NO: 6651 - DNA, 201 bp, Homo sapiens
ccaacaccgacggctccttcgagtgcatctgtcctccgggacaccgcgctggtccggacctcgcctcctgtctcgacgtggacgaatgtcgcgagcgaggyccagccctgtgcgggtcgcagcgttgtgagaactctcccggctcctaccgctgtgtccgggactgcgatcctgggtaccacgcgggccccgagggcacct

SEQ ID NO: 6652 - DNA, 201 bp, Homo sapiens
gagaacacccctggctcctaccgctgtacaccagcctgtgaccctggctatcagcccacgccagggggcggatgccaggatgtggacgaatgccggaaccrgtccttctgcggtgcccacgccgtgtgccagaacctgcccggctccttccagtgcctctgtgaccagggttacgagggggcacgggatgggcgtcactgc

SEQ ID NO: 6653 - DNA, 201 bp, Homo sapiens
gccgccctgtgggcccggccgctgtgacaacacggcaggctcctttcactgtgcctgccctgctggcttccgctcccgagggcccggggccccctgccaaratgtggatgagtgtgcccgaagccccccaccctgcacctacgggcggtgtgagaacacagaaggcagcttccagtgtgtctgccccatgggcttccaacc

SEQ ID NO: 6654 - DNA, 201 bp, Homo sapiens
gcatctgtcctccgggacaccgcgctggtccggacctcgcctcctgtctcgacgtggacgaatgtcgcgagcgaggtccagccctgtgcgggtcgcagcgytgtgagaactctcccggctcctaccgctgtgtccgggactgcgatcctgggtaccacgcgggccccgagggcacctgtgacgatgtggatgagtgccaag

SEQ ID NO: 6655 - DNA, 201 bp, Homo sapiens
gccccgagggcacctgtgacgatgtggatgagtgccaagaatatggtcccgagatttgtggagcccagcgttgtgagaacacccctggctcctaccgctgyacaccagcctgtgaccctggctatcagcccacgccagggggcggatgccaggatgtggacgaatgccggaaccggtccttctgcggtgcccacgccgtgt

SEQ ID NO: 6656 - DNA, 201 bp, Homo sapiens; identical to SEQ ID NO: 6540

SEQ ID NO: 6657 - DNA, 201 bp, Homo sapiens
gaggagcctcctgaaggtggaagctatgctggttccctggctgagccctacgaggagctggaggcggaggagtgcgggatcctggacggctgcaccaacgrccgctgcgtgcgcgtccccgaaggcttcacctgccgttgcttcgacggctaccgcctggacatgacccgcatggcctgcgttgacatcaacgagtgtgat

SEQ ID NO: 6658 - DNA, 201 bp, Homo sapiens; identical to SEQ ID NO: 6536

SEQ ID NO: 6659 - DNA, 201 bp, Homo sapiens
ccccggtcctgtgtcccttgatctgtcacaatggcggtgtgtgcgtgaagcctgaccgctgcttctgtcccccggacttcgctggcaagttctgccagttrcactcctcgggcgcccggcccccggccccggctgtaccaggcctcacccgctccgtgtacactatgccactggccaaccaccgcgacgacgagcacggcg

SEQ ID NO: 6660 - DNA, 201 bp, Homo sapiens
agggttacgagggggcacgggatgggcgtcactgcgtggatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgttggcatgtccccaggct

SEQ ID NO: 6661 - DNA, 201 bp, Homo sapiens; identical to SEQ ID NO: 6548

SEQ ID NO: 6662 - DNA, 201 bp, Homo sapiens
  misc_feature (1)...(201): n = A,T,C or G, or insertion/deletion polymorphism (see Tables 1-2)
cggtgtgtgcgtgaagcctgaccgctgcttctgtcccccggacttcgctggcaagttctgccagttgcactcctcgggcgcccggcccccggccccggctntaccaggcctcacccgctccgtgtacactatgccactggccaaccaccgcgacgacgagcacggcgtggcatctatggtgagcgtccacgtggagcaccc

SEQ ID NO: 6663 - DNA, 201 bp, Homo sapiens; identical to SEQ ID NO: 6544

SEQ ID NO: 6664 - DNA, 201 bp, Homo sapiens
ctccgggacaccgcgctggtccggacctcgcctcctgtctcgacgtggacgaatgtcgcgagcgaggtccagccctgtgcgggtcgcagcgttgtgagaaytctcccggctcctaccgctgtgtccgggactgcgatcctgggtaccacgcgggccccgagggcacctgtgacgatgtggatgagtgccaagaatatggtc

SEQ ID NO: 6665 - DNA, 201 bp, Homo sapiens
cggtgtgtgcgtgaagcctgaccgctgcttctgtcccccggacttcgctggcaagttctgccagttgcactcctcgggcgcccggcccccggccccggctrtaccaggcctcacccgctccgtgtacactatgccactggccaaccaccgcgacgacgagcacggcgtggcatctatggtgagcgtccacgtggagcaccc

SEQ ID NO: 6666 - DNA, 201 bp, Homo sapiens
cgagaacacgccaggcagcttcctgtgcgtgtgccccgccgggtaccaggctgcaccgcacggagccagctgccaggatgtggatgaatgcacccagagcscaggcctgtgtggccgagggggctgcaagaacctgcctggctctttccgctgtgtttgcccggctggcttccggggctcggcgtgtgaagaggatgtgga

SEQ ID NO: 6667 - DNA, 201 bp, Homo sapiens; identical to SEQ ID NO: 6532

SEQ ID NO: 6668 - DNA, 201 bp, Homo sapiens
tccctcacggcgagtgcctcaacactgacggctcctttgcctgtacttgtgcccctggctaccgacccggaccccgcggagcctcttgcctcgacgttgaygagtgcagcgaggaggacctttgccagagcggcatctgtaccaacaccgacggctccttcgagtgcatctgtcctccgggacaccgcgctggtccggacc

SEQ ID NO: 6669 - DNA, 201 bp, Homo sapiens
ctcgcactgcttctgatataaacagaagagcaagtccaagctgatttgcaggctctccacgacgggtgcagtagacatgaccagtttatcggcagtcaacracttttattcccacatcgtactcgcagctggccggaacaggaccgtggaagtgtttgacctcaacgccggctgcagtgcagcggtgatagcggaagccca

SEQ ID NO: 6670 - DNA, 201 bp, Homo sapiens
gcagtcaacgacttttattcccacatcgtactcgcagctggccggaacaggaccgtggaagtgtttgacctcaacgccggctgcagtgcagcggtgatagyggaagcccactcacggcctgtccatcaaatctgccaaaataaatatttcagcagggccatcgtggacccagaagaactccatgacctgctgctggcgcgg

SEQ ID NO: 6671 - DNA, 201 bp, Homo sapiens
tggtgacataagagaagcagctacgtgtgtgtttattccagatgccaagtgaagcctagaacaggagttgcatcttgcaggtcccctcagtggatgggccrggccccgagggtgagggctgccacagttgactgcccagccaggctgtgggacggctgctcttgtactctccatgctctgactcaagggaacctgtgttcc

SEQ ID NO: 6672 - DNA, 201 bp, Homo sapiens
ttgccgtgttggagatcaacccggccgcgctagtcagggctcagcagtgccccagcatggggcagagcctctcggtgccagccagctcctgtgtcctaccracctctccactgtatctgggaattgccaaggagaagagtaccaaggctgctagtgaacagcgacgtgctgcacggaacgtcatgaaggaccaacgcctgg

SEQ ID NO: 6673 - DNA, 201 bp, Homo sapiens
tgccctgaggaaccgcactgcggatcaaaaggtgctgtgcttgctggcctccctctttggcgggaagattgccgtgttggagatcaacccggccgcgctastcagggctcagcagtgccccagcatggggcagagcctctcggtgccagccagctcctgtgtcctaccgacctctccactgtatctgggaattgccaagga

SEQ ID NO: 6674 - DNA, 201 bp, Homo sapiens
gtggtgacataagagaagcagctacgtgtgtgtttattccagatgccaagtgaagcctagaacaggagttgcatcttgcaggtcccctcagtggatgggcygggccccgagggtgagggctgccacagttgactgcccagccaggctgtgggacggctgctcttgtactctccatgctctgactcaagggaacctgtgttc

SEQ ID NO: 6675 - DNA, 201 bp, Homo sapiens
ctgcacggaacgtcatgaaggaccaacgcctggttttccatagtaaagttaggtcatctggttatgcgtcagcaccacatgtaactatgttttcaccaaasaccaacatcaagagtgaggggaaaggatcttcaaggagcaggagcagctgcgcacgggaggcataccccgtggagtgcgctgtgcccaccaagcccggcc

SEQ ID NO: 6676 - DNA, 201 bp, Homo sapiens
cgtgctgcacggaacgtcatgaaggaccaacgcctggttttccatagtaaagttaggtcatctggttatgcgtcagcaccacatgtaactatgttttcacyaaagaccaacatcaagagtgaggggaaaggatcttcaaggagcaggagcagctgcgcacgggaggcataccccgtggagtgcgctgtgcccaccaagccc

SEQ ID NO: 6677 - DNA, 201 bp, Homo sapiens
  misc_feature (1)...(201): n = A,T,C or G, or insertion/deletion polymorphism (see Tables 1-2)
agcaccacatgtaactatgttttcaccaaagaccaacatcaagagtgaggggaaaggatcttcaaggagcaggagcagctgcgcacgggaggcataccccntggagtgcgctgtgcccaccaagcccggcccccaggtcgctgccgcccccacctgcacacgtgtatgctgcatccagtactcaggagatgggcagtggct

SEQ ID NO: 6678 - DNA, 201 bp, Homo sapiens
tggaagtgtttgacctcaacgccggctgcagtgcagcggtgatagcggaagcccactcacggcctgtccatcaaatctgccaaaataaatatttcagcagrgccatcgtggacccagaagaactccatgacctgctgctggcgcggacactccaggactcagcctttggctttccatagtggtgacataagagaagcagct

SEQ ID NO: 6679 - DNA, 201 bp, Homo sapiens
  misc_feature (1)...(201): n = A,T,C or G, or insertion/deletion polymorphism (see Tables 1-2)
agcctctcggtgccagccagctcctgtgtcctaccgacctctccactgtatctgggaattgccaaggagaagagtaccaaggctgctagtgaacagcgacntgctgcacggaacgtcatgaaggaccaacgcctggttttccatagtaaagttaggtcatctggttatgcgtcagcaccacatgtaactatgttttcacca

SEQ ID NO: 6680 - DNA, 118 bp, Homo sapiens
ctcacctggtctcctgcrcatcacagatgccacctgcacccgcccagcaccctcgtactcacctggtctcctgcgcattgcagatgccacatgcacccacccagcaaccttgtcctca

SEQ ID NO: 6681 - DNA, 201 bp, Homo sapiens
tgctggccggatcgtgtgccctgaggaaccgcactgcggatcaaaaggtgctgtgcttgctggcctccctctttggcgggaagattgccgtgttggagatsaacccggccgcgctagtcagggctcagcagtgccccagcatggggcagagcctctcggtgccagccagctcctgtgtcctaccgacctctccactgtatc

SEQ ID NO: 6682 - DNA, 201 bp, Homo sapiens
ttgccaaggagaagagtaccaaggctgctagtgaacagcgacgtgctgcacggaacgtcatgaaggaccaacgcctggttttccatagtaaagttaggtcrtctggttatgcgtcagcaccacatgtaactatgttttcaccaaagaccaacatcaagagtgaggggaaaggatcttcaaggagcaggagcagctgcgcac

SEQ ID NO: 6683 - DNA, 171 bp, Homo sapiens
ctcacctggtctcctgcgcatcacagatgccacctgcacccgcccagcaccctcgtactcacctggtctcytgcgcattgcagatgccacatgcacccacccagcaaccttgtcctcacctggtctctggctgtccagagttgcttcctgttgacgacagctctcctcaga

SEQ ID NO: 6684 - DNA, 201 bp, Homo sapiens
gaaaggatcttcaaggagcaggagcagctgcgcacgggaggcataccccgtggagtgcgctgtgcccaccaagcccggcccccaggtcgctgccgcccccwcctgcacacgtgtatgctgcatccagtactcaggagatgggcagtggctggcctgtgggttggccaaccatctgttactcgtttttgatgccagcctgac

SEQ ID NO: 6685 - DNA, 201 bp, Homo sapiens
cacccagcaaccttgtcctcacctggtctctggctgtccagagttgcttcctgttgacgacagctctcctcagaagaaagccagcttccctctacaagtgmtctgggaaaaggagagcaggttgaagtaacatttcctgtactgagacttgcaccctgtgatctctcactcatcccaaattctgcatgtggatgtctttct

SEQ ID NO: 6686 - DNA, 123 bp, Homo sapiens
  misc_feature (1)...(123): n = A,T,C or G, or insertion/deletion polymorphism (see Tables 1-2)
ctcacctggtctcctgcgcatcncagatgccacctgcacccgcccagcaccctcgtactcacctggtctcctgcgcattgcagatgccacatgcacccacccagcaaccttgtcctcacctgg

SEQ ID NO: 6687 - DNA, 201 bp, Homo sapiens; identical to SEQ ID NO: 6681

SEQ ID NO: 6688 - DNA, 118 bp, Homo sapiens; identical to SEQ ID NO: 6680

SEQ ID NO: 6689 - DNA, 201 bp, Homo sapiens; identical to SEQ ID NO: 6672

SEQ ID NO: 6690 - DNA, 201 bp, Homo sapiens; identical to SEQ ID NO: 6673

SEQ ID NO: 6691 - DNA, 201 bp, Homo sapiens; identical to SEQ ID NO: 6682

SEQ ID NO: 6692 - DNA, 201 bp, Homo sapiens; identical to SEQ ID NO: 6675

SEQ ID NO: 6693 - DNA, 201 bp, Homo sapiens; identical to SEQ ID NO: 6676

SEQ ID NO: 6694 - DNA, 201 bp, Homo sapiens
  misc_feature (1)...(201): n = A,T,C or G, or insertion/deletion polymorphism (see Tables 1-2)
agcaccacatgtaactatgttttcaccaaagaccaacatcaagagtgaggggaaaggatcttcaaggagcaggagcagctgcgcacgggaggcataccccntggagtgcgctgtgcccaccaagcccggcccccaggtcgctgccgcccccacctgcacacgtgtatgctgcatccagtactcaggtgcgccacgtcctgc

SEQ ID NO: 6695 - DNA, 171 bp, Homo sapiens; identical to SEQ ID NO: 6683

SEQ ID NO: 6696 - DNA, 201 bp, Homo sapiens
gaaaggatcttcaaggagcaggagcagctgcgcacgggaggcataccccgtggagtgcgctgtgcccaccaagcccggcccccaggtcgctgccgcccccwcctgcacacgtgtatgctgcatccagtactcaggtgcgccacgtcctgcgggagctgggtagcatttcattgtaagagtctttgattctgcccactgtaa

SEQ ID NO: 6697 - DNA, 201 bp, Homo sapiens; identical to SEQ ID NO: 6685

SEQ ID NO: 6698 - DNA, 201 bp, Homo sapiens; identical to SEQ ID NO: 6679
  misc_feature (1)...(201): n = A,T,C or G, or insertion/deletion polymorphism (see Tables 1-2)

SEQ ID NO: 6699 - DNA, 123 bp, Homo sapiens; identical to SEQ ID NO: 6686
  misc_feature (1)...(123): n = A,T,C or G, or insertion/deletion polymorphism (see Tables 1-2)

SEQ ID NO: 6700 - DNA, 201 bp, Homo sapiens; identical to SEQ ID NO: 6669

SEQ ID NO: 6701 - DNA, 201 bp, Homo sapiens
gcagtcaacgacttttattcccacatcgtactcgcagctggccggaacaggaccgtggaagtgtttgacctcaacgccggctgcagtgcagcggtgatagyggaagcccactcacggcctgtccatcaaatctgccaaaataaaggttcatcatttacaacccaacagcctcaggcttataaccttttcctgaccacggcc

SEQ ID NO: 6702 - DNA, 118 bp, Homo sapiens; identical to SEQ ID NO: 6680

SEQ ID NO: 6703 - DNA, 201 bp, Homo sapiens; identical to SEQ ID NO: 6681

SEQ ID NO: 6704 - DNA, 201 bp, Homo sapiens; identical to SEQ ID NO: 6672

SEQ ID NO: 6705 - DNA, 201 bp, Homo sapiens; identical to SEQ ID NO: 6673

SEQ ID NO: 6706 - DNA, 201 bp, Homo sapiens; identical to SEQ ID NO: 6682

SEQ ID NO: 6707 - DNA, 201 bp, Homo sapiens; identical to SEQ ID NO: 6675

SEQ ID NO: 6708 - DNA, 201 bp, Homo sapiens; identical to SEQ ID NO: 6676

SEQ ID NO: 6709 - DNA, 201 bp, Homo sapiens; identical to SEQ ID NO: 6677
  misc_feature (1)...(201): n = A,T,C or G, or insertion/deletion polymorphism (see Tables 1-2)

SEQ ID NO: 6710 - DNA, 171 bp, Homo sapiens; identical to SEQ ID NO: 6683

SEQ ID NO: 6711 - DNA, 201 bp, Homo sapiens; identical to SEQ ID NO: 6684

SEQ ID NO: 6712 - DNA, 123 bp, Homo sapiens; identical to SEQ ID NO: 6686
  misc_feature (1)...(123): n = A,T,C or G, or insertion/deletion polymorphism (see Tables 1-2)

SEQ ID NO: 6713 - DNA, 201 bp, Homo sapiens; identical to SEQ ID NO: 6679
  misc_feature (1)...(201): n = A,T,C or G, or insertion/deletion polymorphism (see Tables 1-2)

SEQ ID NO: 6714 - DNA, 201 bp, Homo sapiens; identical to SEQ ID NO: 6685

SEQ ID NO: 6715 - DNA, 201 bp, Homo sapiens
catcagcgccccagcaagtaagaacgggattttgaaaattcttatggaaaaaagtctgcagcatttccagaaactttcttaattagaagaaaacatgaaartaaccgttgcaaatcaattgtatataaaaatgaatggtcttctattaaaatgtagagggagattttttgcaaaggtgttgggattacaggcgtgagccac

SEQ ID NO: 6716 - DNA, 201 bp, Homo sapiens
cctgaggtgtgagcgccactttgaagggcatccaacccgcggctatccatgtggaatcgctttcagtccttgtggacgattcgcggcttgtggggccgagracagacacgcttacgtgtatgaaatgggctcaagcacgttttctcaccggctggctgggcacacagacactgtcactggagtggccttcaacccatcagc

SEQ ID NO: 6717 - DNA, 201 bp, Homo sapiens; identical to SEQ ID NO: 6669

SEQ ID NO: 6718 - DNA, 201 bp, Homo sapiens; identical to SEQ ID NO: 6701

SEQ ID NO: 6719 - DNA, 201 bp, Homo sapiens; identical to SEQ ID NO: 6672

SEQ ID NO: 6720 - DNA, 201 bp, Homo sapiens; identical to SEQ ID NO: 6673

SEQ ID NO: 6721 - DNA, 201 bp, Homo sapiens
atgtggaatcgctttcagtccttgtggacgattcgcggcttgtggggccgaggacagacacgcttacgtgtatgaaatgggctcaagcacgttttctcacyggctggctgggcacacagacactgtcactggagtggccttcaacccatcagcgccccagcaagtaagaacgggattttgaaaattcttatggaaaaaagt

SEQ ID NO: 6722 - DNA, 201 bp, Homo sapiens; identical to SEQ ID NO: 6675

SEQ ID NO: 6723 - DNA, 201 bp, Homo sapiens; identical to SEQ ID NO: 6676

SEQ ID NO: 6724 - DNA, 201 bp, Homo sapiens; identical to SEQ ID NO: 6677
  misc_feature (1)...(201): n = A,T,C or G, or insertion/deletion polymorphism (see Tables 1-2)

SEQ ID NO: 6725 - DNA, 201 bp, Homo sapiens
tatccatgtggaatcgctttcagtccttgtggacgattcgcggcttgtggggccgaggacagacacgcttacgtgtatgaaatgggctcaagcacgttttmtcaccggctggctgggcacacagacactgtcactggagtggccttcaacccatcagcgccccagcaagtaagaacgggattttgaaaattcttatggaaa

SEQ ID NO: 6726 - DNA, 201 bp, Homo sapiens; identical to SEQ ID NO: 6679
  misc_feature (1)...(201): n = A,T,C or G, or insertion/deletion polymorphism (see Tables 1-2)

SEQ ID NO: 6727 - DNA, 118 bp, Homo sapiens; identical to SEQ ID NO: 6680

SEQ ID NO: 6728 - DNA, 201 bp, Homo sapiens; identical to SEQ ID NO: 6681

SEQ ID NO: 6729 - DNA, 201 bp, Homo sapiens; identical to SEQ ID NO: 6682

SEQ ID NO: 6730 - DNA, 171 bp, Homo sapiens; identical to SEQ ID NO: 6683

SEQ ID NO: 6731 - DNA, 201 bp, Homo sapiens; identical to SEQ ID NO: 6684

SEQ ID NO: 6732 - DNA, 201 bp, Homo sapiens; identical to SEQ ID NO: 6685

SEQ ID NO: 6733 - DNA, 123 bp, Homo sapiens; identical to SEQ ID NO: 6686
  misc_feature (1)...(123): n = A,T,C or G, or insertion/deletion polymorphism (see Tables 1-2)

SEQ ID NO: 6734 - DNA, 201 bp, Homo sapiens; identical to SEQ ID NO: 6681

SEQ ID NO: 6735 - DNA, 118 bp, Homo sapiens; identical to SEQ ID NO: 6680

SEQ ID NO: 6736 - DNA, 201 bp, Homo sapiens
ttgccgtgttggagatcaacccggccgcgctagtcagggctcagcagtgccccagcatggggcagagcctctcggtgccagccagctcctgtgtcctaccracctctccactgtatctgggaattgccaaggagaagagtaccaaggctgctagtgaacagcgacgtggtcatgtaactatgttttcaccaaagaccaaca

SEQ ID NO: 6737 - DNA, 201 bp, Homo sapiens; identical to SEQ ID NO: 6673

SEQ ID NO: 6738 - DNA, 201 bp, Homo sapiens
tcctaccgacctctccactgtatctgggaattgccaaggagaagagtaccaaggctgctagtgaacagcgacgtggtcatgtaactatgttttcaccaaasaccaacatcaagagtgaggggaaaggatcttcaaggagcaggagcagctgcgcacgggaggcataccccgtggagtgcgctgtgcccaccaagcccggcc

SEQ ID NO: 6739 - DNA, 201 bp, Homo sapiens
tgtgtcctaccgacctctccactgtatctgggaattgccaaggagaagagtaccaaggctgctagtgaacagcgacgtggtcatgtaactatgttttcacyaaagaccaacatcaagagtgaggggaaaggatcttcaaggagcaggagcagctgcgcacgggaggcataccccgtggagtgcgctgtgcccaccaagccc

SEQ ID NO: 6740 - DNA, 201 bp, Homo sapiens
  misc_feature (1)...(201): n = A,T,C or G, or insertion/deletion polymorphism (see Tables 1-2)
acgtggtcatgtaactatgttttcaccaaagaccaacatcaagagtgaggggaaaggatcttcaaggagcaggagcagctgcgcacgggaggcataccccntggagtgcgctgtgcccaccaagcccggcccccaggtcgctgccgcccccacctgcacacgtgtatgctgcatccagtactcaggtgcgccacgtcctgc

SEQ ID NO: 6741 - DNA, 171 bp, Homo sapiens; identical to SEQ ID NO: 6683

SEQ ID NO: 6742 - DNA, 160 bp, Homo sapiens
gaaaggatcttcaaggagcaggagcagctgcgcacgggaggcataccccgtggagtgcgctgtgcccaccaagcccggcccccaggtcgctgccgcccccwcctgcacacgtgtatgctgcatccagtactcaggtgcgccacgtcctgcgggagctggg

SEQ ID NO: 6743 - DNA, 201 bp, Homo sapiens; identical to SEQ ID NO: 6685

SEQ ID NO: 6744 - DNA, 201 bp, Homo sapiens
  misc_feature (1)...(201): n = A,T,C or G, or insertion/deletion polymorphism (see Tables 1-2)
agcctctcggtgccagccagctcctgtgtcctaccgacctctccactgtatctgggaattgccaaggagaagagtaccaaggctgctagtgaacagcgacntggtcatgtaactatgttttcaccaaagaccaacatcaagagtgaggggaaaggatcttcaaggagcaggagcagctgcgcacgggaggcataccccgtg

SEQ ID NO: 6745 - DNA, 123 bp, Homo sapiens; identical to SEQ ID NO: 6686
  misc_feature (1)...(123): n = A,T,C or G, or insertion/deletion polymorphism (see Tables 1-2)

SEQ ID NO: 6746 - DNA, 201 bp, Homo sapiens; identical to SEQ ID NO: 6716

SEQ ID NO: 6747 - DNA, 201 bp, Homo sapiens; identical to SEQ ID NO: 6669

SEQ ID NO: 6748 - DNA, 201 bp, Homo sapiens; identical to SEQ ID NO: 6701

SEQ ID NO: 6749 - DNA, 201 bp, Homo sapiens; identical to SEQ ID NO: 6681

SEQ ID NO: 6750 - DNA, 118 bp, Homo sapiens; identical to SEQ ID NO: 6680

SEQ ID NO: 6751 - DNA, 201 bp, Homo sapiens; identical to SEQ ID NO: 6673

SEQ ID NO: 6752 - DNA, 201 bp, Homo sapiens; identical to SEQ ID NO: 6672

SEQ ID NO: 6753 - DNA, 201 bp, Homo sapiens; identical to SEQ ID NO: 6682

SEQ ID NO: 6754 - DNA, 201 bp, Homo sapiens
atgtggaatcgctttcagtccttgtggacgattcgcggcttgtggggccgaggacagacacgcttacgtgtatgaaatgggctcaagcacgttttctcacyggctggctgggcacacagacactgtcactggagtggccttcaacccatcagcgccccagggtgctggtgagagaccttacataaggaacctggagtgtga

SEQ ID NO: 6755 - DNA, 201 bp, Homo sapiens; identical to SEQ ID NO: 6675

SEQ ID NO: 6756 - DNA, 201 bp, Homo sapiens; identical to SEQ ID NO: 6676

SEQ ID NO: 6757 - DNA, 201 bp, Homo sapiens; identical to SEQ ID NO: 6677
  misc_feature (1)...(201): n = A,T,C or G, or insertion/deletion polymorphism (see Tables 1-2)

SEQ ID NO: 6758 - DNA, 171 bp, Homo sapiens; identical to SEQ ID NO: 6683

SEQ ID NO: 6759 - DNA, 201 bp, Homo sapiens; identical to SEQ ID NO: 6684

SEQ ID NO: 6760 - DNA, 201 bp, Homo sapiens
tatccatgtggaatcgctttcagtccttgtggacgattcgcggcttgtggggccgaggacagacacgcttacgtgtatgaaatgggctcaagcacgttttmtcaccggctggctgggcacacagacactgtcactggagtggccttcaacccatcagcgccccagggtgctggtgagagaccttacataaggaacctggag

SEQ ID NO: 6761 - DNA, 201 bp, Homo sapiens; identical to SEQ ID NO: 6685

SEQ ID NO: 6762 - DNA, 123 bp, Homo sapiens; identical to SEQ ID NO: 6686
  misc_feature (1)...(123): n = A,T,C or G, or insertion/deletion polymorphism (see Tables 1-2)

SEQ ID NO: 6763 - DNA, 201 bp, Homo sapiens; identical to SEQ ID NO: 6679
  misc_feature (1)...(201): n = A,T,C or G, or insertion/deletion polymorphism (see Tables 1-2)

SEQ ID NO: 6764 - DNA, 201 bp, Homo sapiens
tggcctgcgttgtttgtaggcaaatgatggtggcatctggcaatcaattagtagaatgtcaggagtgccataatctctaccaccgagattgtcataaaccscaggtgacagacaaggaagcgaatgaccctcgcctggtgtggtattgtgcccgatgtaccagacaaatgaaaagaatggctcaaaaaactcagaaaccac

SEQ ID NO: 6765 - DNA, 201 bp, Homo sapiens
ctcccattactgtccaaagtagcaaggatttacctatggctgacctttccagttttgaggagaccagtgctgatgattttgccatggagatgggattggcytgcgttgtttgtaggcaaatgatggtggcatctggcaatcaattagtagaatgtcaggagtgccataatctctaccaccgagattgtcataaaccccagg

SEQ ID NO: 6766 - DNA, 201 bp, Homo sapiens
agatgaaaggcttattattatgatataatctgtaatacactgtaatttaataaaagtcttcataatcaaatttctattgtttcttaccttaaaatgctaartattatataacaaaacttggaaactttcattttaaatcaatcttcaacatttttattctaatgatttccatagtgtgtgaaaacaatgattagaatgact

SEQ ID NO: 6767 - DNA, 201 bp, Homo sapiens
cttaactggatgggcagcttttgcagccaaaacttcctctgctggtccttcaacagcaaaattgagttcaacaacacaaaacaatactgggaaacctgctrcttcgtcagctaaccagaaacctgtgggtttgactggtctggcaacatcatccaaaggtggaataggttccaaaataggttccaataacagcactacgcc

SEQ ID NO: 6768 - DNA, 201 bp, Homo sapiens
ttatttcaggaaattcttctagtgccagcgtttcctcgtcagtaactagtggcttaactggatgggcagcttttgcagccaaaacttcctctgctggtccytcaacagcaaaattgagttcaacaacacaaaacaatactgggaaacctgctacttcgtcagctaaccagaaacctgtgggtttgactggtctggcaacat

SEQ ID NO: 6769 - DNA, 201 bp, Homo sapiens
gtactaccagcaaaactacttcagaatccagcagctctccctcagcatcccttaaaggcccaacttcacaagaatcacagctcaatgctatgaagcgattrcagatggtcaagaagaaagctgcccaaaagaaactcaagaagtaatgtggccaagtaggtttttgtatcatattagcctaaagatgaaaggcttattatt

SEQ ID NO: 6770 - DNA, 201 bp, Homo sapiens
ctgtgggtttgactggtctggcaacatcatccaaaggtggaataggttccaaaataggttccaataacagcactacgcccactgtacctttaaaaccaccyccacctctaaccttgggtaaaactggccttagtcgctcagttagttgtgacaatgtcagcaaagtaggtcttcctagtccaagtagtttagttccaggaa

SEQ ID NO: 6771 - DNA, 201 bp, Homo sapiens; identical to SEQ ID NO: 6764

SEQ ID NO: 6772 - DNA, 201 bp, Homo sapiens; identical to SEQ ID NO: 6765

SEQ ID NO: 6773 - DNA, 201 bp, Homo sapiens; identical to SEQ ID NO: 6766

SEQ ID NO: 6774 - DNA, 201 bp, Homo sapiens; identical to SEQ ID NO: 6767

SEQ ID NO: 6775 - DNA, 201 bp, Homo sapiens; identical to SEQ ID NO: 6768

SEQ ID NO: 6776 - DNA, 201 bp, Homo sapiens; identical to SEQ ID NO: 6769

SEQ ID NO: 6777 - DNA, 201 bp, Homo sapiens; identical to SEQ ID NO: 6770

SEQ ID NO: 6778 - DNA, 201 bp, Homo sapiens
cacctggaggtggaccctgaaattcagaggatcaagacccaggagcgggagcagattatggttctcaacaacaagtttgcctccttcattgacaaggtgcrattcctggagcagcagaaccaggtgctacaaacaaaatgggagttgctgcagcaggtgaacacctcaactggaaccaacaacctggagcccctcttggag

SEQ ID NO: 6779 - DNA, 201 bp, Homo sapiens
atcatcgatgcagtgcggacccagtatgaactgattgcacagaggagcaaggacgaggccgaagccctgtaccagaccaagtaccaggagctccagatcayggcagggagacatggagacgacctgaagaacagcaagatggagattgcagagctcaaccgcaccgtccagaggctgcaggcagagatcagcaacgtgaag

SEQ ID NO: 6780 - DNA, 201 bp, Homo sapiens
tcgtcctgaagaaggatgtggatgctgcttatgtgagcaaagtggacctggagtccagggtggacactctgactggggaggtcaatttcttgaaatatttrtttttgacggagctgtctcaggtgcagactcacatcagcgacaccaacgtcatcctgtccatggacaataaccgttccctggacctggacagcatcatcg

SEQ ID NO: 6781 - DNA, 201 bp, Homo sapiens
cccagtatgaactgattgcacagaggagcaaggacgaggccgaagccctgtaccagaccaagtaccaggagctccagatcatggcagggagacatggagaygacctgaagaacagcaagatggagattgcagagctcaaccgcaccgtccagaggctgcaggcagagatcagcaacgtgaagaagcagattgaacagatgc

SEQ ID NO: 6782 - DNA, 201 bp, Homo sapiens
cgcgggaggcggcggcagctacggctcaggaggctacggcggcggcagcggtgggggctatggcggcggaagaagctaccgcggaggcggggcacgaggcrggagtggaggcggttatggcagcggctgcggcggcggtggcgggagctacggagggagcggcagaagcggccgcggatcctcgcgcgtgcagatcatcca

SEQ ID NO: 6783 - DNA, 201 bp, Homo sapiens
atttttgacggagctgtctcaggtgcagactcacatcagcgacaccaacgtcatcctgtccatggacaataaccgttccctggacctggacagcatcatcratgcagtgcggacccagtatgaactgattgcacagaggagcaaggacgaggccgaagccctgtaccagaccaagtaccaggagctccagatcatggcagg

SEQ ID NO: 6784 - DNA, 126 bp, Homo sapiens
tatggcagcggctgcggcggcggtggcgggagctacggagggagcggcagaagcggccgcggatcctcgcgcgtgcagatcatccagacctccaccaacamctcccacaggcggatcttggagtag

SEQ ID NO: 6785 - DNA, 201 bp, Homo sapiens
cgggaggcggcggcagctacggctcaggaggctacggcggcggcagcggtgggggctatggcggcggaagaagctaccgcggaggcggggcacgaggcggragtggaggcggttatggcagcggctgcggcggcggtggcgggagctacggagggagcggcagaagcggccgcggatcctcgcgcgtgcagatcatccaga

SEQ ID NO: 6786 - DNA, 171 bp, Homo sapiens
agaagctaccgcggaggcggggcacgaggcgggagtggaggcggttatggcagcggctgcggcggcggtggcgggagctacggagggagcggcagaagcgkccgcggatcctcgcgcgtgcagatcatccagacctccaccaacacctcccacaggcggatcttggagtag

SEQ ID NO: 6787 - DNA, 201 bp, Homo sapiens
ggcgcgggaggcggcggcagctacggctcaggaggctacggcggcggcagcggtgggggctatggcggcggaagaagctaccgcggaggcggggcacgagkcgggagtggaggcggttatggcagcggctgcggcggcggtggcgggagctacggagggagcggcagaagcggccgcggatcctcgcgcgtgcagatcatc

SEQ ID NO: 6788 - DNA, 201 bp, Homo sapiens
tgctcagtgcggagcagatgcgccagaacgcggaggtcaggagcatgcaggatgtcgtggaggactacaagagcaagtatgaggatgaaatcaacaagagractggcagcgagaatgactttgtcgtcctgaagaaggatgtggatgctgcttatgtgagcaaagtggacctggagtccagggtggacactctgactgggg

SEQ ID NO: 6789 - DNA, 201 bp, Homo sapiens
gtggacactctgactggggaggtcaatttcttgaaatatttatttttgacggagctgtctcaggtgcagactcacatcagcgacaccaacgtcatcctgtycatggacaataaccgttccctggacctggacagcatcatcgatgcagtgcggacccagtatgaactgattgcacagaggagcaaggacgaggccgaagcc

SEQ ID NO: 6790 - DNA, 201 bp, Homo sapiens
tctcaggtgcagactcacatcagcgacaccaacgtcatcctgtccatggacaataaccgttccctggacctggacagcatcatcgatgcagtgcggacccrgtatgaactgattgcacagaggagcaaggacgaggccgaagccctgtaccagaccaagtaccaggagctccagatcatggcagggagacatggagacgac

SEQ ID NO: 6791 - DNA, 201 bp, Homo sapiens
cctaccgccagctgctggagggcgaggagagcaggatgtcaggagagctgcagagccatgtgagcatctccgtgcagaacagccaggtgagcgtcaacggyggcgcgggaggcggcggcagctacggctcaggaggctacggcggcggcagcggtgggggctatggcggcggaagaagctaccgcggaggcggggcacgag

SEQ ID NO: 6792 - DNA, 201 bp, Homo sapiens
gcagcagaaccaggtgctacaaacaaaatgggagttgctgcagcaggtgaacacctcaactggaaccaacaacctggagcccctcttggagaactacatckgtgacctgcggaggcaggtggatttgctcagtgcggagcagatgcgccagaacgcggaggtcaggagcatgcaggatgtcgtggaggactacaagagcaa

SEQ ID NO: 6793 - DNA, 201 bp, Homo sapiens
ttacttgaatctcattattttgacaataatttaattcttttattgttcaatctgttagtgagatgtgtcataggtattatgtcattagttcaaattcttgyggaaattatagctacattaaaagtgtaacatttttatttagttgtgtacttatttgttaataatacagacattgtatgttatcatactgcaatttacaat

SEQ ID NO: 6794 - DNA, 201 bp, Homo sapiens
acgcaagagagcattactttcccaaagagctacacggttcatactgaaggatgatatgagaaattttcactttttgtcaaaacttgtactctcagcgggcyctctaagaccaactccagcagtcaaacattcaaaaacgactcactttgagattgaaatatttgatgctcaaacaaggaaacagatatgtattctggataa

SEQ ID NO: 6795 - DNA, 201 bp, Homo sapiens
caattaaaatattttctgtagattatttgaaaatcattctgaatatatattttgaaatatatagattatatttgtatgtaaattatatttatacatcttctgaaatatatttcaaaatatgtgtgtacgtgtgtatatgtgtatatatatacacatatatatacacatacacaaatatatgcatatttcaaatggattgta

SEQ ID NO: 6796 - DNA, 201 bp, Homo sapiens
acaattaaaatattttctgtagattatttgaaaatcattctgaatatatattttgaaatatatagattatatttgtatgtaaattatatttatacatcttctgaaatatatttcaaaatatgtgtgtacgtgtgtatatgtgtatatatatacacatatatatacacatacacaaatatatgcatatttcaaatggattgt

SEQ ID NO: 6797 - DNA, 201 bp, Homo sapiens
tacaattaaaatattttctgtagattatttgaaaatcattctgaatatatattttgaaatatatagattatatttgtatgtaaattatatttatacatcttctgaaatatatttcaaaatatgtgtgtacgtgtgtatatgtgtatatatatacacatatatatacacatacacaaatatatgcatatttcaaatggattg

SEQ ID NO: 6798 - DNA, 201 bp, Homo sapiens
cttgggtttaccagggtctgtggatgaactgcgcaggtaacgcgttgggttctttccattgccgaccgcattttactatcttcaaagtagcaggttatatmcaggcatgtagaggacttatgatcgctgctgtcagcctgggcttctttggttccatatttgcgctctttggaatgaagtgtaccaaagtcggaggctccg

SEQ ID NO: 6799 - DNA, 201 bp, Homo sapiens
gtcatgtcttctcggacaaagtatcatggtggagaagattttaaaacaacaaacccttcaaaacagtttgataaaaatgcttatgtctaaaagagctcgckggcaagctgcctcttgagtttgttataaaagcgaactgttcacaaaatgatcccatcaaggccctcccataattaacactcaaaactatttttaaaatat

SEQ ID NO: 6800 - DNA, 201 bp, Homo sapiens
ttggtaaaccatacttgatcctaaattcctgtacttcctcaggccatccgagcatgaaacgctgtcacctacccacatccgctggctgtgacgcttgtcaragtgttctctatcggctgcatgcctagaccaccaaagcgttctgaccggacagtgtcactggagaaggcggcgcgacatgtccagggcgcagatctgggc

SEQ ID NO: 6801 - DNA, 201 bp, Homo sapiens
cttgatcctaaattcctgtacttcctcaggccatccgagcatgaaacgctgtcacctacccacatccgctggctgtgacgcttgtcaaagtgttctctatyggctgcatgcctagaccaccaaagcgttctgaccggacagtgtcactggagaaggcggcgcgacatgtccagggcgcagatctgggctctggtgtctggt

SEQ ID NO: 6802 - DNA, 201 bp, Homo sapiens
gccactcagtagattgttgaaaaagcaaagccacaccattctctttgatgtatgcagagagttacgtagcaggggatgttctctgatttattccactggcmccattagtgaatatttagttgttttcataaacgatgctgtgatgaagactcatgtacatatttagcaaattttggtttcttacatgtgcctgtcatgact

SEQ ID NO: 6803 - DNA, 201 bp, Homo sapiens
aatgatcccatcaaggccctcccataattaacactcaaaactatttttaaaatatgcatttgaagcatctgttgattgtatggatgtaagtgttcttacawagttagttatatactaatcattttctgttgtggctttctataaaaaataaacagtttatttacaggatttgtaaaatgttttctacatttatatagaaca

SEQ ID NO: 6804 - DNA, 201 bp, Homo sapiens; identical to SEQ ID NO: 6799

SEQ ID NO: 6805 - DNA, 201 bp, Homo sapiens; identical to SEQ ID NO: 6803

SEQ ID NO: 6806 - DNA, 201 bp, Homo sapiens; identical to SEQ ID NO: 6802

SEQ ID NO: 6807 - DNA, 134 bp, Homo sapiens
atgatcagatttgcaatgtgtagcatcattgacrttttactttcctttgaaaaaggaaacaatgcctgtttcccaagtccaaattataaccccttcacatggatgtttttcctggtttcatgtcctaactacac

SEQ ID NO: 6808 - DNA, 201 bp, Homo sapiens
aacaaacaaaaaactgtcatgaattttagtatcttattaatttctaattagattttaacttctaattttggtaagtagttcaaaataacaacaacaacaamaaaaaaaaaaacacctgaaactagtggaaaaaacttccacagctttataataccgtagcattctttacacaaaagtcaattcctaaaccctcaaatttca

SEQ ID NO: 6809 - DNA, 201 bp, Homo sapiens
tttaacttctaattttggtaagtagttcaaaataacaacaacaacaaaaaaaaaaaaaacacctgaaactagtggaaaaaacttccacagctttataataycgtagcattctttacacaaaagtcaattcctaaaccctcaaatttcagaacataaaaataaatttccatttacagatttcccccttccagttccaaaagt

SEQ ID NO: 6810 - DNA, 201 bp, Homo sapiens
ccactggaggagcaatgcccgctttctttttaaaattctcctgggaaaattactcctcagcctcctttataaatccttgaggaaatgtcaagttctttcargacaagaaaaactctcagctgggcacagtggctcacacctgtaatcccagcactttgggaagctgagactataatccctgctgggattacagatgtgagc

SEQ ID NO: 6811 - DNA, 201 bp, Homo sapiens
ggtgatgaaatcatctatacaacaaacccccatgacgtaagtttacctatgaaacaaactggcacatgtacccctgaacttaaaagttgttaaaaaaaaawtttttttaagagagatgaaagtgactcaagaagctgtgtcaccaaatctttgagagctatgtcaccaaatcaaaaaataacagaaaaccagacaagatca

SEQ ID NO: 6812 - DNA, 201 bp, Homo sapiens
ctctggaatctggccatcctgcgaacctgctacgtgtcagcagcctggaaaagcagaaagtcactcatcttttcctggacatggggaactgtcatctcccwgggccctaggacccctcacttctcagagatcaccatcatcccacttccctggagccacggctccagtatcaccttccaagtgactttcccaaggtttcat

SEQ ID NO: 6813 - DNA, 201 bp, Homo sapiens
ctgaagaaccaatccctgcgttttgtttatgtgactgacagcaacccacctgccaggctgagctggacctgggaaggccaagccctgaatctctcccagtygtcagaatcagccgtcctggagctgcccccagtggagtcttgtgatggaggggaatttgtctgccaagctcagcaccctttgggctcccagcatgtctcc

SEQ ID NO: 6814 - DNA, 201 bp, Homo sapiens
tgactttcccaaggtttcatgtgaccacagagatgaccatccaactcaatgtctcctcacctgtagccttggagaatgccacctccctgtcagtcctgaakaaccaatccctgcgttttgtttatgtgactgacagcaacccacctgccaggctgagctggacctgggaaggccaagccctgaatctctcccagtcgtcag

SEQ ID NO: 6815 - DNA, 201 bp, Homo sapiens
caccccatggccccaggaccacagcaccaacctcacctggcaggtgaagttccctggagctggtgtgactacagagagaaccatccagctcagtgtctccwactccagactccgtttccagatgcctcctcatccagttcctccacagtctgagcagccgtgtttcctctctggtgctggagaacaaggggaaaatgccac

SEQ ID NO: 6816 - DNA, 201 bp, Homo sapiens
gacatggggaactgtcatctccctgggccctaggacccctcacttctcagagatcaccatcatcccacttccctggagccacggctccagtatcaccttcsaagtgactttcccaaggtttcatgtgaccacagagatgaccatccaactcaatgtctcctcacctgtagccttggagaatgccacctccctgtcagtcct

SEQ ID NO: 6817 - DNA, 201 bp, Homo sapiens
gaaagtcactcatcttttcctggacatggggaactgtcatctccctgggccctaggacccctcacttctcagagatcaccatcatcccacttccctggagycacggctccagtatcaccttccaagtgactttcccaaggtttcatgtgaccacagagatgaccatccaactcaatgtctcctcacctgtagccttggaga

SEQ ID NO: 6818 - DNA, 201 bp, Homo sapiens; identical to SEQ ID NO: 2282

SEQ ID NO: 6819 - DNA, 201 bp, Homo sapiens; identical to SEQ ID NO: 2284

SEQ ID NO: 6820 - DNA, 201 bp, Homo sapiens; identical to SEQ ID NO: 2286

SEQ ID NO: 6821 - DNA, 201 bp, Homo sapiens; identical to SEQ ID NO: 2287

SEQ ID NO: 6822 - DNA, 201 bp, Homo sapiens; identical to SEQ ID NO: 2283

SEQ ID NO: 6823 - DNA, 201 bp, Homo sapiens; identical to SEQ ID NO: 2271

SEQ ID NO: 6824 - DNA, 201 bp, Homo sapiens
acttgtaccagttttacggtccctctggccagtacacccatgaatttgatggagatgaggagttctacgtggacctggagaggaaggagactgcctggcgktggcctgagttcagcaaatttggaggttttgacccgcagggtgcactgagaaacatggctgtggcaaaacacaacttgaacatcatgattaaacgctaca

SEQ ID NO: 6825 - DNA, 201 bp, Homo sapiens; identical to SEQ ID NO: 2272

SEQ ID NO: 6826 - DNA, 188 bp, Homo sapiens; identical to SEQ ID NO: 2274

SEQ ID NO: 6827 - DNA, 192 bp, Homo sapiens; identical to SEQ ID NO: 2273

SEQ ID NO: 6828 - DNA, 201 bp, Homo sapiens
ttgtaccagttttacggtccctctggccagtacacccatgaatttgatggagatgaggagttctacgtggacctggagaggaaggagactgcctggcggtkgcctgagttcagcaaatttggaggttttgacccgcagggtgcactgagaaacatggctgtggcaaaacacaacttgaacatcatgattaaacgctacaac

SEQ ID NO: 6829 - DNA, 201 bp, Homo sapiens; identical to SEQ ID NO: 2285

SEQ ID NO: 6830 - DNA, 201 bp, Homo sapiens; identical to SEQ ID NO: 2278

SEQ ID NO: 6831 - DNA, 201 bp, Homo sapiens; identical to SEQ ID NO: 2279

SEQ ID NO: 6832 - DNA, 201 bp, Homo sapiens; identical to SEQ ID NO: 2280

SEQ ID NO: 6833 - DNA, 201 bp, Homo sapiens
gaccgcctttggaggcagaagagcagttccacccaataactctaatgcagcggaagatgacctgcccacagtggagcttcagggcgtggtgccccggggcrtcaacctgcaagagtttcttaatgtcacgagcgttcacctgttcaaggagagatgggacactaacaaggtggaccaccacactgacaagtatgaaaacaa

SEQ ID NO: 6834 - DNA, 201 bp, Homo sapiens
aaagacttcaagctctccatcaccttccggaacaacagccacaaccgttacaccatcacagcttatctctcagccaacatcaccttctacaccggggtccygaaggcagaattcaagaaggagacgttcgacgtgacgctggagcccttgtccttcaagaaagaggcggtgctgatccaagccggcgagtacatgggtcag

SEQ ID NO: 6835 - DNA, 201 bp, Homo sapiens
cgaaccagtcgaaacccagaaacagacacgtacattctcttcaatccttggtgtgaagatgatgctgtgtatctggacaatgagaaagaaagagaagagtwtgtcctgaatgacatcggggtaattttttatggagaggtcaatgacatcaagaccagaagctggagctatggtcagtttgaagatggcatcctggacact

SEQ ID NO: 6836 - DNA, 201 bp, Homo sapiens
  misc_feature (1)...(201): n = A,T,C or G, or insertion/deletion polymorphism (see Tables 1-2)
acaaggagataagaaagcaggtgcaacactcaagtctattgaataatgtagttttgtgatgcattttatagaatgtgtcacactgtggcctgatcagcagnagccaatatcccttactttaaccctttctgggatgcaatactaggaagtaaagtgaagaatttatctctttagttagtgattatatttcacccatctctc

SEQ ID NO: 6837 - DNA, 201 bp, Homo sapiens
ggatgttctggccaagcaaaagtccaccgtgctaaccatccctgagatcatcatcaaggtccgtggcactcaggtagttggttctgacatgactgtgacarttcagtttaccaatcctttaaaagaaaccctgcgaaatgtctgggtacacctggatggtcctggagtaacaagaccaatgaagaagatgttccgtgaaat

SEQ ID NO: 6838 - DNA, 201 bp, Homo sapiens
gccaacatcaccttctacaccggggtcccgaaggcagaattcaagaaggagacgttcgacgtgacgctggagcccttgtccttcaagaaagaggcggtgcwgatccaagccggcgagtacatgggtcagctgctggaacaagcgtccctgcacttctttgtcacagctcgcatcaatgagaccagggatgttctggccaag

SEQ ID NO: 6839 - DNA, 201 bp, Homo sapiens
attctctcttgtccttcacatcacccatgttgagacctcagcttggcactcaggtgctgaagggtaatatggactcagccttgcaaatagccagtgctagytctgacccaaccacagaggatgctgacatcatttgtattatgttccaaggctactacagagaaggctgcctgctatgtatttgcaaggctgatttatggt

SEQ ID NO: 6840 - DNA, 201 bp, Homo sapiens
aggctgatttatggtcagaatttccctctgatatgtctagggtgtgatttaggtcagtagactgtgattcttagcaaaaaatgaacagtgataagtatacwgggggcaaaatcagaatggaatgctctggtctatataaccacatttctaagcctttgagactgttcctgagccttcagcactaacctatgagggtgagct

SEQ ID NO: 6841 - DNA, 201 bp, Homo sapiens
ataaccacatttctaagcctttgagactgttcctgagccttcagcactaacctatgagggtgagctggtcccctctatatatacatcatacttaactttaytaagtaatctcacagcatttgccaagtctcccaatatccaattttaaaatgaaatgcattttgctagacagttaaactggcttaacttagtatattatta

SEQ ID NO: 6842 - DNA, 201 bp, Homo sapiens
tgttctggccaagcaaaagtccaccgtgctaaccatccctgagatcatcatcaaggtccgtggcactcaggtagttggttctgacatgactgtgacaattsagtttaccaatcctttaaaagaaaccctgcgaaatgtctgggtacacctggatggtcctggagtaacaagaccaatgaagaagatgttccgtgaaatccg

SEQ ID NO: 6843 - DNA, 201 bp, Homo sapiens
tgcagtgggaagaagtgtgccggccctgggtctctgggcatcggaagctgatagccagcatgagcagtgactccctgagacatgtgtatggcgagctggaygtgcagattcaaagacgaccttccatgtgaatgcacaggaagctgagatgaaccctggcatttggcctcttgtagtcttggctaaggaaattctaacgca

SEQ ID NO: 6844 - DNA, 201 bp, Homo sapiens
gtcagaaacttccaggaccgcctttggaggcagaagagcagttccacccaataactctaatgcagcggaagatgacctgcccacagtggagcttcagggcktggtgccccggggcgtcaacctgcaagagtttcttaatgtcacgagcgttcacctgttcaaggagagatgggacactaacaaggtggaccaccacactga

SEQ ID NO: 6845 - DNA, 201 bp, Homo sapiens
tggcatttggcctcttgtagtcttggctaaggaaattctaacgcaaaaatagctcttgctttgacttaggtgtgaagacccagacaggactgcagagggcyccagagtggagatcccacatatttcaaaaacatgcttttccaaacccaggctattcggcaaggaagttagtttttaatctctccaccttccaaagagtgc

SEQ ID NO: 6846 - DNA, 201 bp, Homo sapiens
ggagagatgggacactaacaaggtggaccaccacactgacaagtatgaaaacaacaagctgattgtccgcagagggcagtctttctatgtgcagattgacytcagtcgtccatatgaccccagaagggatctcttcagggtggaatacgtcattggtcgctacccacaggagaacaagggaacctacatcccagtgcctat

SEQ ID NO: 6847 - DNA, 201 bp, Homo sapiens
ttctattggaataccggagctctgagaatccagtccggtatggccaatgctgggtttttgctggtgtctttaacacatttttacgatgccttggaataccmgcaagaattgttaccaattatttctctgcccatgataatgatgccaatttgcaaatggacatcttcctggaagaagatgggaacgtgaattccaaactca

SEQ ID NO: 6848 - DNA, 201 bp, Homo sapiens
aacgttgacatggactttgaagtggaaaatgctgtgctgggaaaagacttcaagctctccatcaccttccggaacaacagccacaaccgttacaccatcayagcttatctctcagccaacatcaccttctacaccggggtcccgaaggcagaattcaagaaggagacgttcgacgtgacgctggagcccttgtccttcaag

SEQ ID NO: 6849 - DNA, 201 bp, Homo sapiens
caacagccacaaccgttacaccatcacagcttatctctcagccaacatcaccttctacaccggggtcccgaaggcagaattcaagaaggagacgttcgacrtgacgctggagcccttgtccttcaagaaagaggcggtgctgatccaagccggcgagtacatgggtcagctgctggaacaagcgtccctgcacttctttgt

SEQ ID NO: 6850 - DNA, 201 bp, Homo sapiens
tcatttacattacagctaagaaagatggcactcatgtggtggaaaatgtggatgccacccacattgggaaattaattgtgaccaaacaaattggaggagayggcatgatggatattactgatacttacaaattccaagaaggtcaagaagaagagagattggccctagaaactgccctgatgtacggagctaaaaagcccc

SEQ ID NO: 6851 - DNA, 201 bp, Homo sapiens
  misc_feature (1)...(201): n = A,T,C or G, or insertion/deletion polymorphism (see Tables 1-2)
agctctccatcaccttccggaacaacagccacaaccgttacaccatcacagcttatctctcagccaacatcaccttctacaccggggtcccgaaggcaganttcaagaaggagacgttcgacgtgacgctggagcccttgtccttcaagaaagaggcggtgctgatccaagccggcgagtacatgggtcagctgctggaac

SEQ ID NO: 6852 - DNA, 201 bp, Homo sapiens; identical to SEQ ID NO: 6847

SEQ ID NO: 6853 - DNA, 201 bp, Homo sapiens
ttaactgcagtttgggatggaggtggtgctcagcttttatataaagggggaagcaagtatgatgctgtgtatctggacaatgagaaagaaagagaagagtwtgtcctgaatgacatcggggtaattttttatggagaggtcaatgacatcaagaccagaagctggagctatggtcagtttgaagatggcatcctggacact

SEQ ID NO: 6854 - DNA, 201 bp, Homo sapiens
taggagtcctactcacacttgtgctgctgcaagtgagaaacttgaccgtcaccttcaatttcaatgttggcaacaacaacaaaagcagccacacacaacayctgtgaatgcccagaccttaactgcagtttgggatggaggtggtgctcagcttttatataaagggggaagcaagtatgatgctgtgtatctggacaatga

SEQ ID NO: 6855 - DNA, 201 bp, Homo sapiens
  misc_feature (1)...(201): n = A,T,C or G, or insertion/deletion polymorphism (see Tables 1-2)
gaaatagcacatagatctcagttcatccccaggatctggcagcaactatgggcagagaatttcccccaaggagatgcagctgcttctgcaaaggctgccgntactgcagataaaggctcgttattcactgtgacacacctacatgtaccacctccatccatatttgctccagtgaatgccaaagatgacgaaggtgtcctc

SEQ ID NO: 6856 - DNA, 201 bp, Homo sapiens
taaagtcagtgaaatgagtagttttcaacgtaatctgtttattctggcctataattacaaaatggaacagatttcaaaaggacgtaatactccactgtgcracagctttgttttccggaaagttcgaagcttgctagggggaaatattcgtctcctgttgtgtggtggcgctccactttctgcaaccacgcagcgattcat

SEQ ID NO: 6857 - DNA, 201 bp, Homo sapiens
aatactgataagccacaccccaggggtgaaattcttattgggggccaaagtgtgacaatggggtactacaaaaatgaagcaaaaacaaaagctgatttctytgaagatgaaaatggacaaaggtggctctgtactggggatattggagagtttgaacccgatggatgcttaaagattattgatcgtaaaaaggaccttgta

SEQ ID NO: 6858 - DNA, 201 bp, Homo sapiens
acccggactccggcgtagcggttttgacacaagggcgcatatcttcaaagcacctagtacctcctaccattgtcaactgattctcgctgaagtctgttaaytctactttttgagtacttatgaataaccacgtgtcttcaaaaccatctaccatgaagctaaaacataccatcaaccctattcttttatattttatacatt

SEQ ID NO: 6859 - DNA, 201 bp, Homo sapiens
atctatatttgtaaacaaattagtcatggaaaattattctatcccaaagtctccttttagtctagataatcattatttcattttaaaattagtgtttttcktagtttgcactgatgcgtgtatggatgtgtgtgagtcagtggtagcttatttaaaaagcaccttatcctttctcccataacctttgtacactaaaaaatg

SEQ ID NO: 6860 - DNA, 201 bp, Homo sapiens
acatcattactagtaaagaactcttacaaacaaagttgaaggatatagtttctttggtcccacgcctgcggcacatcatcactgttgatggaaagccaccracctggtccgagttccccaagggcatcattgtgcataccatggctgcagtggaggccctgggagccaaggccagcatggaaaaccaacctcatagcaaac

SEQ ID NO: 6861 - DNA, 201 bp, Homo sapiens
aacaagagtatataaagttattctttgaatatttcgttgactatatgtacattgagttatctatatttgtaaacaaattagtcatggaaaattattctatyccaaagtctccttttagtctagataatcattatttcattttaaaattagtgtttttcatagtttgcactgatgcgtgtatggatgtgtgtgagtcagtgg

SEQ ID NO: 6862 - DNA, 201 bp, Homo sapiens
acttaaatcataggcaccacatttttcatgtcagactagttactttgttgattctcagttactgtaggcatcaaaaggcaaaaatcaaaaaaaaaaaaacaaaaaaaacaaaaaaaaagatgaacctaggtctgtgtaaagtaaggggagtgttaggagcagccaggactgtgtagtgtgtgtttggttgcatcacaaaca

SEQ ID NO: 6863 - DNA, 201 bp, Homo sapiens
cttaaatcataggcaccacatttttcatgtcagactagttactttgttgattctcagttactgtaggcatcaaaaggcaaaaatcaaaaaaaaaaaaacaaaaaaaacaaaaaaaaagatgaacctaggtctgtgtaaagtaaggggagtgttaggagcagccaggactgtgtagtgtgtgtttggttgcatcacaaacat

SEQ ID NO: 6864 - DNA, 201 bp, Homo sapiens
aacttacttgtttgctgctaaaatactcaagattttgccatttttaaacaaccagtccctgtgatacaactttgaaaaaacttttaaaaatctctgatgtrtgggctctttttttcccataagaattatgtacatctgtgatgttttacagggggatccgcttttaaacagtgtacatattggaccacactgaaatgtcat

SEQ ID NO: 6865 - DNA, 201 bp, Homo sapiens
ttaaatcataggcaccacatttttcatgtcagactagttactttgttgattctcagttactgtaggcatcaaaaggcaaaaatcaaaaaaaaaaaaacaaaaaaaacaaaaaaaaagatgaacctaggtctgtgtaaagtaaggggagtgttaggagcagccaggactgtgtagtgtgtgtttggttgcatcacaaacatc

SEQ ID NO: 6866 - DNA, 201 bp, Homo sapiens
acaagagtatataaagttattctttgaatatttcgttgactatatgtacattgagttatctatatttgtaaacaaattagtcatggaaaattattctatcrcaaagtctccttttagtctagataatcattatttcattttaaaattagtgtttttcatagtttgcactgatgcgtgtatggatgtgtgtgagtcagtggt

SEQ ID NO: 6867 - DNA, 201 bp, Homo sapiens
gcatatgcaaacagttatcattcttatgtcattggatttgttgtgccaaatcaaaaggaactaactgaactagctcgaaagaaaggacttaaagggacttsggaggagctgtgtaacagttgtgaaatggaaaatgaggtacttaaagtgctttccgaagctgctatttcagcaagtctggaaaagtttgaaattccagta

SEQ ID NO: 6868 - DNA, 201 bp, Homo sapiens
gtttgagtcctgaaccgtggacccctgaaactggtctggtgacagatgccttcaagctgaaacgcaaagagcttaaaacacattaccaggcggacattgarcgaatgtatggaagaaaataattattctcttctggcatcagtttgctacagtgagctcagatcaaataggaaaatacttgaaatgcatgtctcaagctgc

SEQ ID NO: 6869 - DNA, 201 bp, Homo sapiens; identical to SEQ ID NO: 6857

SEQ ID NO: 6870 - DNA, 201 bp, Homo sapiens; identical to SEQ ID NO: 6856

SEQ ID NO: 6871 - DNA, 201 bp, Homo sapiens
gggaaacagctgtaacatttgccaccctcagaagctgctggtcctgtgtcacaccaccttagcctcttgatcgaggaagattctcgctgaagtctgttaaytctactttttgagtacttatgaataaccacgtgtcttcaaaaccatctaccatgaagctaaaacataccatcaaccctattcttttatattttatacatt

SEQ ID NO: 6872 - DNA, 200 bp, Homo sapiens
  misc_feature (1)...(200): n = A,T,C or G, or insertion/deletion polymorphism (see Tables 1-2)
atacagaattcgttgttgggaaggactggggaaacagctgtaacatttgccaccctcagaagctgctggtcctgtgtcacaccaccttagcctcttgatngaggaagattctcgctgaagtctgttaattctactttttgagtacttatgaataaccacgtgtcttcaaaaccatctaccatgaagctaaaacataccat

SEQ ID NO: 6873 - DNA, 201 bp, Homo sapiens; identical to SEQ ID NO: 6859

SEQ ID NO: 6874 - DNA, 201 bp, Homo sapiens; identical to SEQ ID NO: 6860

SEQ ID NO: 6875 - DNA, 201 bp, Homo sapiens; identical to SEQ ID NO: 6861

SEQ ID NO: 6876 - DNA, 201 bp, Homo sapiens; identical to SEQ ID NO: 6862

SEQ ID NO: 6877 - DNA, 201 bp, Homo sapiens; identical to SEQ ID NO: 6863

SEQ ID NO: 6878 - DNA, 201 bp, Homo sapiens; identical to SEQ ID NO: 6865

SEQ ID NO: 6879 - DNA, 201 bp, Homo sapiens; identical to SEQ ID NO: 6864

SEQ ID NO: 6880 - DNA, 201 bp, Homo sapiens; identical to SEQ ID NO: 6867

SEQ ID NO: 6881 - DNA, 201 bp, Homo sapiens; identical to SEQ ID NO: 6866

SEQ ID NO: 6882 - DNA, 201 bp, Homo sapiens; identical to SEQ ID NO: 6868

SEQ ID NO: 6883 - DNA, 201 bp, Homo sapiens; identical to SEQ ID NO: 6857

SEQ ID NO: 6884 - DNA, 201 bp, Homo sapiens; identical to SEQ ID NO: 6856

SEQ ID NO: 6885 - DNA, 201 bp, Homo sapiens; identical to SEQ ID NO: 6871

SEQ ID NO: 6886 - DNA, 201 bp, Homo sapiens
  misc_feature (1)...(201): n = A,T,C or G, or insertion/deletion polymorphism (see Tables 1-2)
gatacagaattcgttgttgggaaggactggggaaacagctgtaacatttgccaccctcagaagctgctggtcctgtgtcacaccaccttagcctcttgatngaggaagattctcgctgaagtctgttaattctactttttgagtacttatgaataaccacgtgtcttcaaaaccatctaccatgaagctaaaacataccat

SEQ ID NO: 6887 - DNA, 201 bp, Homo sapiens; identical to SEQ ID NO: 6859

SEQ ID NO: 6888 - DNA, 201 bp, Homo sapiens; identical to SEQ ID NO: 6860

SEQ ID NO: 6889 - DNA, 201 bp, Homo sapiens; identical to SEQ ID NO: 6861

SEQ ID NO: 6890 - DNA, 201 bp, Homo sapiens; identical to SEQ ID NO: 6862

SEQ ID NO: 6891 - DNA, 201 bp, Homo sapiens; identical to SEQ ID NO: 6863

SEQ ID NO: 6892 - DNA, 201 bp, Homo sapiens; identical to SEQ ID NO: 6865

SEQ ID NO: 6893 - DNA, 201 bp, Homo sapiens; identical to SEQ ID NO: 6864

SEQ ID NO: 6894 - DNA, 201 bp, Homo sapiens; identical to SEQ ID NO: 6867

SEQ ID NO: 6895 - DNA, 201 bp, Homo sapiens; identical to SEQ ID NO: 6866

SEQ ID NO: 6896 - DNA, 201 bp, Homo sapiens; identical to SEQ ID NO: 6868

SEQ ID NO: 6897 - DNA, 201 bp, Homo sapiens; identical to SEQ ID NO: 6856

SEQ ID NO: 6898 - DNA, 201 bp, Homo sapiens; identical to SEQ ID NO: 6857

SEQ ID NO: 6899 - DNA, 201 bp, Homo sapiens
gcgcggggcgtgaacgctctggggctcagccaggcctgcgcgggcccgaggccggaggaacccggactccggcgtagcgattctcgctgaagtctgttaaytctactttttgagtacttatgaataaccacgtgtcttcaaaaccatctaccatgaagctaaaacataccatcaaccctattcttttatattttatacatt

SEQ ID NO: 6900 - DNA, 201 bp, Homo sapiens; identical to SEQ ID NO: 6859

SEQ ID NO: 6901 - DNA, 201 bp, Homo sapiens; identical to SEQ ID NO: 6860

SEQ ID NO: 6902 - DNA, 201 bp, Homo sapiens; identical to SEQ ID NO: 6861

SEQ ID NO: 6903 - DNA, 201 bp, Homo sapiens; identical to SEQ ID NO: 6862

SEQ ID NO: 6904 - DNA, 201 bp, Homo sapiens; identical to SEQ ID NO: 6863

SEQ ID NO: 6905 - DNA, 201 bp, Homo sapiens; identical to SEQ ID NO: 6864

SEQ ID NO: 6906 - DNA, 201 bp, Homo sapiens; identical to SEQ ID NO: 6865

SEQ ID NO: 6907 - DNA, 201 bp, Homo sapiens; identical to SEQ ID NO: 6866

SEQ ID NO: 6908 - DNA, 201 bp, Homo sapiens; identical to SEQ ID NO: 6867

SEQ ID NO: 6909 - DNA, 201 bp, Homo sapiens; identical to SEQ ID NO: 6868

SEQ ID NO: 6910 - DNA, 201 bp, Homo sapiens
cccaaccacaaagggacagtgtgaccctgagcaagtcactacctctgtccactttctgatctacaaaatgaaatgacggagatactgagtcagctgtggcrttctactcactaccaaatcataatttataaacctcgttaaccctccccaaaacacttgtattctttatgttaaaacaagtccgaagcttatatgagataa

SEQ ID NO: 6911 - DNA, 201 bp, Homo sapiens
gaggatgacatgttaaaagaagaaatgaatggattttcatcctttgcaaggtcactagtaccctcttcagagagactacacctaagtctacataaatccartaaagtcatcacaaatggtcctgagaagaactccagttcctccccgtccagtgtggattatgcagcctccgggccccggaaactgagctctggagccctg

SEQ ID NO: 6912 - DNA, 124 bp, Homo sapiens
  misc_feature (1)...(124): n = A,T,C or G, or insertion/deletion polymorphism (see Tables 1-2)
ccagcccttagcaacggcctggcnacggtttccctgctgctgcagcccccgtcggctcctcttttccagtcctccactgccggggctgggcccggccgcgggaaggaccgaaggggatacagcg

SEQ ID NO: 6913 - DNA, 201 bp, Homo sapiens
acagaaccacaaccctaccctgcctttttctccacaggtcaggattccagatgattaacattaactgttcttcagaggctgagaaaatcacttaagagaartaagtacctacctcttctgctgtcaccattgctataattgcaattccctgttcccataccatctgccaaaaatcttgacaggtattctgtaatggtccct

SEQ ID NO: 6914 - DNA, 201 bp, Homo sapiens
aaagttaaagtcactcacataaaaatcccttgaggtcttctggacagccatgttcaggccagtctgtgtattggaggtgccagacggtcctctcttgcccrgtaaggaggtgcttcatcttcaggcctgtggtggcatagcagccagagtctgtgcggaaccgggtcgtgatcttaaaccttccataggtgacagtgttgt

SEQ ID NO: 6915 - DNA, 201 bp, Homo sapiens
cactagtaccctcttcagagagactacacctaagtctacataaatccagtaaagtcatcacaaatggtcctgagaagaactccagttcctccccgtccagygtggattatgcagcctccgggccccggaaactgagctctggagccctgtatggcagaaggcccagaagcacattcccaaattcccaccggtttcagttag

SEQ ID NO: 6916 - DNA, 201 bp, Homo sapiens
agtaatgctgcagtagactgctcggttccagtaagcgtgagtaccagcataaagtatgcagaccaacaacgaagagagaaactcaaaaaggaattagcacratgtgaaaaagagttcaaattaactaaaactgcaatgcgagccaattataaaaataattccaagtcactttttaataccttacaaaagccctcaggcgaa

SEQ ID NO: 6917 - DNA, 201 bp, Homo sapiens
acgactgttcgagcgacatataaaacaaaataaacatttggaggaggaaaaaatgcgccacctgctgcatgtcctgaaagtagacttaggctgcacatcgraggaaaactcggcaggcgatcatgatctccgacaaaatcaccacgccagtccttcctaccccagcactgcagtggaccaacaacggagggttggggcttt

SEQ ID NO: 6918 - DNA, 201 bp, Homo sapiens
gagagaaactcaaaaaggaattagcacaatgtgaaaaagagttcaaattaactaaaactgcaatgcgagccaattataaaaataattccaagtcacttttkaataccttacaaaagccctcaggcgaaccgcaaattgaggatgacatgttaaaagaagaaatgaatggattttcatcctttgcaaggtcactagtaccct

SEQ ID NO: 6919 - DNA, 201 bp, Homo sapiens
tataaaacaaaataaacatttggaggaggaaaaaatgcgccacctgctgcatgtcctgaaagtagacttaggctgcacatcggaggaaaactcggcaggcratcatgatctccgacaaaatcaccacgccagtccttcctaccccagcactgcagtggaccaacaacggagggttggggctttggggatcacttgtgctat

SEQ ID NO: 6920 - DNA, 201 bp, Homo sapiens
  misc_feature (1)...(201): n = A,T,C or G, or insertion/deletion polymorphism (see Tables 1-2)
ctcttttccagtcctccactgccggggctgggcccggccgcgggaaggaccgaaggggatacagcgtgtccctgcggcggctgcaagaggactaagcatgnatggcagccggagagtcagagcaacctctgtccttcccagatatggtccaccgtgcctatttaaaggacacttgagcaccaaaagtaatgctgcagtaga

SEQ ID NO: 6921 - DNA, 161 bp, Homo sapiens
ccagcccttagcaacggcctggcgacggtttccctgctgctgcagcccccgtcggctcctyttttccagtcctccactgccggggctgggcccggccgcgggaaggaccgaaggggatacagcgtgtccctgcggcggctgcaagaggactaagcatggat

SEQ ID NO: 6922 - DNA, 201 bp, Homo sapiens
ccattcactcctcgcactttaaaaacagaagcaaaatctttcctgtcacagtatcgctattatacacctgccaaaagaaaaaaggattttacagatcaacrgatagaagctgaaacccagactgaattaagctttaaatctgagttggggacagctgagactaaaaacatgacagattcagaaatgaacataaagcaggca

SEQ ID NO: 6923 - DNA, 201 bp, Homo sapiens
agcaacctctgtccttcccagatatggtccaccgtgcctatttaaaggacacttgagcaccaaaagtaatgctgcagtagactgctcggttccagtaagcrtgagtaccagcataaagtatgcagaccaacaacgaagagagaaactcaaaaaggaattagcacaatgtgaaaaagagttcaaattaactaaaactgcaat

SEQ ID NO: 6924 - DNA, 201 bp, Homo sapiens
tcggaggaaaactcggcaggcgatcatgatctccgacaaaatcaccacgccagtccttcctaccccagcactgcagtggaccaacaacggagggttggggytttggggatcacttgtgctatttgtatggcgtcgaacagactggatctcttcaagatatgctgtggaaaatcaatgaaatagaaaagtactcaaggatca

SEQ ID NO: 6925 - DNA, 201 bp, Homo sapiens
gccaaagctgcagtagactgctcggttccagtaagcgtgagtaccagcataaagtatgcagaccaacaacgaagagagaaactcaaaaaggaattagcacratgtgaaaaagagttcaaattaactaaaactgcaatgcgagccaattataaaaataattccaagtcactttttaataccttacaaaagccctcaggcgaa

SEQ ID NO: 6926 - DNA, 201 bp, Homo sapiens; identical to SEQ ID NO: 6918

SEQ ID NO: 6927 - DNA, 201 bp, Homo sapiens
  misc_feature (1)...(201): n = A,T,C or G, or insertion/deletion polymorphism (see Tables 1-2)
ctcttttccagtcctccactgccggggctgggcccggccgcgggaaggaccgaaggggatacagcgtgtccctgcggcggctgcaagaggactaagcatgnatggcagccggagagtcagagcaacctctgtccttcccagatatggtccaccgtgcctatttaaaggacacttgagcaccaaaagtaatgctttttgcac

SEQ ID NO: 6928 - DNA, 201 bp, Homo sapiens
cagactaagcactctccagctggtcaagaatcacatggctgttcactataataaaatcctttcagccaaagctgcagtagactgctcggttccagtaagcrtgagtaccagcataaagtatgcagaccaacaacgaagagagaaactcaaaaaggaattagcacaatgtgaaaaagagttcaaattaactaaaactgcaat

SEQ ID NO: 6929 - DNA, 201 bp, Homo sapiens; identical to SEQ ID NO: 6922

SEQ ID NO: 6930 - DNA, 201 bp, Homo sapiens
cactagtaccctcttcagagagactacacctaagtctacataaatccagtaaagtcatcacaaatggccctgagaagaactccagttcctccccgtccagygtggattatgcagcctcgggcccccggaaactgagctctggagccctgtatggcagaaggcccagaagcacattcccaaattcccaccggtttcagttag

SEQ ID NO: 6931 - DNA, 201 bp, Homo sapiens
gaggatgacatgttaaaagaagaaatgaatggattttcatcctttgcaaggtcactagtaccctcttcagagagactacacctaagtctacataaatccartaaagtcatcacaaatggccctgagaagaactccagttcctccccgtccagtgtggattatgcagcctcgggcccccggaaactgagctctggagccctg

SEQ ID NO: 6932 - DNA, 201 bp, Homo sapiens
gccaggggttccgtgggaggcggccctagccggggccctgctggcgctggcggtgctggccaccgtgggaggcaacctgctggtcatcgtggccatcgccyggactccgagactccagaccatgaccaacgtgttcgtgacttcgctggccgcagccgacctggtgatgggactcctggtggtgccgccggcggccacctt

SEQ ID NO: 6933 - DNA, 201 bp, Homo sapiens
acgcgccagctgcgcttgctgcgcggggagctgggccgctttccgcccgaggagtctccgccggcgccgtcgcgctctctggccccggccccggtggggaygtgcgctccgcccgaaggggtgcccgcctgcggccggcggcccgcgcgcctcctgcctctccgggaacaccgggccctgtgcaccttgggtctcatcatg

SEQ ID NO: 6934 - DNA, 201 bp, Homo sapiens
cgctcatctactgccgcagcccggactttcgcagcgccttccgccgtcttctgtgccgctgcggccgtcgcctgcctccggagccctgcgccgccgcccgyccggccctcttcccctcgggcgttcctgcggcccggagcagcccagcgcagcccaggctttgccaacggctcgacgggtttgacagctgtggaggtgaga

SEQ ID NO: 6935 - DNA, 201 bp, Homo sapiens
gccttgctgtcccctcccctgagccaggtgatttgggagaccccctccttccttctttccctaccgccccacgcgcgacccggggatggctccgtggcctyacgagaacagctctcttgccccatggccggacctccccaccctggcgcccaataccgccaacaccagtgggctgccaggggttccgtgggaggcggccct

SEQ ID NO: 6936 - DNA, 105 bp, Homo sapiens
ttcccctcgggcgttcctgcggcccggagcagcccagcgcagcccaggctttgccaacggctcgacgggtttgacagctgtggaggtgagaatccacttcyggta

SEQ ID NO: 6937 - DNA, 115 bp, Homo sapiens
gctactcctcccccragagcggtggcaccgagggagttggggtggggggaggctgagcgctctggctgggacagctagagaagatggcccaggctggggaagtcgctctcatgcc

SEQ ID NO: 6938 - DNA, 201 bp, Homo sapiens; identical to SEQ ID NO: 6932

SEQ ID NO: 6939 - DNA, 201 bp, Homo sapiens; identical to SEQ ID NO: 6933

SEQ ID NO: 6940 - DNA, 201 bp, Homo sapiens
cgctcatctactgccgcagcccggactttcgcagcgccttccgccgtcttctgtgccgctgcggccgtcgcctgcctccggagccctgcgccgccgcccgyccggccctcttcccctcgggcgttcctgcggcccggagcagcccagcgcagcccaggctttgccaacggctcgacggggcttcttggggagtttcttagg

SEQ ID NO: 6941 - DNA, 201 bp, Homo sapiens; identical to SEQ ID NO: 6935

SEQ ID NO: 6942 - DNA, 201 bp, Homo sapiens
cttaccaagtgggttttcaccatcctcttgctctctgtctgagagatgttttctaaaccccagccttgaacttcactcctccctcagtggtagtgtccagstgccgtggagcagcaggctggctttggtaggggcacccatcacccggcttgcctgtgcagtcagtgagtgcttagggcaaagagagctcccctggttcca

SEQ ID NO: 6943 - DNA, 201 bp, Homo sapiens
ggagcagcaggctggctttggtaggggcacccatcacccggcttgcctgtgcagtcagtgagtgcttagggcaaagagagctcccctggttccattccttytgccacccaaaccctgatgagaccttagtgttctccaggctctgtggcccaggctgagagcagcagggtagaaaagaccaagatttggggttttatctct

SEQ ID NO: 6944 - DNA, 115 bp, Homo sapiens; identical to SEQ ID NO: 6937

SEQ ID NO: 6945 - DNA, 201 bp, Homo sapiens
caaacgttgacttaggaactttggaatctgaagacctgatccccctcttcaatgatgtagagtctgctctgaacaaaagtgagccctttctaacctggctktaatcactaccattgtaacttggatgtagccatgaccttacatttcctgggcctcttggaaaaagtgatggagcagagcaagtctgcaggtgcaccactt

SEQ ID NO: 6946 - DNA, 201 bp, Homo sapiens
agctcgtggcggaagaagatcctgccggagtctttctttaaggagcctgattcgggctcgcactcgcgccagtccagcaccgactcgtcgggcggccaccmggggcctcgactggctgggggtgcccagcatgtccgctcgcactcgtcgcccgcgtccctgcagctgggcaccggcgcgggtgctgcgggtagccccgcg

SEQ ID NO: 6947 - DNA, 201 bp, Homo sapiens
ccccctcttcaatgatgtagagtctgctctgaacaaaagtgagccctttctaacctggctgtaatcactaccattgtaacttggatgtagccatgaccttmcatttcctgggcctcttggaaaaagtgatggagcagagcaagtctgcaggtgcaccacttcccgcctccatgactcgtgctccctcctttttatgttgcc

SEQ ID NO: 6948 - DNA, 201 bp, Homo sapiens
aaaagtgatggaactggatgctctcccagtcttacatttctatgtaaatgtgaaagagaaacatggctacaaggaccaggtttgaaatttttcactataaraagtttttgaaaataaggagccccagagagaattcctagaagatggcagaggaggaaaaagaggaacctatcttcccacctagataataattttaccagt

SEQ ID NO: 6949 - DNA, 201 bp, Homo sapiens; identical to SEQ ID NO: 6945

SEQ ID NO: 6950 - DNA, 201 bp, Homo sapiens; identical to SEQ ID NO: 6946

SEQ ID NO: 6951 - DNA, 201 bp, Homo sapiens
cttaaataagattccttttgatctaccggaatatacatgtacagagtacattggatcatgttggaaagaaggcaagtgaaaaggtcagagatgaagtagcyaagttatggaatatcgtggaaaggatactagttgtgaaatggaaagagacaagttatagtaccccaaaagcaaaacaagcaggagatgcaagagatgccc

SEQ ID NO: 6952 - DNA, 201 bp, Homo sapiens
gtacaggcagacaagagcgtagcctgctgttgcctccatcactatgaaatgacttattttacctgaaggacccatggtttatgttcctctaattcctttcrctctccctaagccctctgagagagatgaagatagatgattttattgctactaaattgaagggagcactatttctttttgtcttttgttagcaaaaaattg

SEQ ID NO: 6953 - DNA, 201 bp, Homo sapiens
cgtattatttaggatgtgaaatgccatttctttcactgattacaccatatacaggaaacaggtaaaacagtgaaaactttattgtgctggttgatgccaayttggttgaaaagctctctgcagaagaagtgatctagactgacagaagtgttgctaattacaagttgtgttctcatgacgtaattagaaagtaacttctca

SEQ ID NO: 6954 - DNA, 201 bp, Homo sapiens
tctattttggcattttccccaatacatctctgctcatctgactcttatcttggcatctgcttcctggtggatctgaactgacccataagccacgcttactrgtgattttccagaagatgaatccggcctcggcgccccctccgctcccgccgcctgggcagcaagtgatccacgtcacgcaggacctagacacagacctcg

SEQ ID NO: 6955 - DNA, 201 bp, Homo sapiens
gaagaagtgatctagactgacagaagtgttgctaattacaagttgtgttctcatgacgtaattagaaagtaacttctcaaagtacaacttttatgaaaaarataagctgttaaaaaaaggaaatcgtaggttaatttaattgggaaaatgggcaattgacagagaccattttcctaacacatatatgtgctagtactttaa

SEQ ID NO: 6956 - DNA, 201 bp, Homo sapiens; identical to SEQ ID NO: 6947

SEQ ID NO: 6957 - DNA, 201 bp, Homo sapiens; identical to SEQ ID NO: 6952

SEQ ID NO: 6958 - DNA, 201 bp, Homo sapiens; identical to SEQ ID NO: 6951

SEQ ID NO: 6959 - DNA, 201 bp, Homo sapiens; identical to SEQ ID NO: 6945

SEQ ID NO: 6960 - DNA, 201 bp, Homo sapiens; identical to SEQ ID NO: 6946

SEQ ID NO: 6961 - DNA, 201 bp, Homo sapiens; identical to SEQ ID NO: 6953

SEQ ID NO: 6962 - DNA, 201 bp, Homo sapiens; identical to SEQ ID NO: 6955

SEQ ID NO: 6963 - DNA, 201 bp, Homo sapiens; identical to SEQ ID NO: 6947

SEQ ID NO: 6964 - DNA, 201 bp, Homo sapiens
cttccttcctaggcctacctctgttggtgcttttgtcttccaacctccctatgtagtaagaccagccaagcccacatgcccactgggagccctgaaaccasatctggttttctgtcttacctgaacaggttcccagaacccacaccaggcctctgaatcagtctctgagaatctgattgatttaaagccacttggttgctt

SEQ ID NO: 6965 - DNA, 201 bp, Homo sapiens
tcactggactctgcagcctgcagaactggggcaagggtaggagttccagtaggggaaggagcaggtagactcttcagctgcctcagctgggactgaagacytaagctgattctctttcctctccactcctaagaagcaattttctgttcctctccttccaccactttttactttctgctatctcccatctcccgcttccct

SEQ ID NO: 6966 - DNA, 201 bp, Homo sapiens
  misc_feature (1)...(201): n = A,T,C or G, or insertion/deletion polymorphism (see Tables 1-2)
atcctgccaaccagggcaggcccggcgtctgggctctgggaacaaatggggcccacatcctggagtggcaaattttgggggatgcgctacctgtcccagcnggccctgtgcctccaacccagagctccccacagacctggtgtaatttcacaagggccatccctttccccaggcttccctgagggaggcggaagtttgaac

SEQ ID NO: 6967 - DNA, 201 bp, Homo sapiens
cccagctccctgggcatcactgattgctgtcagtatgtcacctcctgtcaccccaagagatcagagagacgcaagtatggccgagacttcctgctacgttkccgcttctgcagcatcgcttgtcagcgaccagtaggactggtccttatggaaggagtgacagatactaagccagagcgacctgcgggttgggctgagtct

SEQ ID NO: 6968 - DNA, 201 bp, Homo sapiens
ctggggtgtggccttgggagatcctgggccagcccctccacacatctccctaagtcagagtggctgctggccctggtagatttgacttgctcttgcctcaytcgacctccaaagtgggactgaagacagtggtcaagagacttgagttcgggacagtaagccaggggttaaggttctttcctttttttgaaagccaaagac

SEQ ID NO: 6969 - DNA, 201 bp, Homo sapiens
cgggtgcggtggctcacacctgtaatcccagcactttgggaggctgaggcgggtggatcacctgaggtcgagagttccagaccagcctgaccaacatgaakaaatcccgtctctactaaaaatacaaaattagccgggcgtgatggcgcatgcctgtaatcccagctacttggaggctgaggcaggagaattgcttgaacc

SEQ ID NO: 6970 - DNA, 183 bp, Homo sapiens
tgcttgaacctgggaagcggaggttgtggtgagccgagatcatgccattgcactccagcctggacaacaagagtgaaactccatctcaaaaaaaaaaaaaraaaagaaaagaaaagaaagaaaactcagctaggaattagaaacatcatttgtcctcttggcctgttcagctggtgactgtag

SEQ ID NO: 6971 - DNA, 201 bp, Homo sapiens
gttttcctgattaaagctatggcagctgcatgagacatgatgcgggtggcacatgcctcttgctgagcatctatttctgatctcttttgcattctggagcsagggctgagcagtgggccatctgtcgctggaaaaatgtctcttccttcctaggcctacctctgttggtgcttttgtcttccaacctccctatgtagtaag

SEQ ID NO: 6972 - DNA, 201 bp, Homo sapiens
caggtggtccagcaggcagctgagtgaccttcgggctgcagagaacctggatgagcctttccctgagatgctaggagaggagccactgctggaggtggagkgggtggagggctccatgtgggcagctatccccatgcagtcggagccccagtatgcagactgtgctgccctcccagtgggtgccctggccacagagcagtg

SEQ ID NO: 6973 - DNA, 201 bp, Homo sapiens; identical to SEQ ID NO: 6964

SEQ ID NO: 6974 - DNA, 201 bp, Homo sapiens; identical to SEQ ID NO: 6965

SEQ ID NO: 6975 - DNA, 201 bp, Homo sapiens; identical to SEQ ID NO: 6966
  misc_feature (1)...(201): n = A,T,C or G, or insertion/deletion polymorphism (see Tables 1-2)

SEQ ID NO: 6976 - DNA, 201 bp, Homo sapiens; identical to SEQ ID NO: 6967

SEQ ID NO: 6977 - DNA, 201 bp, Homo sapiens; identical to SEQ ID NO: 6968

SEQ ID NO: 6978 - DNA, 201 bp, Homo sapiens; identical to SEQ ID NO: 6969

SEQ ID NO: 6979 - DNA, 201 bp, Homo sapiens
tgcttgaacctgggaagcggaggttgtggtgagccgagatcatgccattgcactccagcctggacaacaagagtgaaactccatctcaaaaaaaaaaaaaraaaagaaaagaaaagaaagaaaactcagctaggaattagaaacatcatttgtcctcttggcctgttcagctggtgactgtagatttgatgaaaaggaaac

SEQ ID NO: 6980 - DNA, 201 bp, Homo sapiens; identical to SEQ ID NO: 6971

SEQ ID NO: 6981 - DNA, 201 bp, Homo sapiens; identical to SEQ ID NO: 6972

SEQ ID NO: 6982 - DNA, 201 bp, Homo sapiens
agagcagccgggagagcctcaactcctgcggcttcgtggaaggcaagcccaggcccatgggctccccccggctgggcatcgccagcctgtccaagacctcrgagtacaagccacccagctctccttcccagagatgcaaagtctacacccagaagggggtcctgccgtctcccgccccactgcctccctcgagcaaggatt

SEQ ID NO: 6983 - DNA, 201 bp, Homo sapiens
gcacggccctctctgacaaggagctcaccgacaacgagggccccccagactttgtccctatcgtgccagccctgcagaagacccggggcgacagccggccygcagaggcaggagaggctgcagccggcaagtcagaaagggactgcctgaagtgcaacacgtttgccgagctgcaggagaggctggactgcatcgacggca

SEQ ID NO: 6984 - DNA, 201 bp, Homo sapiens
gaaaaccccccaacagcacaggcgtccgctgggtggatggccccttgcggagcagcccgaggggccttggggaaccctttgagattaaagtctatgaaatygatgatgtggagcgcctgcagcggcgacgagggggtgccagcaaggaggccatgtgcttcaatgcaaagctgaagattctggaacaccgccagcagagga

SEQ ID NO: 6985 - DNA, 201 bp, Homo sapiens
aggagctcaccgacaacgagggccccccagactttgtccctatcgtgccagccctgcagaagacccggggcgacagccggcccgcagaggcaggagaggcygcagccggcaagtcagaaagggactgcctgaagtgcaacacgtttgccgagctgcaggagaggctggactgcatcgacggcagcgaggagcccagcagct

SEQ ID NO: 6986 - DNA, 201 bp, Homo sapiens
gccatgtgcttcaatgcaaagctgaagattctggaacaccgccagcagaggatcgccgaggtccgcgcgaagtacgagtggctgatgaaggagctggaggygaccaaacagtatctgatgctggatcccaacaagtggctcagtgaatttgacttggagcaggtttgggagctggattccctggagtacctggaggcactg

SEQ ID NO: 6987 - DNA, 201 bp, Homo sapiens
agtaagttgtgtttgtagagctatttcttaatcagtattgcttatgaataaatattacctgtcttttatggttattctggtgaggccactcaaacagagasacttccctcggcacgagccagtgtgtgtgtttccaaagtaggtttggagcagcaggtgacctcgatgccacatcccaacaagcagcgtggtcaggtagac

SEQ ID NO: 6988 - DNA, 201 bp, Homo sapiens
cctcccgcaggagccaccaacaggactgtgatgaggacgaccaccgcaactcacacgtgttcttcacactgcacatctaccagtaccggatggagaagagygggaaagggggaatgtctggaggtcgcagccgcctgcatctcattgatctcggcagctgtgtgaaagctcttagcaaaaatcgagaaggaggctcagggc

SEQ ID NO: 6989 - DNA, 201 bp, Homo sapiens
ggcgaccaaacagtatctgatgctggatcccaacaagtggctcagtgaatttgacttggagcaggtttgggagctggattccctggagtacctggaggcaytggagtgtgtgacggagcgcctggagagccgtgtcaacttctgcaaggcccatctcatgatgatcacctgcttcgacatcacctccaggcgccggtagat

SEQ ID NO: 6990 - DNA, 201 bp, Homo sapiens
cccccaacagcacaggcgtccgctgggtggatggccccttgcggagcagcccgaggggccttggggaaccctttgagattaaagtctatgaaatcgatgaygtggagcgcctgcagcggcgacgagggggtgccagcaaggaggccatgtgcttcaatgcaaagctgaagattctggaacaccgccagcagaggatcgccg

SEQ ID NO: 6991 - DNA, 201 bp, Homo sapiens
aacaagtggctcagtgaatttgacttggagcaggtttgggagctggattccctggagtacctggaggcactggagtgtgtgacggagcgcctggagagccrtgtcaacttctgcaaggcccatctcatgatgatcacctgcttcgacatcacctccaggcgccggtagatgagccagacccttgtcctagtggtcccccgc

SEQ ID NO: 6992 - DNA, 201 bp, Homo sapiens
cggccacgccaaactgggaaaatcctacaccatgatcggaaaggatgattccatgcagaacctgggcatcattccctgtgccatctcttggctcttcaagstcataaacgaacgcaaggaaaagaccggcgcccgtttctcagtccgggtttccgccgtggaagtgtgggggaaggaggagaacctgcgggacctgctgtc

SEQ ID NO: 6993 - DNA, 201 bp, Homo sapiens
gaggacgagctggtgttcacgctggtggaggagctgaccatcagcggggtcctggacagcggccgccccaccagcatcatcagcttcaacagcgactgctytgcacgggccctggcctcgggctcgcggcccgtcagcatcatcagcagcatcagcgaggacctggagtgctactccagcacggcccccgtctccgaggtc

SEQ ID NO: 6994 - DNA, 201 bp, Homo sapiens
acagcggccgccccaccagcatcatcagcttcaacagcgactgctctgcacgggccctggcctcgggctcgcggcccgtcagcatcatcagcagcatcagygaggacctggagtgctactccagcacggcccccgtctccgaggtcagcatcacacagttcttgcccctcccgaagatgagcctggatgagaaggcccagg

SEQ ID NO: 6995 - DNA, 201 bp, Homo sapiens
aggacctggagtgctactccagcacggcccccgtctccgaggtcagcatcacacagttcttgcccctcccgaagatgagcctggatgagaaggcccaggaygcagggagcagacgctcttccatcagctcctggctgagcgagatgagcgcgggcagtgaggcccccatcaaaggctgcaaaatatccacagtgagcaagg

SEQ ID NO: 6996 - DNA, 201 bp, Homo sapiens
acacggccaatctgagcagctgcgaggggtacatccccatgaagaccaatatcacagtttacccctgcattgccatgagcccccggaacatccaagagccsgaggcccccaccgccacccccaaagcaggccccacattagcccagtcccgggagagtaaggaaaacagtgcaaagaaagagatgaaatttgaggacccgt

SEQ ID NO: 6997 - DNA, 201 bp, Homo sapiens
aggatgattccatgcagaacctgggcatcattccctgtgccatctcttggctcttcaagctcataaacgaacgcaaggaaaagaccggcgcccgtttctcmgtccgggtttccgccgtggaagtgtgggggaaggaggagaacctgcgggacctgctgtcggaggtggccacgggcagcctgcaggacggccagtccccgg

SEQ ID NO: 6998 - DNA, 201 bp, Homo sapiens
aacggcacggccctctctgacaaggagctcaccgacaacgagggccccccagactttgtccctatcgtgccagccctgcagaagacccggggcgacagccrgcccgcagaggcaggagaggctgcagccggcaagtcagaaagggactgcctgaagtgcaacacgtttgccgagctgcaggagaggctggactgcatcgac

SEQ ID NO: 6999 - DNA, 201 bp, Homo sapiens
tagccatgacttatcaatgatgatggattggaaagcagtagctgcccagaagttaaatctgtcttctaaaaagaagaaacatcggccttccacttcttccsctgccgaaccaccgctctttgcaaccagcttcagtgggattctgcagacctcccctcccccagccccaccctgcctgctgagggctgtcaacaaggtgaa

SEQ ID NO: 7000 - DNA, 201 bp, Homo sapiens; identical to SEQ ID NO: 6989

SEQ ID NO: 7001 - DNA, 201 bp, Homo sapiens; identical to SEQ ID NO: 6987

SEQ ID NO: 7002 - DNA, 201 bp, Homo sapiens; identical to SEQ ID NO: 6990

SEQ ID NO: 7003 - DNA, 201 bp, Homo sapiens; identical to SEQ ID NO: 6991

SEQ ID NO: 7004 - DNA, 201 bp, Homo sapiens; identical to SEQ ID NO: 6984

SEQ ID NO: 7005 - DNA, 201 bp, Homo sapiens; identical to SEQ ID NO: 6986

SEQ ID NO: 7006 - DNA, 201 bp, Homo sapiens; identical to SEQ ID NO: 6989

SEQ ID NO: 7007 - DNA, 201 bp, Homo sapiens; identical to SEQ ID NO: 6987

SEQ ID NO: 7008 - DNA, 201 bp, Homo sapiens; identical to SEQ ID NO: 6990

SEQ ID NO: 7009 - DNA, 201 bp, Homo sapiens; identical to SEQ ID NO: 6991

SEQ ID NO: 7010 - DNA, 201 bp, Homo sapiens; identical to SEQ ID NO: 6984

SEQ ID NO: 7011 - DNA, 201 bp, Homo sapiens; identical to SEQ ID NO: 6986

SEQ ID NO: 7012 - DNA, 201 bp, Homo sapiens
  misc_feature (1)...(201): n = A,T,C or G, or insertion/deletion polymorphism (see Tables 1-2)
agtttactgtgctggaccttggaatggtgctgcttccagtggccagccagatggaagcatcctgcctcgtcatccagttggttcaagagcaaaccaaagancccagtaagaaccctcttctcgggaagaaacgggccctgctgctgtctgagccttcgctccttcgaaccgtgcagcagatcccaggagttggaaaagtta

SEQ ID NO: 7013 - DNA, 201 bp, Homo sapiens
tgggacggtggggttcctgccggctgtattcgggccttggactggactgagaagctacggtggagaccatccatggaaaagaacccccctgatgatacggsccccgtgcacgtgcctttggggcatattgtggccaatgagaaatggcgcgggtcacagctggcgcaggagatgcaagggaaaattaagctcattttcgag

SEQ ID NO: 7014 - DNA, 201 bp, Homo sapiens
gcatcctgcctcgtcatccagttggttcaagagcaaaccaaagagcccagtaagaaccctcttctcgggaagaaacgggccctgctgctgtctgagccttygctccttcgaaccgtgcagcagatcccaggagttggaaaagttaaagctccccttctcctccagaagtttccaagcatccagcaactgagtaatgcttcc

SEQ ID NO: 7015 - DNA, 201 bp, Homo sapiens
aaaacccggatgagtgaacaatacttcccagccctacagaagtttactgtgctggaccttggaatggtgctgcttccagtggccagccagatggaagcatyctgcctcgtcatccagttggttcaagagcaaaccaaagagcccagtaagaaccctcttctcgggaagaaacgggccctgctgctgtctgagccttcgctc

SEQ ID NO: 7016 - DNA, 201 bp, Homo sapiens
agaagtttccaagcatccagcaactgagtaatgcttccattggggaactggagcaggtggtcggacaagcagtggcacagcagatccatgccttcttcacrcagcccaggtgagggctggcctcagggccacggcatcttctcccgagaccacaaacaccaggatcttgttttcagctttaaaaaccaagagaatgggccg

SEQ ID NO: 7017 - DNA, 201 bp, Homo sapiens
ctccttcgaaccgtgcagcagatcccaggagttggaaaagttaaagctccccttctcctccagaagtttccaagcatccagcaactgagtaatgcttccaytggggaactggagcaggtggtcggacaagcagtggcacagcagatccatgccttcttcacgcagcccaggtgagggctggcctcagggccacggcatctt

SEQ ID NO: 7018 - DNA, 201 bp, Homo sapiens
gaactggagcaggtggtcggacaagcagtggcacagcagatccatgccttcttcacgcagcccaggtgagggctggcctcagggccacggcatcttctccygagaccacaaacaccaggatcttgttttcagctttaaaaaccaagagaatgggccgggtgcactggctcacgcctctaatctcagcactttgggaggccg

SEQ ID NO: 7019 - DNA, 201 bp, Homo sapiens
tgtctgcagtaaaacccactgctgtcccaccactagctgagccaggagctggcaaaggtctgcattcagaacatcgggagaaaatgaacaggatgcggcartgcattgctcagcgtctgaaggaggcccagaatacatgtgccaatgctgacaatttttaatgagattgatgtgagtaacatccagaagatgagggctcgg

SEQ ID NO: 7020 - DNA, 201 bp, Homo sapiens
accctacaaattgatcatgcaggaactgaaaaccagtcttctccctgtcccctcatgggtcccaggttagcctggtgacaggcacatgctgttggcctcamgcaaggaagcagagcactatgtaaccagcagtcacagcttttttcttggtgttcctgcctggctctctccctctctgcacctgtctcataccctcgaata

SEQ ID NO: 7021 - DNA, 201 bp, Homo sapiens
  misc_feature (1)...(201): n = A,T,C or G, or insertion/deletion polymorphism (see Tables 1-2)
caatggcaccttcattctccattgtcattgacttcaagatgcctcttctacctctaccaggaagcacaggccaggggatctgggtgtgtgaatgggagganagagcagaggttccctgaggtcacgtgttgtaatcatcatagaaggagagcccaggtctgccctcacgctctccatcataggctcacaccaagaagactc

SEQ ID NO: 7022 - DNA, 201 bp, Homo sapiens
  misc_feature (1)...(201): n = A,T,C or G, or insertion/deletion polymorphism (see Tables 1-2)
ctcaggaaaactggtgctgctcctgctaaggccaagccggctgaagctcctgctgctgcagccccaaaagcagaacctatagcagcggcagttcctccccntgcagcacccatacccactcgatgccaccagtgccctcgccctcacaacctccttctagcaaacctgtgtctgcagtaaaacccactgctgtcccaccac

SEQ ID NO: 7023 - DNA, 201 bp, Homo sapiens
ggtcatttctaagatgtgttgccggtggatctgggcacaatcattggaattccttggagctactgggattcatggctttgtatccaactgcatccaggccwgaggctgctgacatttgacactagggccagtagagagtgcctttttgtatcttgagccaagaagtgaggcctgggggtggggaggggggaaggggtggga

SEQ ID NO: 7024 - DNA, 201 bp, Homo sapiens
  misc_feature (1)...(201): n = A,T,C or G, or insertion/deletion polymorphism (see Tables 1-2)
tcacaacctccttctagcaaacctgtgtctgcagtaaaacccactgctgtcccaccactagctgagccaggagctggcaaaggtctgcattcagaacatcnggagaaaatgaacaggatgcggcagtgcattgctcagcgtctgaaggaggcccagaatacatgtgccaatgctgacaatttttaatgagattgatgtgag

SEQ ID NO: 7025 - DNA, 201 bp, Homo sapiens
ccaagccctcagtggaacctgtcaagagcatcagcagcatggagctgaagaccgagccctttgatgacttcctgttcccagcatcatccaggcccagtggstctgagacagcccgctccgtgccagacatggacctatctgggtccttctatgcagcagactgggagcctctgcacagtggctccctggggatggggccca

SEQ ID NO: 7026 - DNA, 121 bp, Homo sapiens
aaccgcatctgcagcgagcawctgagaagccaagactgagccggcggccgcggcgcagcgaacgagcagtgaccgtgctcctacccagctctgctccacagcgcccacctgtctccgcccc

SEQ ID NO: 7027 - DNA, 201 bp, Homo sapiens
actgatcatgcattgttgaggtggtctgaatgttctgacattaacagttttccatgaaaacgttttattgtgtttttaatttatttattaagatggattcycagatatttatatttttattttatttttttctaccttgaggtcttttgacatgtggaaagtgaatttgaatgaaaaatttaagcattgtttgcttattgt

SEQ ID NO: 7028 - DNA, 196 bp, Homo sapiens
  misc_feature (1)...(196): n = A,T,C or G, or insertion/deletion polymorphism (see Tables 1-2)
aaccgcatctgcagcgagcatctgagaagccaagactgagccggcggccgcggcgcagcgaacgagcagtgaccgtgctcctacccagctctgctncacagcgcccacctgtctccgcccctcggcccctcgcccggctttgcctaaccgccacgatgatgttctcgggcttcaacgcagactacgaggcgtcatc

SEQ ID NO: 7029 - DNA, 201 bp, Homo sapiens
cggacctggccgtctccagtgccaacttcattcccacggtcactgccatctcgaccagtccggacctgcagtggctggtgcagcccgccctcgtctcctcygtggccccatcgcagaccagagcccctcaccctttcggagtccccgccccctccgctggggcttactccagggctggcgttgtgaagaccatgacaggag

SEQ ID NO: 7030 - DNA, 201 bp, Homo sapiens
tgtgtccggaacctgctcgctcacgtcggctttccccttctgttttgttctaggacttctgcacggacctggccgtctccagtgccaacttcattcccacrgtcactgccatctcgaccagtccggacctgcagtggctggtgcagcccgccctcgtctcctccgtggccccatcgcagaccagagcccctcaccctttcg

SEQ ID NO: 7031 - DNA, 201 bp, Homo sapiens; identical to SEQ ID NO: 7025

SEQ ID NO: 7032 - DNA, 121 bp, Homo sapiens; identical to SEQ ID NO: 7026

SEQ ID NO: 7033 - DNA, 201 bp, Homo sapiens; identical to SEQ ID NO: 7027

SEQ ID NO: 7034 - DNA, 196 bp, Homo sapiens; identical to SEQ ID NO: 7028
  misc_feature (1)...(196): n = A,T,C or G, or insertion/deletion polymorphism (see Tables 1-2)

SEQ ID NO: 7035 - DNA, 201 bp, Homo sapiens; identical to SEQ ID NO: 7029

SEQ ID NO: 7036 - DNA, 201 bp, Homo sapiens
accactcacccgcagactccttctccagcatgggctcgcctgtcaacgcgcaggacttctgcacggacctggccgtctccagtgccaacttcattcccacrgtcactgccatctcgaccagtccggacctgcagtggctggtgcagcccgccctcgtctcctccgtggccccatcgcagaccagagcccctcaccctttcg

SEQ ID NO: 7037 - DNA, 201 bp, Homo sapiens; identical to SEQ ID NO: 7025

SEQ ID NO: 7038 - DNA, 121 bp, Homo sapiens; identical to SEQ ID NO: 7026

SEQ ID NO: 7039 - DNA, 201 bp, Homo sapiens; identical to SEQ ID NO: 7027

SEQ ID NO: 7040 - DNA, 196 bp, Homo sapiens; identical to SEQ ID NO: 7028
  misc_feature (1)...(196): n = A,T,C or G, or insertion/deletion polymorphism (see Tables 1-2)

SEQ ID NO: 7041 - DNA, 201 bp, Homo sapiens; identical to SEQ ID NO: 7029

SEQ ID NO: 7042 - DNA, 201 bp, Homo sapiens; identical to SEQ ID NO: 7036

SEQ ID NO: 7043 - DNA, 201 bp, Homo sapiens
gtggcgctgatggaaaaaggaagtccctgcagcagtccccgcactctttaagcagctgtttaccgaaggcaccagttcagccaggagtgaaatccggagasgagcaacgccagcctgggtcacagtccatcaaaccccatgagcccgaccactctcgctcttccttacattcccacgtcccccttctctcccaacccctca

SEQ ID NO: 7044 - DNA, 201 bp, Homo sapiens
atgacatgaagagctggggcttgttacagaaaaataatcataaaatgaacaaaacctcagagcccgggtcatcttctgcaggcggcagaactacatcgggrccaccaaatcaccactcttcagccccatcccactccctgtttcgggcctcgtctgctgggaaagtcacttttccagtatgtctcctggcctcttatgatg

SEQ ID NO: 7045 - DNA, 201 bp, Homo sapiens
tggtggagaaaatccaagctctacaagcctctgaggtgcagtccaaaaggaaagaggctacatgcccgaggcaccaggagatgttccattatttctgcgargatgatgggaagttcctctgttttgtgtgtcgtgaatccaaggaccacaaatcccataatgtcagcttgatcgaagaagctgcccagaattatcaggggc

SEQ ID NO: 7046 - DNA, 201 bp, Homo sapiens
acagacttggcacagcttcctacagtcttgaaacagccctgttgttctgtcatggccagtgggcagtttgtgaacaaactgcaagaggaagtgatctgccscatctgcctggacattctgcagaaacctgtcaccatcgactgtgggcacaatttctgcctcaaatgcatcactcagattggggaaacatcatgtggattt

SEQ ID NO: 7047 - DNA, 201 bp, Homo sapiens
ctgaagaccaagcagaacatgccacccaggcagctgctggagaactggagaaaaaactcagtgaagcaaaatcaagacatgactccatcacagggagcctraaaaaattcaaagaccaactccaggctgataggaaaaaagatgaaaacagattcttcaaaagcatgaataaaaatgacatgaagagctggggcttgttac

SEQ ID NO: 7048 - DNA, 191 bp, Homo sapiens
attacacattcaaagtatccatttgttctcaagaggtagcaagaaacagtatccacagtggactccggggctcctacagacttggcacagyttcctacagtcttgaaacagccctgttgttctgtcatggccagtgggcagtttgtgaacaaactgcaagaggaagtgatctgccccatctgcctggacat

SEQ ID NO: 7049 - DNA, 201 bp, Homo sapiens
atgcatcactcagattggggaaacatcatgtggatttttcaaatgtcccctctgcaaaacttccgtaaggaagaacgcaatcaggttcaactcgctgttgyggaatctggtggagaaaatccaagctctacaagcctctgaggtgcagtccaaaaggaaagaggctacatgcccgaggcaccaggagatgttccattattt

SEQ ID NO: 7050 - DNA, 201 bp, Homo sapiens
tgaggtgcagtccaaaaggaaagaggctacatgcccgaggcaccaggagatgttccattatttctgcgaggatgatgggaagttcctctgttttgtgtgtygtgaatccaaggaccacaaatcccataatgtcagcttgatcgaagaagctgcccagaattatcaggggcagattcaagagcagatccaagtcttgcagca

SEQ ID NO: 7051 - DNA, 166 bp, Homo sapiens
attacacattcaaagtatccatttgttctcaagaggtagcaagaaacagtatccacagtggactcyggggctcctacagacttggcacagcttcctacagtcttgaaacagccctgttgttctgtcatggccagtgggcagtttgtgaacaaactgcaagaggaag

SEQ ID NO: 7052 - DNA, 201 bp, Homo sapiens
aaagcatgaataaaaatgacatgaagagctggggcttgttacagaaaaataatcataaaatgaacaaaacctcagagcccgggtcatcttctgcaggcggmagaactacatcggggccaccaaatcaccactcttcagccccatcccactccctgtttcgggcctcgtctgctgggaaagtcacttttccagtatgtctcc

SEQ ID NO: 7053 - DNA, 201 bp, Homo sapiens
agcgagctctcaggatacgaagacatttgacgttgcgctgtccgaggagctccatgcggcactgagtgagtggctgacagcgatccgggcttggttttgtraggttccttcaagctaagccagctcagagaacacggggagcggtggtgctccacggacttcggagcatagagtggcgctgatggaaaaaggaagtccctg

SEQ ID NO: 7054 - DNA, 201 bp, Homo sapiens
ctcttatgatgagatttctggtcaaggagcgagctctcaggatacgaagacatttgacgttgcgctgtccgaggagctccatgcggcactgagtgagtggytgacagcgatccgggcttggttttgtgaggttccttcaagctaagccagctcagagaacacggggagcggtggtgctccacggacttcggagcatagagt

SEQ ID NO: 7055 - DNA, 201 bp, Homo sapiens
catttgacgttgcgctgtccgaggagctccatgcggcactgagtgagtggctgacagcgatccgggcttggttttgtgaggttccttcaagctaagccagytcagagaacacggggagcggtggtgctccacggacttcggagcatagagtggcgctgatggaaaaaggaagtccctgcagcagtccccgcactctttaag

SEQ ID NO: 7056 - DNA, 201 bp, Homo sapiens
tacatgcccgaggcaccaggagatgttccattatttctgcgaggatgatgggaagttcctctgttttgtgtgtcgtgaatccaaggaccacaaatcccatratgtcagcttgatcgaagaagctgcccagaattatcaggggcagattcaagagcagatccaagtcttgcagcaaaaggagaaggagacagtacaagtgaa

SEQ ID NO: 7057 - DNA, 201 bp, Homo sapiens
ctcaagaagctcattgattccctgaagaccaagcagaacatgccacccaggcagctgctggagaactggagaaaaaactcagtgaagcaaaatcaagacaygactccatcacagggagcctgaaaaaattcaaagaccaactccaggctgataggaaaaaagatgaaaacagattcttcaaaagcatgaataaaaatgaca

SEQ ID NO: 7058 - DNA, 201 bp, Homo sapiens
tcattgattccctgaagaccaagcagaacatgccacccaggcagctgctggagaactggagaaaaaactcagtgaagcaaaatcaagacatgactccatcrcagggagcctgaaaaaattcaaagaccaactccaggctgataggaaaaaagatgaaaacagattcttcaaaagcatgaataaaaatgacatgaagagctg

SEQ ID NO: 7059 - DNA, 201 bp, Homo sapiens
ccatgcggcactgagtgagtggctgacagcgatccgggcttggttttgtgaggttccttcaagctaagccagctcagagaacacggggagcggtggtgctmcacggacttcggagcatagagtggcgctgatggaaaaaggaagtccctgcagcagtccccgcactctttaagcagctgtttaccgaaggcaccagttcag

SEQ ID NO: 7060 - DNA, 201 bp, Homo sapiens
atagagtggcgctgatggaaaaaggaagtccctgcagcagtccccgcactctttaagcagctgtttaccgaaggcaccagttcagccaggagtgaaatccrgagaggagcaacgccagcctgggtcacagtccatcaaaccccatgagcccgaccactctcgctcttccttacattcccacgtcccccttctctcccaacc

SEQ ID NO: 7061 - DNA, 201 bp, Homo sapiens
ggatcctcacagaatttgaactcctgcatcaagtcctagaggaggagaagaatttcctgctatcacggatttactggctgggtcatgagggaacggaagcrgggaaacactatgttgcctccactgagccacagttgaacgatctcaagaagctcattgattccctgaagaccaagcagaacatgccacccaggcagctgc

SEQ ID NO: 7062 - DNA, 201 bp, Homo sapiens
cggatttactggctgggtcatgagggaacggaagcagggaaacactatgttgcctccactgagccacagttgaacgatctcaagaagctcattgattcccygaagaccaagcagaacatgccacccaggcagctgctggagaactggagaaaaaactcagtgaagcaaaatcaagacatgactccatcacagggagcctga

SEQ ID NO: 7063 - DNA, 201 bp, Homo sapiens
  misc_feature (1)...(201): n = A,T,C or G, or insertion/deletion polymorphism (see Tables 1-2)
cctgctatcacggatttactggctgggtcatgagggaacggaagcagggaaacactatgttgcctccactgagccacagttgaacgatctcaagaagctcnttgattccctgaagaccaagcagaacatgccacccaggcagctgctggagaactggagaaaaaactcagtgaagcaaaatcaagacatgactccatcaca

SEQ ID NO: 7064 - DNA, 201 bp, Homo sapiens
acactatgttgcctccactgagccacagttgaacgatctcaagaagctcattgattccctgaagaccaagcagaacatgccacccaggcagctgctggagractggagaaaaaactcagtgaagcaaaatcaagacatgactccatcacagggagcctgaaaaaattcaaagaccaactccaggctgataggaaaaaagat

SEQ ID NO: 7065 - DNA, 201 bp, Homo sapiens
cctgttgttctgtcatggccagtgggcagtttgtgaacaaactgcaagaggaagtgatctgccccatctgcctggacattctgcagaaacctgtcaccatygactgtgggcacaatttctgcctcaaatgcatcactcagattggggaaacatcatgtggatttttcaaatgtcccctctgcaaaacttccgtaaggaaga

SEQ ID NO: 7066 - DNA, 201 bp, Homo sapiens
tgttgcggaatctggtggagaaaatccaagctctacaagcctctgaggtgcagtccaaaaggaaagaggctacatgcccgaggcaccaggagatgttccaytatttctgcgaggatgatgggaagttcctctgttttgtgtgtcgtgaatccaaggaccacaaatcccataatgtcagcttgatcgaagaagctgcccaga

SEQ ID NO: 7067 - DNA, 201 bp, Homo sapiens
actcgctgttgcggaatctggtggagaaaatccaagctctacaagcctctgaggtgcagtccaaaaggaaagaggctacatgcccgaggcaccaggagatrttccattatttctgcgaggatgatgggaagttcctctgttttgtgtgtcgtgaatccaaggaccacaaatcccataatgtcagcttgatcgaagaagctg

SEQ ID NO: 7068 - DNA, 201 bp, Homo sapiens
tgccgcctagtggaaaaaggaagtccctgcagcagtccccgcactctttaagcagctgtttaccgaaggcaccagttcagccaggagtgaaatccggagasgagcaacgccagcctgggtcacagtccatcaaaccccatgagcccgaccactctcgctcttccttacattcccacgtcccccttctctcccaacccctca

SEQ ID NO: 7069 - DNA, 201 bp, Homo sapiens; identical to SEQ ID NO: 7044

SEQ ID NO: 7070 - DNA, 201 bp, Homo sapiens
gtgaagagtttcagtttctcaacccaacccctgttcctctggaactggagaaaaaactcagtgaagcaaaatcaagacatgactccatcacagggagcctraaaaaattcaaagaccaactccaggctgataggaaaaaagatgaaaacagattcttcaaaagcatgaataaaaatgacatgaagagctggggcttgttac

SEQ ID NO: 7071 - DNA, 201 bp, Homo sapiens; identical to SEQ ID NO: 7045

SEQ ID NO: 7072 - DNA, 201 bp, Homo sapiens; identical to SEQ ID NO: 7046

SEQ ID NO: 7073 - DNA, 148 bp, Homo sapiens
aaacagtatccacagtggactccggggctcctacagacttggcacagyttcctacagtcttgaaacagccctgttgttctgtcatggccagtgggcagtttgtgaacaaactgcaagaggaagtgatctgccccatctgcctggacat

SEQ ID NO: 7074 - DNA, 201 bp, Homo sapiens; identical to SEQ ID NO: 7049

SEQ ID NO: 7075 - DNA, 201 bp, Homo sapiens; identical to SEQ ID NO: 7052

SEQ ID NO: 7076 - DNA, 201 bp, Homo sapiens; identical to SEQ ID NO: 7050

SEQ ID NO: 7077 - DNA, 123 bp, Homo sapiens
aaacagtatccacagtggactcyggggctcctacagacttggcacagcttcctacagtcttgaaacagccctgttgttctgtcatggccagtgggcagtttgtgaacaaactgcaagaggaag

SEQ ID NO: 7078 - DNA, 201 bp, Homo sapiens; identical to SEQ ID NO: 7054

SEQ ID NO: 7079 - DNA, 201 bp, Homo sapiens
agcgagctctcaggatacgaagacatttgacgttgcgctgtccgaggagctccatgcggcactgagtgagtggctgacagcgatccgggcttggttttgtraggttccttcaagctaagccagctcagagaacacggggagcggtggtgctccacggacttcggagcatagagtggcgctgagtgagtggctgagaccgac

SEQ ID NO: 7080 - DNA, 201 bp, Homo sapiens
catttgacgttgcgctgtccgaggagctccatgcggcactgagtgagtggctgacagcgatccgggcttggttttgtgaggttccttcaagctaagccagytcagagaacacggggagcggtggtgctccacggacttcggagcatagagtggcgctgagtgagtggctgagaccgaccacggttcttgacttagtggaat

SEQ ID NO: 7081 - DNA, 201 bp, Homo sapiens; identical to SEQ ID NO: 7056

SEQ ID NO: 7082 - DNA, 201 bp, Homo sapiens
tcaaagtcgtcttgtgcagaagtgaagagtttcagtttctcaacccaacccctgttcctctggaactggagaaaaaactcagtgaagcaaaatcaagacaygactccatcacagggagcctgaaaaaattcaaagaccaactccaggctgataggaaaaaagatgaaaacagattcttcaaaagcatgaataaaaatgaca

SEQ ID NO: 7083 - DNA, 201 bp, Homo sapiens
cttgtgcagaagtgaagagtttcagtttctcaacccaacccctgttcctctggaactggagaaaaaactcagtgaagcaaaatcaagacatgactccatcrcagggagcctgaaaaaattcaaagaccaactccaggctgataggaaaaaagatgaaaacagattcttcaaaagcatgaataaaaatgacatgaagagctg

SEQ ID NO: 7084 - DNA, 201 bp, Homo sapiens
ccatgcggcactgagtgagtggctgacagcgatccgggcttggttttgtgaggttccttcaagctaagccagctcagagaacacggggagcggtggtgctmcacggacttcggagcatagagtggcgctgagtgagtggctgagaccgaccacggttcttgacttagtggaattgggtcgaaggagtggagaatgggaggg

SEQ ID NO: 7085 - DNA, 201 bp, Homo sapiens
tgtggtgccgcctagtggaaaaaggaagtccctgcagcagtccccgcactctttaagcagctgtttaccgaaggcaccagttcagccaggagtgaaatccrgagaggagcaacgccagcctgggtcacagtccatcaaaccccatgagcccgaccactctcgctcttccttacattcccacgtcccccttctctcccaacc

SEQ ID NO: 7086 - DNA, 201 bp, Homo sapiens
cggatttactggctgggtcatgagggaacggaagcagggaaacactatgttgcctccactgagccacagttgaacgatctcaagaagctcattgattcccygaagaccaagcagaacatgccacccaggcagctgctggaggatatcaaagtcgtcttgtgcagaagtgaagagtttcagtttctcaacccaacccctgtt

SEQ ID NO: 7087 - DNA, 201 bp, Homo sapiens; identical to SEQ ID NO: 7061

SEQ ID NO: 7088 - DNA, 201 bp, Homo sapiens
  misc_feature (1)...(201): n = A,T,C or G, or insertion/deletion polymorphism (see Tables 1-2)
cctgctatcacggatttactggctgggtcatgagggaacggaagcagggaaacactatgttgcctccactgagccacagttgaacgatctcaagaagctcnttgattccctgaagaccaagcagaacatgccacccaggcagctgctggaggatatcaaagtcgtcttgtgcagaagtgaagagtttcagtttctcaaccc

SEQ ID NO: 7089 - DNA, 201 bp, Homo sapiens
ccaagcagaacatgccacccaggcagctgctggaggatatcaaagtcgtcttgtgcagaagtgaagagtttcagtttctcaacccaacccctgttcctctrgaactggagaaaaaactcagtgaagcaaaatcaagacatgactccatcacagggagcctgaaaaaattcaaagaccaactccaggctgataggaaaaaag

SEQ ID NO: 7090 - DNA, 201 bp, Homo sapiens; identical to SEQ ID NO: 7065

SEQ ID NO: 7091 - DNA, 201 bp, Homo sapiens
gaattgggtcgaaggagtggagaatgggagggctcgggctactgagagtggagatgggggcgggggtggtggtgaagagagttggagaaggaatggacgarttcttgagcaaaaggaggggaagagacaatctccagccacccgccccacgcttgacttcttatcactttggctgtggtgccgcctagtggaaaaaggaag

SEQ ID NO: 7092 - DNA, 201 bp, Homo sapiens; identical to SEQ ID NO: 7066

SEQ ID NO: 7093 - DNA, 201 bp, Homo sapiens; identical to SEQ ID NO: 7067

SEQ ID NO: 7094 - DNA, 201 bp, Homo sapiens; identical to SEQ ID NO: 7045

SEQ ID NO: 7095 - DNA, 201 bp, Homo sapiens; identical to SEQ ID NO: 7046

SEQ ID NO: 7096 - DNA, 201 bp, Homo sapiens; identical to SEQ ID NO: 7047

SEQ ID NO: 7097 - DNA, 191 bp, Homo sapiens; identical to SEQ ID NO: 7048

SEQ ID NO: 7098 - DNA, 201 bp, Homo sapiens
aatactaagggacctctaagtctacaggtggtcaaaatgctgtatccacccaattccactaaatggaataaatgaataaatgaatgaattcatttattccrtttcctcagttcctccccaaattacacctctgccaggaaacagagggcgctccgacttgttcaggtgtactttcttgagtttcacctccatccctcctgc

SEQ ID NO: 7099 - DNA, 201 bp, Homo sapiens; identical to SEQ ID NO: 7049

SEQ ID NO: 7100 - DNA, 166 bp, Homo sapiens; identical to SEQ ID NO: 7051

SEQ ID NO: 7101 - DNA, 201 bp, Homo sapiens; identical to SEQ ID NO: 7050

SEQ ID NO: 7102 - DNA, 201 bp, Homo sapiens; identical to SEQ ID NO: 7056

SEQ ID NO: 7103 - DNA, 201 bp, Homo sapiens; identical to SEQ ID NO: 7057

SEQ ID NO: 7104 - DNA, 201 bp, Homo sapiens; identical to SEQ ID NO: 7058

SEQ ID NO: 7105 - DNA, 201 bp, Homo sapiens; identical to SEQ ID NO: 7062

SEQ ID NO: 7106 - DNA, 201 bp, Homo sapiens; identical to SEQ ID NO: 7061

SEQ ID NO: 7107 - DNA, 201 bp, Homo sapiens; identical to SEQ ID NO: 7064

SEQ ID NO: 7108 - DNA, 201 bp, Homo sapiens; identical to SEQ ID NO: 7063
  misc_feature (1)...(201): n = A,T,C or G, or insertion/deletion polymorphism (see Tables 1-2)

SEQ ID NO: 7109 - DNA, 201 bp, Homo sapiens; identical to SEQ ID NO: 7065

SEQ ID NO: 7110 - DNA, 201 bp, Homo sapiens; identical to SEQ ID NO: 7066

SEQ ID NO: 7111 - DNA, 201 bp, Homo sapiens; identical to SEQ ID NO: 7067

SEQ ID NO: 7112 - DNA, 201 bp, Homo sapiens; identical to SEQ ID NO: 7068

SEQ ID NO: 7113 - DNA, 201 bp, Homo sapiens; identical to SEQ ID NO: 7044

SEQ ID NO: 7114 - DNA, 201 bp, Homo sapiens; identical to SEQ ID NO: 7045

SEQ ID NO: 7115 - DNA, 201 bp, Homo sapiens; identical to SEQ ID NO: 7046

SEQ ID NO: 7116 - DNA, 201 bp, Homo sapiens; identical to SEQ ID NO: 7047

SEQ ID NO: 7117 - DNA, 148 bp, Homo sapiens; identical to SEQ ID NO: 7073

SEQ ID NO: 7118 - DNA, 201 bp, Homo sapiens; identical to SEQ ID NO: 7049

SEQ ID NO: 7119 - DNA, 201 bp, Homo sapiens; identical to SEQ ID NO: 7050

SEQ ID NO: 7120 - DNA, 123 bp, Homo sapiens; identical to SEQ ID NO: 7077

SEQ ID NO: 7121 - DNA, 201 bp, Homo sapiens; identical to SEQ ID NO: 7052

SEQ ID NO: 7122 - DNA, 201 bp, Homo sapiens; identical to SEQ ID NO: 7079

SEQ ID NO: 7123 - DNA, 201 bp, Homo sapiens; identical to SEQ ID NO: 7054

SEQ ID NO: 7124 - DNA, 201 bp, Homo sapiens; identical to SEQ ID NO: 7080

SEQ ID NO: 7125 - DNA, 201 bp, Homo sapiens; identical to SEQ ID NO: 7056

SEQ ID NO: 7126 - DNA, 201 bp, Homo sapiens; identical to SEQ ID NO: 7057

SEQ ID NO: 7127 - DNA, 201 bp, Homo sapiens; identical to SEQ ID NO: 7058

SEQ ID NO: 7128 - DNA, 201 bp, Homo sapiens; identical to SEQ ID NO: 7084

SEQ ID NO: 7129 - DNA, 201 bp, Homo sapiens; identical to SEQ ID NO: 7085

SEQ ID NO: 7130 - DNA, 201 bp, Homo sapiens; identical to SEQ ID NO: 7061

SEQ ID NO: 7131 - DNA, 201 bp, Homo sapiens; identical to SEQ ID NO: 7062

SEQ ID NO: 7132 - DNA, 201 bp, Homo sapiens; identical to SEQ ID NO: 7063
  misc_feature (1)...(201): n = A,T,C or G, or insertion/deletion polymorphism (see Tables 1-2)

SEQ ID NO: 7133 - DNA, 201 bp, Homo sapiens; identical to SEQ ID NO: 7064

SEQ ID NO: 7134 - DNA, 201 bp, Homo sapiens; identical to SEQ ID NO: 7065

SEQ ID NO: 7135 - DNA, 201 bp, Homo sapiens; identical to SEQ ID NO: 7091

SEQ ID NO: 7136 - DNA, 201 bp, Homo sapiens; identical to SEQ ID NO: 7066

SEQ ID NO: 7137 - DNA, 201 bp, Homo sapiens; identical to SEQ ID NO: 7067

SEQ ID NO: 7138 - DNA, 201 bp, Homo sapiens; identical to SEQ ID NO: 7043

SEQ ID NO: 7139 - DNA, 201 bp, Homo sapiens; identical to SEQ ID NO: 7044

SEQ ID NO: 7140 - DNA, 201 bp, Homo sapiens; identical to SEQ ID NO: 7070

SEQ ID NO: 7141 - DNA, 201 bp, Homo sapiens; identical to SEQ ID NO: 7045

SEQ ID NO: 7142 - DNA, 201 bp, Homo sapiens; identical to SEQ ID NO: 7046

SEQ ID NO: 7143 - DNA, 191 bp, Homo sapiens; identical to SEQ ID NO: 7048

SEQ ID NO: 7144 - DNA, 201 bp, Homo sapiens; identical to SEQ ID NO: 7049

SEQ ID NO: 7145 - DNA, 201 bp, Homo sapiens; identical to SEQ ID NO: 7052

SEQ ID NO: 7146 - DNA, 201 bp, Homo sapiens; identical to SEQ ID NO: 7050

SEQ ID NO: 7147 - DNA, 166 bp, Homo sapiens; identical to SEQ ID NO: 7051

SEQ ID NO: 7148 - DNA, 201 bp, Homo sapiens; identical to SEQ ID NO: 7054

SEQ ID NO: 7149 - DNA, 201 bp, Homo sapiens; identical to SEQ ID NO: 7053

SEQ ID NO: 7150 - DNA, 201 bp, Homo sapiens; identical to SEQ ID NO: 7055

SEQ ID NO: 7151 - DNA, 201 bp, Homo sapiens; identical to SEQ ID NO: 7056

SEQ ID NO: 7152 - DNA, 201 bp, Homo sapiens; identical to SEQ ID NO: 7082

SEQ ID NO: 7153 - DNA, 201 bp, Homo sapiens; identical to SEQ ID NO: 7083

SEQ ID NO: 7154 - DNA, 201 bp, Homo sapiens; identical to SEQ ID NO: 7059

SEQ ID NO: 7155 - DNA, 201 bp, Homo sapiens; identical to SEQ ID NO: 7060

SEQ ID NO: 7156 - DNA, 201 bp, Homo sapiens; identical to SEQ ID NO: 7086

SEQ ID NO: 7157 - DNA, 201 bp, Homo sapiens; identical to SEQ ID NO: 7061

SEQ ID NO: 7158 - DNA, 201 bp, Homo sapiens; identical to SEQ ID NO: 7088
  misc_feature (1)...(201): n = A,T,C or G, or insertion/deletion polymorphism (see Tables 1-2)

SEQ ID NO: 7159 - DNA, 201 bp, Homo sapiens; identical to SEQ ID NO: 7089

SEQ ID NO: 7160 - DNA, 201 bp, Homo sapiens; identical to SEQ ID NO: 7065

SEQ ID NO: 7161 - DNA, 201 bp, Homo sapiens; identical to SEQ ID NO: 7066

SEQ ID NO: 7162 - DNA, 201 bp, Homo sapiens; identical to SEQ ID NO: 7067

SEQ ID NO: 7163 - DNA, 201 bp, Homo sapiens; identical to SEQ ID NO: 7068

SEQ ID NO: 7164 - DNA, 201 bp, Homo sapiens; identical to SEQ ID NO: 7044

SEQ ID NO: 7165 - DNA, 201 bp, Homo sapiens; identical to SEQ ID NO: 7070

SEQ ID NO: 7166 - DNA, 201 bp, Homo sapiens; identical to SEQ ID NO: 7045

SEQ ID NO: 7167 - DNA, 201 bp, Homo sapiens; identical to SEQ ID NO: 7046

SEQ ID NO: 7168 - DNA, 191 bp, Homo sapiens; identical to SEQ ID NO: 7048

SEQ ID NO: 7169 - DNA, 201 bp, Homo sapiens; identical to SEQ ID NO: 7049

SEQ ID NO: 7170 - DNA, 201 bp, Homo sapiens; identical to SEQ ID NO: 7052

SEQ ID NO: 7171 - DNA, 201 bp, Homo sapiens; identical to SEQ ID NO: 7050

SEQ ID NO: 7172 - DNA, 166 bp, Homo sapiens; identical to SEQ ID NO: 7051

SEQ ID NO: 7173 - DNA, 201 bp, Homo sapiens; identical to SEQ ID NO: 7054

SEQ ID NO: 7174 - DNA, 201 bp, Homo sapiens; identical to SEQ ID NO: 7079

SEQ ID NO: 7175 - DNA, 201 bp, Homo sapiens; identical to SEQ ID NO: 7080

SEQ ID NO: 7176 - DNA, 201 bp, Homo sapiens; identical to SEQ ID NO: 7056

SEQ ID NO: 7177 - DNA, 201 bp, Homo sapiens; identical to SEQ ID NO: 7082

SEQ ID NO: 7178 - DNA, 201 bp, Homo sapiens; identical to SEQ ID NO: 7083

SEQ ID NO: 7179 - DNA, 201 bp, Homo sapiens; identical to SEQ ID NO: 7084

SEQ ID NO: 7180 - DNA, 201 bp, Homo sapiens; identical to SEQ ID NO: 7085

SEQ ID NO: 7181 - DNA, 201 bp, Homo sapiens; identical to SEQ ID NO: 7086

SEQ ID NO: 7182 - DNA, 201 bp, Homo sapiens; identical to SEQ ID NO: 7061

SEQ ID NO: 7183 - DNA, 201 bp, Homo sapiens; identical to SEQ ID NO: 7088
  misc_feature (1)...(201): n = A,T,C or G, or insertion/deletion polymorphism (see Tables 1-2)

SEQ ID NO: 7184 - DNA, 201 bp, Homo sapiens; identical to SEQ ID NO: 7089

SEQ ID NO: 7185 - DNA, 201 bp, Homo sapiens; identical to SEQ ID NO: 7065

SEQ ID NO: 7186 - DNA, 201 bp, Homo sapiens; identical to SEQ ID NO: 7091

SEQ ID NO: 7187 - DNA, 201 bp, Homo sapiens; identical to SEQ ID NO: 7066

SEQ ID NO: 7188 - DNA, 201 bp, Homo sapiens; identical to SEQ ID NO: 7067

SEQ ID NO: 7189 - DNA, 201 bp, Homo sapiens; identical to SEQ ID NO: 7068

SEQ ID NO: 7190 - DNA, 201 bp, Homo sapiens; identical to SEQ ID NO: 7044

SEQ ID NO: 7191 - DNA, 201 bp, Homo sapiens; identical to SEQ ID NO: 7045

SEQ ID NO: 7192 - DNA, 201 bp, Homo sapiens; identical to SEQ ID NO: 7046

SEQ ID NO: 7193 - DNA, 201 bp, Homo sapiens; identical to SEQ ID NO: 7047

SEQ ID NO: 7194 - DNA, 191 bp, Homo sapiens; identical to SEQ ID NO: 7048

SEQ ID NO: 7195 - DNA, 201 bp, Homo sapiens; identical to SEQ ID NO: 7049

SEQ ID NO: 7196 - DNA, 201 bp, Homo sapiens; identical to SEQ ID NO: 7050

SEQ ID NO: 7197 - DNA, 166 bp, Homo sapiens; identical to SEQ ID NO: 7051

SEQ ID NO: 7198 - DNA, 201 bp, Homo sapiens; identical to SEQ ID NO: 7052

SEQ ID NO: 7199 - DNA, 201 bp, Homo sapiens; identical to SEQ ID NO: 7079

SEQ ID NO: 7200 - DNA, 201 bp, Homo sapiens; identical to SEQ ID NO: 7054

SEQ ID NO: 7201 - DNA, 201 bp, Homo sapiens; identical to SEQ ID NO: 7080

SEQ ID NO: 7202 - DNA, 201 bp, Homo sapiens; identical to SEQ ID NO: 7056

SEQ ID NO: 7203 - DNA, 201 bp, Homo sapiens; identical to SEQ ID NO: 7057

SEQ ID NO: 7204 - DNA, 201 bp, Homo sapiens; identical to SEQ ID NO: 7058

SEQ ID NO: 7205 - DNA, 201 bp, Homo sapiens; identical to SEQ ID NO: 7084

SEQ ID NO: 7206 - DNA, 201 bp, Homo sapiens; identical to SEQ ID NO: 7085

SEQ ID NO: 7207 - DNA, 201 bp, Homo sapiens; identical to SEQ ID NO: 7061

SEQ ID NO: 7208 - DNA, 201 bp, Homo sapiens; identical to SEQ ID NO: 7062

SEQ ID NO: 7209 - DNA, 201 bp, Homo sapiens; identical to SEQ ID NO: 7063
  misc_feature (1)...(201): n = A,T,C or G, or insertion/deletion polymorphism (see Tables 1-2)

SEQ ID NO: 7210 - DNA, 201 bp, Homo sapiens; identical to SEQ ID NO: 7064

SEQ ID NO: 7211 - DNA, 201 bp, Homo sapiens; identical to SEQ ID NO: 7065

SEQ ID NO: 7212 - DNA, 201 bp, Homo sapiens; identical to SEQ ID NO: 7091

SEQ ID NO: 7213 - DNA, 201 bp, Homo sapiens; identical to SEQ ID NO: 7066

SEQ ID NO: 7214 - DNA, 201 bp, Homo sapiens; identical to SEQ ID NO: 7067

SEQ ID NO: 7215 - DNA, 201 bp, Homo sapiens
tacatgcccgaggcaccaggagatgttccactatttctgcgaggatgatgggaagttcctctgttttgtgtgtcgtgaatccaaggaccacaaatcccatratgtcagcttgatcgaagaagctgcccagaattatcaggggcagattcaagagcagatccaagtcttgcagcaaaaggagaaggagacagtacaagtgaa

SEQ ID NO: 7216 - DNA, 201 bp, Homo sapiens
gtgaagagtttcagtttctcaacccaacccctgttcctctggaactggagaaaaaactcagtgaagcaaaatcaagacacgactccatcacagggagcctraaaaaattcaaagaccaactccaggctgataggaaaaaagatgaaaacagattcttcaaaagcatgaataaaaatgacatgaagagctggggcttgttac

SEQ ID NO: 7217 - DNA, 201 bp, Homo sapiens
acactatgttgcctccactgagccacagttgaacgatctcaagaagctcgttgattccctgaagaccaagcagaacatgccacccaggcagctgctggagratatcaaagtcgtcttgtgcagaagtgaagagtttcagtttctcaacccaacccctgttcctctggaactggagaaaaaactcagtgaagcaaaatcaag

SEQ ID NO: 7218 - DNA, 201 bp, Homo sapiens; identical to SEQ ID NO: 7044

SEQ ID NO: 7219 - DNA, 201 bp, Homo sapiens; identical to SEQ ID NO: 7052

SEQ ID NO: 7220 - DNA, 201 bp, Homo sapiens; identical to SEQ ID NO: 7084

SEQ ID NO: 7221 - DNA, 201 bp, Homo sapiens; identical to SEQ ID NO: 7085

SEQ ID NO: 7222 - DNA, 201 bp, Homo sapiens; identical to SEQ ID NO: 7091

SEQ ID NO: 7223 - DNA, 201 bp, Homo sapiens
agcgagctctcaggatacgaagacatttgacgttgcgctgtccgaggagctccatgcggcactgagtgagtggctgacagcgatccgggcttggttttgtraggttccttcaagctaagccagctcagagaacacggggagcggtggtgctacacggacttcggagcatagagtggcgctgagtgagtggctgagaccgac

SEQ ID NO: 7224 - DNA, 116 bp, Homo sapiens
aaaaaaaaaaaaaaaycttgaaacagccctgttgttctgtcatggccagtgggcagtttgtgaacaaactgcaagaggaagtgatctgccccatctgcctggacattctgcagaaa

SEQ ID NO: 7225 - DNA, 201 bp, Homo sapiens; identical to SEQ ID NO: 7046

SEQ ID NO: 7226 - DNA, 201 bp, Homo sapiens
catttgacgttgcgctgtccgaggagctccatgcggcactgagtgagtggctgacagcgatccgggcttggttttgtgaggttccttcaagctaagccagytcagagaacacggggagcggtggtgctacacggacttcggagcatagagtggcgctgagtgagtggctgagaccgaccacggttcttgacttagtggaat

SEQ ID NO: 7227 - DNA, 201 bp, Homo sapiens
cctgttgttctgtcatggccagtgggcagtttgtgaacaaactgcaagaggaagtgatctgccccatctgcctggacattctgcagaaacctgtcaccatygactgtgggcacaatttctgcctcaaatgcatcactcagattggggaaacatcatgtggatttttcaaatgtcccctctgcaaaacttccgtaagaagag

SEQ ID NO: 7228 - DNA, 201 bp, Homo sapiens; identical to SEQ ID NO: 7066

SEQ ID NO: 7229 - DNA, 201 bp, Homo sapiens
ggatcctcacagaatttgaactcctgcatcaagtcctagaggaggagaagaatttcctgctatcacggatttactggctgggtcatgagggaacggaagcrgggaaacactatgttgcctccactgagccacagttgaacgatctcaagaagctcgttgattccctgaagaccaagcagaacatgccacccaggcagctgc

SEQ ID NO: 7230 - DNA, 201 bp, Homo sapiens
  misc_feature (1)...(201): n = A,T,C or G, or insertion/deletion polymorphism (see Tables 1-2)
cctgctatcacggatttactggctgggtcatgagggaacggaagcggggaaacactatgttgcctccactgagccacagttgaacgatctcaagaagctcnttgattccctgaagaccaagcagaacatgccacccaggcagctgctggaggatatcaaagtcgtcttgtgcagaagtgaagagtttcagtttctcaaccc

SEQ ID NO: 7231 - DNA, 201 bp, Homo sapiens
actcgctgttgcggaatctggtggagaaaatccaagctctacaagcctctgaggtgcagtccaaaaggaaagaggctacatgcccgaggcaccaggagatrttccactatttctgcgaggatgatgggaagttcctctgttttgtgtgtcgtgaatccaaggaccacaaatcccataatgtcagcttgatcgaagaagctg

SEQ ID NO: 7232 - DNA, 201 bp, Homo sapiens
ctcttatgatgagatttctggtcaaggagcgagctctcaggatacgaagacatttgacgttgcgctgtccgaggagctccatgcggcactgagtgagtggytgacagcgatccgggcttggttttgtgaggttccttcaagctaagccagctcagagaacacggggagcggtggtgctacacggacttcggagcatagagt

SEQ ID NO: 7233 - DNA, 201 bp, Homo sapiens; identical to SEQ ID NO: 7068

SEQ ID NO: 7234 - DNA, 201 bp, Homo sapiens; identical to SEQ ID NO: 7082

SEQ ID NO: 7235 - DNA, 201 bp, Homo sapiens
cttgtgcagaagtgaagagtttcagtttctcaacccaacccctgttcctctggaactggagaaaaaactcagtgaagcaaaatcaagacacgactccatcrcagggagcctgaaaaaattcaaagaccaactccaggctgataggaaaaaagatgaaaacagattcttcaaaagcatgaataaaaatgacatgaagagctg

SEQ ID NO: 7236 - DNA, 201 bp, Homo sapiens
atgcatcactcagattggggaaacatcatgtggatttttcaaatgtcccctctgcaaaacttccgtaagaagagacgcaatcaggttcaactcgctgttgyggaatctggtggagaaaatccaagctctacaagcctctgaggtgcagtccaaaaggaaagaggctacatgcccgaggcaccaggagatgttccactattt

SEQ ID NO: 7237 - DNA, 201 bp, Homo sapiens
tggtggagaaaatccaagctctacaagcctctgaggtgcagtccaaaaggaaagaggctacatgcccgaggcaccaggagatgttccactatttctgcgargatgatgggaagttcctctgttttgtgtgtcgtgaatccaaggaccacaaatcccataatgtcagcttgatcgaagaagctgcccagaattatcaggggc

SEQ ID NO: 7238 - DNA, 201 bp, Homo sapiens
tgaggtgcagtccaaaaggaaagaggctacatgcccgaggcaccaggagatgttccactatttctgcgaggatgatgggaagttcctctgttttgtgtgtygtgaatccaaggaccacaaatcccataatgtcagcttgatcgaagaagctgcccagaattatcaggggcagattcaagagcagatccaagtcttgcagca

SEQ ID NO: 7239 - DNA, 201 bp, Homo sapiens
gtgagcaggagggtggcagagctgggacaaagctgcctttgccgctgggctttccgggactgtggagggagcacaggcggggaagctccacttcagacagsgcttggtggggcaggacatggctcccattttgaagggaggtctccatgtggtccgagtgaggtgagacggccctcgtcctggtgttcctgatcatcttga

SEQ ID NO: 7240 - DNA, 201 bp, Homo sapiens
tccttcttcatcacgctgcccctcagcctcagccccatcgtgatcatctccgtggtctcctgtgtggtgcacacgttggtcctgggggtcaccgtggcccmgcagcagcaggaggagctcaaggggatgcagctgctgcgggagatcctggccaacgtcttcctctacctgtgcgccatcgctgtgggcatcatgtcctac

SEQ ID NO: 7241 - DNA, 201 bp, Homo sapiens
tcaacgagctctttgcccgctttgacaagctggcagctaaataccaccagctgcggattaagatcctgggcgactgctactactgcatctgcggcttgccygactaccgggaggaccacgccgtctgctccatcctcatggggctggccatggtggaggccatctcgtatgtgcgggagaagaccaagactggggtggaca

SEQ ID NO: 7242 - DNA, 201 bp, Homo sapiens
gcgccacgagaccctgctggtgctggtggtctttgcagccctctttgactgctacgtggtggtcatgtgtgctgtggtcttctccagcgacaagctggctyccctcgccgtggctggaattggactggtgttggacatcatcctcttcgtgctctgcaaaaaggggctgctcccggaccgggtcacccgcagagtgctgcc

SEQ ID NO: 7243 - DNA, 201 bp, Homo sapiens
gattgaagtgcacactcatggactttaggtttagaaacctcctcagccttcatttgttcgtggatgtgtgagctctgagggtggccctgctattcctctgygtgcctgtagtgtccccagcataggggtcttaggcatagggctgaacagtccttccagagccctcgttccaatccctgccgtccttgcccctgaggggcc

SEQ ID NO: 7244 - DNA, 201 bp, Homo sapiens
ctggattgaagtgcacactcatggactttaggtttagaaacctcctcagccttcatttgttcgtggatgtgtgagctctgagggtggccctgctattcctstgtgtgcctgtagtgtccccagcataggggtcttaggcatagggctgaacagtccttccagagccctcgttccaatccctgccgtccttgcccctgaggg

SEQ ID NO: 7245 - DNA, 201 bp, Homo sapiens
tcgccgtggctggaattggactggtgttggacatcatcctcttcgtgctctgcaaaaaggggctgctcccggaccgggtcacccgcagagtgctgccctaygtgctgtggctgctcataaccgcccagatcttctcctacctgggcctgaacttcgcgcgtgcccacgcggctagtgacacggtgggctggcaggtcttct

SEQ ID NO: 7246 - DNA, 201 bp, Homo sapiens
agccagaaggaccagcagcagttcaacaccatgtacatgtaccgtcacgagaacgtcagcatcctctttgccgacatcgtgggctttacccagctgtcttytgcctgcagtgcccaggagcttgtgaagctgctcaacgagctctttgcccgctttgacaagctggcagctaaataccaccagctgcggattaagatcctg

SEQ ID NO: 7247 - DNA, 201 bp, Homo sapiens
  misc_feature (1)...(201): n = A,T,C or G, or insertion/deletion polymorphism (see Tables 1-2)
tcatgtttgcctccctgcccaactttgctgacttctacacagaggagagcatcaacaatggtggtattgagtgtctgcgtttcctcaatgaaatcatctcngattttgactctctcctggacaatcccaagttccgggtgatcaccaagatcaaaaccattggcagcacgtatatggcggcttcaggagtcacccccgatg

SEQ ID NO: 7248 - DNA, 201 bp, Homo sapiens
ctaaataccaccagctgcggattaagatcctgggcgactgctactactgcatctgcggcttgcccgactaccgggaggaccacgccgtctgctccatcctsatggggctggccatggtggaggccatctcgtatgtgcgggagaagaccaagactggggtggacatgcgtgtgggggtgcacacgggcaccgtgctggggg

SEQ ID NO: 7249 - DNA, 201 bp, Homo sapiens
ctcataaccgcccagatcttctcctacctgggcctgaacttcgcgcgtgcccacgcggctagtgacacggtgggctggcaggtcttctttgtcttctcctycttcatcacgctgcccctcagcctcagccccatcgtgatcatctccgtggtctcctgtgtggtgcacacgttggtcctgggggtcaccgtggcccagcag

SEQ ID NO: 7250 - DNA, 201 bp, Homo sapiens
  misc_feature (1)...(201): n = A,T,C or G, or insertion/deletion polymorphism (see Tables 1-2)
ccatgctcgccatcttcatcctggtgatggcaaatgtcgtggacatgctcagctgtctccagtactacacgggacccagcaatgcaacggcagggatgganacggagggcagctgcctggagaaccccaagtattacaactatgtggccgtgctgtccctcatcgccaccatcatgctggtgcaggtcagccacatggtga

SEQ ID NO: 7251 - DNA, 201 bp, Homo sapiens; identical to SEQ ID NO: 7239

SEQ ID NO: 7252 - DNA, 201 bp, Homo sapiens; identical to SEQ ID NO: 7240

SEQ ID NO: 7253 - DNA, 201 bp, Homo sapiens; identical to SEQ ID NO: 7241

SEQ ID NO: 7254 - DNA, 201 bp, Homo sapiens; identical to SEQ ID NO: 7242

SEQ ID NO: 7255 - DNA, 201 bp, Homo sapiens; identical to SEQ ID NO: 7243

SEQ ID NO: 7256 - DNA, 201 bp, Homo sapiens; identical to SEQ ID NO: 7244

SEQ ID NO: 7257 - DNA, 201 bp, Homo sapiens; identical to SEQ ID NO: 7245

SEQ ID NO: 7258 - DNA, 201 bp, Homo sapiens; identical to SEQ ID NO: 7246

SEQ ID NO: 7259 - DNA, 201 bp, Homo sapiens; identical to SEQ ID NO: 7247
  misc_feature (1)...(201): n = A,T,C or G, or insertion/deletion polymorphism (see Tables 1-2)

SEQ ID NO: 7260 - DNA, 201 bp, Homo sapiens; identical to SEQ ID NO: 7248

SEQ ID NO: 7261 - DNA, 201 bp, Homo sapiens; identical to SEQ ID NO: 7249

SEQ ID NO: 7262 - DNA, 201 bp, Homo sapiens; identical to SEQ ID NO: 7250
  misc_feature (1)...(201): n = A,T,C or G, or insertion/deletion polymorphism (see Tables 1-2)

SEQ ID NO: 7263 - DNA, 201 bp, Homo sapiens
tcaacaatggtggtattgagtgtctgcgtttcctcaatgaaatcatctcggattttgactctgtgagtgcccatcccaccctgcactctggccatgaagcyggcccattccacatcacatcctacaataggctgcagaggccagagaaactggcttcattttcccagataagccccttccgcaatacatggacttctgcag

SEQ ID NO: 7264 - DNA, 201 bp, Homo sapiens; identical to SEQ ID NO: 7239

SEQ ID NO: 7265 - DNA, 201 bp, Homo sapiens; identical to SEQ ID NO: 7240

SEQ ID NO: 7266 - DNA, 201 bp, Homo sapiens; identical to SEQ ID NO: 7241

SEQ ID NO: 7267 - DNA, 201 bp, Homo sapiens; identical to SEQ ID NO: 7242

SEQ ID NO: 7268 - DNA, 201 bp, Homo sapiens; identical to SEQ ID NO: 7243

SEQ ID NO: 7269 - DNA, 201 bp, Homo sapiens; identical to SEQ ID NO: 7244

SEQ ID NO: 7270 - DNA, 201 bp, Homo sapiens; identical to SEQ ID NO: 7246

SEQ ID NO: 7271 - DNA, 201 bp, Homo sapiens; identical to SEQ ID NO: 7245

SEQ ID NO: 7272 - DNA, 201 bp, Homo sapiens
  misc_feature (1)...(201): n = A,T,C or G, or insertion/deletion polymorphism (see Tables 1-2)
tcatgtttgcctccctgcccaactttgctgacttctacacagaggagagcatcaacaatggtggtattgagtgtctgcgtttcctcaatgaaatcatctcngattttgactctgtgagtgcccatcccaccctgcactctggccatgaagccggcccattccacatcacatcctacaataggctgcagaggccagagaaac

SEQ ID NO: 7273 - DNA, 201 bp, Homo sapiens; identical to SEQ ID NO: 7248

SEQ ID NO: 7274 - DNA, 201 bp, Homo sapiens; identical to SEQ ID NO: 7249

SEQ ID NO: 7275 - DNA, 201 bp, Homo sapiens; identical to SEQ ID NO: 7250
  misc_feature (1)...(201): n = A,T,C or G, or insertion/deletion polymorphism (see Tables 1-2)

SEQ ID NO: 7276 - DNA, 201 bp, Homo sapiens; identical to SEQ ID NO: 7239

SEQ ID NO: 7277 - DNA, 201 bp, Homo sapiens; identical to SEQ ID NO: 7240

SEQ ID NO: 7278 - DNA, 201 bp, Homo sapiens; identical to SEQ ID NO: 7241

SEQ ID NO: 7279 - DNA, 201 bp, Homo sapiens; identical to SEQ ID NO: 7242

SEQ ID NO: 7280 - DNA, 201 bp, Homo sapiens; identical to SEQ ID NO: 7243

SEQ ID NO: 7281 - DNA, 201 bp, Homo sapiens; identical to SEQ ID NO: 7244

SEQ ID NO: 7282 - DNA, 201 bp, Homo sapiens; identical to SEQ ID NO: 7245

SEQ ID NO: 7283 - DNA, 201 bp, Homo sapiens; identical to SEQ ID NO: 7246

SEQ ID NO: 7284 - DNA, 201 bp, Homo sapiens; identical to SEQ ID NO: 7247
  misc_feature (1)...(201): n = A,T,C or G, or insertion/deletion polymorphism (see Tables 1-2)

SEQ ID NO: 7285 - DNA, 201 bp, Homo sapiens; identical to SEQ ID NO: 7248

SEQ ID NO: 7286 - DNA, 201 bp, Homo sapiens; identical to SEQ ID NO: 7249

SEQ ID NO: 7287 - DNA, 201 bp, Homo sapiens; identical to SEQ ID NO: 7250
  misc_feature (1)...(201): n = A,T,C or G, or insertion/deletion polymorphism (see Tables 1-2)

SEQ ID NO: 7288 - DNA, 201 bp, Homo sapiens
gagctggtttcaaagttgcaatgggagcttttgataaaaccagacctgtagtagctgctggtgctgttggattagcacaaagagctttggatgaagctacyaagtatgccctggaaaggaaaactttcggaaagctacttgtagagcaccaagcaatatcatttatgctggctgaaatggcaatgaaagttgaactagcta

SEQ ID NO: 7289 - DNA, 201 bp, Homo sapiens
gtacttcacaaattcaaagacttattgtagcccgtgaacacattgacaagtacaaaaattaaaaaaattactgtagaaatattgaataactagaacacaarccactgtttcagctccagaaaaaagaaagggctttaacgttttttccagtgaaaacaaatcctcttatattaaatctaagcaactgcttattatagtagt

SEQ ID NO: 7290 - DNA, 201 bp, Homo sapiens
cttctattgcaaaggcatttgctggagatattgcaaatcagttagctactgatgctgtgcagatacttggaggcaatggatttaatacagaatatcctgtrgaaaaactaatgagggatgccaaaatctatcagatttatgaaggtacttcacaaattcaaagacttattgtagcccgtgaacacattgacaagtacaaaa

SEQ ID NO: 7291 - DNA, 201 bp, Homo sapiens; identical to SEQ ID NO: 7288

SEQ ID NO: 7292 - DNA, 201 bp, Homo sapiens
aaccgcctcttcccgccccgccccatcccgcccacgggctccagtgggcgggaccagaggagtcccgcgttcggggagtatgtcaaggccgtgacccgtgyattattgtccgagtggccggaacgggagccaacatggcagcggggttcgggcgatgctgcagggtcctgagaagtatttctcgttttcattggagatcac

SEQ ID NO: 7293 - DNA, 201 bp, Homo sapiens
cctctaacccaggttcccgtcctgcaccgcgccgcaagtccccccaccgttcagcgcaaccgggccctcccagccccgccgccgtccccctcccccgcccyggctctctttccgcgctgcggtcagcctcggcgtcccacagagagggccagaggtggaaacgcagaaaaccaaaccaggactatcagagattgcccggag

SEQ ID NO: 7294 - DNA, 201 bp, Homo sapiens
ctcactggaagagaaagtgactccaggtagaattcctcagggagacattcacttccatcattcgctgaaccaggagctttggacagcctcggattgcaccsgcatatccaaggacaccacatcagcggacaagtcataaacagccttgggaatacgcggaaaggtcaaatttacctaaacaattaaattctcttttaaatt

SEQ ID NO: 7295 - DNA, 201 bp, Homo sapiens
gacaaactcagctctttatcccttttccgaattttcctggtactttcactttgaatacagcgcttaattaacattctgccttgtacctaggactaacacastataaattcccagaagacaaagtaggggaatacaataacaggatatagaattttaacagctaaattagatgaatttatgggtgacctttattgggcaaaa

SEQ ID NO: 7296 - DNA, 201 bp, Homo sapiens
ttacttaccaccaccactttgaaggctttcttgcctataccaggacaaactcagctctttatcccttttccgaattttcctggtactttcactttgaataragcgcttaattaacattctgccttgtacctaggactaacacagtataaattcccagaagacaaagtaggggaatacaataacaggatatagaattttaac

SEQ ID NO: 7297 - DNA, 201 bp, Homo sapiens; identical to SEQ ID NO: 7289

SEQ ID NO: 7298 - DNA, 201 bp, Homo sapiens
tatttcacttaccttatttaaaataaatcaataaagcttgccttaaattatttttatatgactgttggtctctaggtagcctttggtctattgtacacaayctcatttcatatgtttgcattttggcaaagaacttaataaaattgttcagtgcttattatcatatctttctgtattttttccaggaaatttcattacttc

SEQ ID NO: 7299 - DNA, 127 bp, Homo sapiens
atagtgtatatttcttgtatttactatgatgaaaaaaggtcgttttaattttgaattgaataaagttacctgttcattttttattagatattttaaagacytcagaaaatataaatatgaaataatt

SEQ ID NO: 7300 - DNA, 201 bp, Homo sapiens
tgtgtttaaaatgttcagaataagaaattggaacaaaggagacatgaatagacaattcctaatcatctttaagagtccgctttgtgttttacttaccaccwccactttgaaggctttcttgcctataccaggacaaactcagctctttatcccttttccgaattttcctggtactttcactttgaatacagcgcttaatta

SEQ ID NO: 7301 - DNA, 201 bp, Homo sapiens; identical to SEQ ID NO: 7290

SEQ ID NO: 7302 - DNA, 201 bp, Homo sapiens
gcatttgtgaaactttctgtttggcacagaaacagtcaaaattttgacattcatattctcctattttacagctacaagaactttcttgaaaatcttatttwattctgagcccatatttcacttaccttatttaaaataaatcaataaagcttgccttaaattatttttatatgactgttggtctctaggtagcctttggtc

SEQ ID NO: 7303 - DNA, 201 bp, Homo sapiens
tgaatctcttaaaatcagtgcacaacggagcaccagcaccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggacca

SEQ ID NO: 7304 - DNA, 201 bp, Homo sapiens
acggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccgt

SEQ ID NO: 7305 - DNA, 201 bp, Homo sapiens
gacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtcccg

SEQ ID NO: 7306 - DNA, 201 bp, Homo sapiens
agagaggagtaaagggctctcggggattcccaggagagaagggcgaagtaggagaaattggactggatggtctggatggtgaagatggagacaaaggattrcctggttcttctggagagaaagggaatcctggaagaaggggtgataaaggacctcgaggagagaaaggagaaagaggagatgttgggattcgaggggacc

SEQ ID NO: 7307 - DNA, 201 bp, Homo sapiens
agacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatggttaagatgtccc

SEQ ID NO: 7308 - DNA, 201 bp, Homo sapiens
ccgcattgaagagggcgtcccgcagttcctggtcctcatctcgtctggaaagtctgacgatgaggtggacgacccggcggtggagctcaagcagtttggcrtggcccctttcacgatcgccaggaacgcagaccaggaggagctggtgaagatctcgctgagccccgaatatgtgttctcggtgagcaccttccgggagct

SEQ ID NO: 7309 - DNA, 201 bp, Homo sapiens
gaagcggaggtgccgctggtgctcctggagaacgaggcagaaccggtccactgggaagaaagggtgagcccggagagccaggaccaaaaggaggaatcggsaaccggggccctcgtggggagacgggagatgacgggagagacggagttggcagtgaaggacgcagaggcaaaaaaggagaaagaggattccctggatacc

SEQ ID NO: 7310 - DNA, 201 bp, Homo sapiens
tgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcgtggcccctttcacga

SEQ ID NO: 7311 - DNA, 201 bp, Homo sapiens
cagctgagttccgagccgccccattgcaaggcatgctgcctggcttgctggcacctctcaggaccctctctggaacccctgaagttcactcaaacaaaagrgatatcatctttcttttggatggatcagccaacgttggaaaaaccaatttcccttatgtgcgcgactttgtaatgaacctagttaacagccttgatattg

SEQ ID NO: 7312 - DNA, 201 bp, Homo sapiens
ctgaggaacatcctggtcagctctgcgggaagcaggataacagaaggtgtgccccagctgctgatcgtcctcacggccgacaggtctggggatgatgtgcrgaacccctccgtggtcgtgaagaggggtggggctgtgcccattggcattggcatcgggaacgctgacatcacagagatgcagaccatctccttcatcccg

SEQ ID NO: 7313 - DNA, 201 bp, Homo sapiens
ccccgctgctgctgctgcaaaaccagtggcgaccaagcctgaggtccctaggccacaggcagccaaaccagctgccaccaagccagccaccactaagcccrtggttaagatgtcccgtgaagtccaggtgtttgagataacagagaacagcgccaaactccactgggagaggcctgagccccccggtccttatttttatga

SEQ ID NO: 7314 - DNA, 201 bp, Homo sapiens
ggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccctctactttccacagggcccctg

SEQ ID NO: 7315 - DNA, 201 bp, Homo sapiens
agaggcctgagccccccggtccttatttttatgacctcaccgtcacctcagcccatgatcagtccctggttctgaagcagaacctcacggtcacggaccgygtcattggaggcctgctcgctgggcagacataccatgtggctgtggtctgctacctgaggtctcaggtcagagccacctaccacggaagtttcagtacaa

SEQ ID NO: 7316 - DNA, 201 bp, Homo sapiens
ctggaagagatcgctttcgactcctccctggtgttcatcccagctgagttccgagccgccccattgcaaggcatgctgcctggcttgctggcacctctcasgaccctctctggaacccctgaagttcactcaaacaaaagggatatcatctttcttttggatggatcagccaacgttggaaaaaccaatttcccttatgtg

SEQ ID NO: 7317 - DNA, 201 bp, Homo sapiens
agatgaaatcagccagcctgcccaggagctgaagagaagcagcataatggcctttgccattgggaacaagggtgccgatcaggctgagctggaagagatckctttcgactcctccctggtgttcatcccagctgagttccgagccgccccattgcaaggcatgctgcctggcttgctggcacctctcaggaccctctctgg

SEQ ID NO: 7318 - DNA, 201 bp, Homo sapiens
tgctgatcacaggtggtaagtccctagatgaaatcagccagcctgcccaggagctgaagagaagcagcataatggcctttgccattgggaacaagggtgcygatcaggctgagctggaagagatcgctttcgactcctccctggtgttcatcccagctgagttccgagccgccccattgcaaggcatgctgcctggcttgc

SEQ ID NO: 7319 - DNA, 201 bp, Homo sapiens
actgggagaggcctgagccccccggtccttatttttatgacctcaccgtcacctcagcccatgatcagtccctggttctgaagcagaacctcacggtcacrgaccgcgtcattggaggcctgctcgctgggcagacataccatgtggctgtggtctgctacctgaggtctcaggtcagagccacctaccacggaagtttca

SEQ ID NO: 7320 - DNA, 201 bp, Homo sapiens
ggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggt

SEQ ID NO: 7321 - DNA, 201 bp, Homo sapiens
cagaacctcacggtcacggaccgcgtcattggaggcctgctcgctgggcagacataccatgtggctgtggtctgctacctgaggtctcaggtcagagccayctaccacggaagtttcagtacaaagaaatctcagcccccacctccacagccagcaaggtcagcttctagttcaaccatcaatctaatggtgagcacagaa

SEQ ID NO: 7322 - DNA, 201 bp, Homo sapiens
cagccatctgtgaagccagccgctgcaaagccggcccctgcgaaacctgtggctgccaagcctgtggccacaaagacggccactgttagacccccagtggyggtgaagccagcaacggcagcgaagcctgtagcagcaaagccagcagctgtaagaccccccgctgctgctgctgcaaaaccagtggcgaccaagcctgag

SEQ ID NO: 7323 - DNA, 201 bp, Homo sapiens
ttaagcgtgtgaggaacggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcagatcaataacacagcagtggggcatgcgc

SEQ ID NO: 7324 - DNA, 201 bp, Homo sapiens
agtggacaagtccaccgagctcaacgaggagcctttgatgcgcttcgggaggctgttgccatccttcgtcagcagtgaaaatgctttttacttgtccccasatatcaggaaacagtgtgattggttccaaggggaccaacccacaaagaaccttgtgaagtttggtcacaaacaagtaaatgttccgaataacgttacttc

SEQ ID NO: 7325 - DNA, 201 bp, Homo sapiens
acaagattaagaaccttcaggtggctctgacatccaaacagcagagtctggagactgccatgtcgtttgtggccaggaacacatttaagcgtgtgaggaayggattcctaatgaggaaagtggctgttttcttcagcaacacacccacaagagcatccccacagctcagagaggctgtgctcaagctctcagatgcgggga

SEQ ID NO: 7326 - DNA, 201 bp, Homo sapiens
agcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcaacgaggagcctttgatgcgcttcgggaggctgt

SEQ ID NO: 7327 - DNA, 201 bp, Homo sapiens
atgacaggcccctgaggcttaacttgctggacttggattatgaactagcggagcagcttgacaacattgccgagaaagcttgctgtggggttccctgcaartgctctgggcagaggggagaccgcgggcccatcggcagcatcgggccaaagggtattcctggagaagacggctaccgaggctatcctggtgatgagggtg

SEQ ID NO: 7328 - DNA, 201 bp, Homo sapiens
acaccttcgccagtgagccaaacgacgtcttcttcaaattagtggacaagtccaccgagctcaacgaggagcctttgatgcgcttcgggaggctgttgccrtccttcgtcagcagtgaaaatgctttttacttgtccccagatatcaggaaacagtgtgattggttccaaggggaccaacccacaaagaaccttgtgaagt

SEQ ID NO: 7329 - DNA, 201 bp, Homo sapiens
gaggaatcgggaaccggggccctcgtggggagacgggagatgacgggagagacggagttggcagtgaaggacgcagaggcaaaaaaggagaaagaggattycctggatacccaggaccaaagggtaacccaggtgaacctgggctaaatggaacaacaggacccaaaggcatcagaggccgaaggggaaattcgggacctc

SEQ ID NO: 7330 - DNA, 201 bp, Homo sapiens
tcacggtcacggaccgcgtcattggaggcctgctcgctgggcagacataccatgtggctgtggtctgctacctgaggtctcaggtcagagccacctaccayggaagtttcagtacaaagaaatctcagcccccacctccacagccagcaaggtcagcttctagttcaaccatcaatctaatggtgagcacagaaccattgg

SEQ ID NO: 7331 - DNA, 201 bp, Homo sapiens
ggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagatgtcaaaaatggtgcggctgctgatataatatttctagtgga

SEQ ID NO: 7332 - DNA, 201 bp, Homo sapiens
  misc_feature (1)...(201): n = A,T,C or G, or insertion/deletion polymorphism (see Tables 1-2)
gccgctgcaaagccggcccctgcgaaacctgtggctgccaagcctgtggccacaaagacggccactgttagacccccagtggcggtgaagccagcaacggnagcgaagcctgtagcagcaaagccagcagctgtaagaccccccgctgctgctgctgcaaaaccagtggcgaccaagcctgaggtccctaggccacaggca

SEQ ID NO: 7333 - DNA, 201 bp, Homo sapiens
gagcggcagggagcgatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggaca

SEQ ID NO: 7334 - DNA, 201 bp, Homo sapiens
aaacgaaaacaaatttggatcacagaaagaatgtgaaaaggtttgcgctcctgtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttc

SEQ ID NO: 7335 - DNA, 201 bp, Homo sapiens
cagccgctgcaaagccggcccctgcgaaacctgtggctgccaagcctgtggccacaaagacggccactgttagacccccagtggcggtgaagccagcaacrgcagcgaagcctgtagcagcaaagccagcagctgtaagaccccccgctgctgctgctgcaaaaccagtggcgaccaagcctgaggtccctaggccacagg

SEQ ID NO: 7336 - DNA, 201 bp, Homo sapiens
cctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtc

SEQ ID NO: 7337 - DNA, 201 bp, Homo sapiens
tcccgcagttcctggtcctcatctcgtctggaaagtctgacgatgaggtggacgacccggcggtggagctcaagcagtttggcgtggcccctttcacgatygccaggaacgcagaccaggaggagctggtgaagatctcgctgagccccgaatatgtgttctcggtgagcaccttccgggagctgcccagcctggagcaga

SEQ ID NO: 7338 - DNA, 201 bp, Homo sapiens
tggctctcactgaaacagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctgtgctcgccaaacccggag

SEQ ID NO: 7339 - DNA, 201 bp, Homo sapiens
acaccggggccgccctggagtttgtcctgaggaacatcctggtcagctctgcgggaagcaggataacagaaggtgtgccccagctgctgatcgtcctcacrgccgacaggtctggggatgatgtgcggaacccctccgtggtcgtgaagaggggtggggctgtgcccattggcattggcatcgggaacgctgacatcacag

SEQ ID NO: 7340 - DNA, 201 bp, Homo sapiens
tgccaccaagccagccaccactaagcccatggttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacggaccgcgtcat

SEQ ID NO: 7341 - DNA, 201 bp, Homo sapiens
agatcgtgctgtctccagcgtttatcctggctgcagagtcgcttcccaagattggagatcttcatccacagatagtgaatctcttaaaatcagtgcacaayggagcaccagcaccagtttcaggtgaaaaggacgtggtgtttctgcttgatggctctgagggcgtcaggagcggcttccctctgttgaaagagtttgtcc

SEQ ID NO: 7342 - DNA, 201 bp, Homo sapiens
ttggatggatcagccaacgttggaaaaaccaatttcccttatgtgcgcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcag

SEQ ID NO: 7343 - DNA, 201 bp, Homo sapiens
aaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggag

SEQ ID NO: 7344 - DNA, 201 bp, Homo sapiens
gatggagtacctggaggacctggagaaactgggaagaatggtggctttggccgaaggggaccccccggagctaagggcaacaagggcggtcctggccagcygggctttgagggagagcaggggaccagaggtgcacagggcccagctggtcctgctggtcctccagggctgataggagaacaaggcatttctggacctcgg

SEQ ID NO: 7345 - DNA, 201 bp, Homo sapiens
attcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaagtcattgaagtcaacaa

SEQ ID NO: 7346 - DNA, 201 bp, Homo sapiens
gagatgacgggagagacggagttggcagtgaaggacgcagaggcaaaaaaggagaaagaggattccctggatacccaggaccaaagggtaacccaggtgarcctgggctaaatggaacaacaggacccaaaggcatcagaggccgaaggggaaattcgggacctccagggatagttggacagaagggagaccctggctacc

SEQ ID NO: 7347 - DNA, 201 bp, Homo sapiens
ttctttttctgaagcctctaacaaatgatctagttcagaaggaagcaaaatcccttaatctatgtgcaccgttgggaccaatgccttaattaaagaatttwaaaaagttgtaatagagaatatttttggcattcctctaatgttgtgtgttttttttttgtgtgtgctggagggaggggatttaattttaattttaaaatg

SEQ ID NO: 7348 - DNA, 201 bp, Homo sapiens
ctgggcattggcaggaaggtgaacatcaaggaggtatacaccttcgccagtgagccaaacgacgtcttcttcaaattagtggacaagtccaccgagctcamcgaggagcctttgatgcgcttcgggaggctgttgccatccttcgtcagcagtgaaaatgctttttacttgtccccagatatcaggaaacagtgtgattgg

SEQ ID NO: 7349 - DNA, 201 bp, Homo sapiens
ttctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatt

SEQ ID NO: 7350 - DNA, 201 bp, Homo sapiens
ctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccgg

SEQ ID NO: 7351 - DNA, 201 bp, Homo sapiens
accctctctggaacccctgaagttcactcaaacaaaagggatatcatctttcttttggatggatcagccaacgttggaaaaaccaatttcccttatgtgcrcgactttgtaatgaacctagttaacagccttgatattggaaatgacaatattcgtgttggtttagtgcaatttagtgacactcctgtaacggagttctct

SEQ ID NO: 7352 - DNA, 201 bp, Homo sapiens
ctatgtgcaccgttgggaccaatgccttaattaaagaatttaaaaaagttgtaatagagaatatttttggcattcctctaatgttgtgtgttttttttttktgtgtgctggagggaggggatttaattttaattttaaaatgtttaggaaatttatacaaagaaactttttaataaagtatattgaaagtttcctgggtgt

SEQ ID NO: 7353 - DNA, 201 bp, Homo sapiens
tcctcacgtgtcatgtttgcttggacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcatacctggtcagac

SEQ ID NO: 7354 - DNA, 201 bp, Homo sapiens
tcggcagcatcgggccaaagggtattcctggagaagacggctaccgaggctatcctggtgatgagggtggacccggtgagcgtggtccgcctggtgtgaayggcactcaaggtttccagggctgcccgggccagagaggagtaaagggctctcggggattcccaggagagaagggcgaagtaggagaaattggactggatg

SEQ ID NO: 7355 - DNA, 201 bp, Homo sapiens
ggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctgg

SEQ ID NO: 7356 - DNA, 201 bp, Homo sapiens
tggacaagattaagaaccttcaggtggctctgacatccaaacagcagagtctggagactgccatgtcgtttgtggccaggaacacatttaagcgtgtgagraacggattcctaatgaggaaagtggctgttttcttcagcaacacacccacaagagcatccccacagctcagagaggctgtgctcaagctctcagatgcgg

SEQ ID NO: 7357 - DNA, 201 bp, Homo sapiens
acacagtttatgaagatggcgactccatccaagtggggcttgtccagtacaactctgaccccactgacgaattcttcctgaaggacttctctaccaagagrcagattattgacgccatcaacaaagtggtctacaaagggggaagacacgccaacactaaggtgggccttgagcacctgcgggtaaaccactttgtgcctg

SEQ ID NO: 7358 - DNA, 201 bp, Homo sapiens
cagtttccaggaagtgcttcgttttgtgtctgaaatagtggacacagtttatgaagatggcgactccatccaagtggggcttgtccagtacaactctgacyccactgacgaattcttcctgaaggacttctctaccaagaggcagattattgacgccatcaacaaagtggtctacaaagggggaagacacgccaacactaa

SEQ ID NO: 7359 - DNA, 201 bp, Homo sapiens
acaaagcctgtgactattataaatcagccatctgtgaagccagccgctgcaaagccggcccctgcgaaacctgtggctgccaagcctgtggccacaaagayggccactgttagacccccagtggcggtgaagccagcaacggcagcgaagcctgtagcagcaaagccagcagctgtaagaccccccgctgctgctgctgca

SEQ ID NO: 7360 - DNA, 201 bp, Homo sapiens
tgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctgg

SEQ ID NO: 7361 - DNA, 201 bp, Homo sapiens; identical to SEQ ID NO: 7303

SEQ ID NO: 7362 - DNA, 201 bp, Homo sapiens; identical to SEQ ID NO: 7304

SEQ ID NO: 7363 - DNA, 201 bp, Homo sapiens; identical to SEQ ID NO: 7305

SEQ ID NO: 7364 - DNA, 201 bp, Homo sapiens; identical to SEQ ID NO: 7306

SEQ ID NO: 7365 - DNA, 201 bp, Homo sapiens; identical to SEQ ID NO: 7307

SEQ ID NO: 7366 - DNA, 201 bp, Homo sapiens; identical to SEQ ID NO: 7308

SEQ ID NO: 7367 - DNA, 201 bp, Homo sapiens; identical to SEQ ID NO: 7309

SEQ ID NO: 7368 - DNA, 201 bp, Homo sapiens; identical to SEQ ID NO: 7310

SEQ ID NO: 7369 - DNA, 201 bp, Homo sapiens; identical to SEQ ID NO: 7311

SEQ ID NO: 7370 - DNA, 201 bp, Homo sapiens; identical to SEQ ID NO: 7312

SEQ ID NO: 7371 - DNA, 201 bp, Homo sapiens; identical to SEQ ID NO: 7313

SEQ ID NO: 7372 - DNA, 201 bp, Homo sapiens; identical to SEQ ID NO: 7314

SEQ ID NO: 7373 - DNA, 201 bp, Homo sapiens; identical to SEQ ID NO: 7315

SEQ ID NO: 7374 - DNA, 201 bp, Homo sapiens; identical to SEQ ID NO: 7316

SEQ ID NO: 7375 - DNA, 201 bp, Homo sapiens; identical to SEQ ID NO: 7317

SEQ ID NO: 7376 - DNA, 201 bp, Homo sapiens; identical to SEQ ID NO: 7318

SEQ ID NO: 7377 - DNA, 201 bp, Homo sapiens; identical to SEQ ID NO: 7319

SEQ ID NO: 7378 - DNA, 201 bp, Homo sapiens; identical to SEQ ID NO: 7320

SEQ ID NO: 7379 - DNA, 201 bp, Homo sapiens; identical to SEQ ID NO: 7321

SEQ ID NO: 7380 - DNA, 201 bp, Homo sapiens; identical to SEQ ID NO: 7322

SEQ ID NO: 7381 - DNA, 201 bp, Homo sapiens; identical to SEQ ID NO: 7323

SEQ ID NO: 7382 - DNA, 201 bp, Homo sapiens; identical to SEQ ID NO: 7324

SEQ ID NO: 7383 - DNA, 201 bp, Homo sapiens; identical to SEQ ID NO: 7325

SEQ ID NO: 7384 - DNA, 201 bp, Homo sapiens; identical to SEQ ID NO: 7326

SEQ ID NO: 7385 - DNA, 201 bp, Homo sapiens; identical to SEQ ID NO: 7327

SEQ ID NO: 7386 - DNA, 201 bp, Homo sapiens; identical to SEQ ID NO: 7328

SEQ ID NO: 7387 - DNA, 201 bp, Homo sapiens; identical to SEQ ID NO: 7329

SEQ ID NO: 7388 - DNA, 201 bp, Homo sapiens; identical to SEQ ID NO: 7330

SEQ ID NO: 7389 - DNA, 201 bp, Homo sapiens
ggagcccagggacacacgccttcaggtttgctcaggggttcatatttggtgcttagacaaattcaaaatgaggaaacatcggcacttgcccttagtggccrtcttttgcctctttctctcaggctttcctacaactcatgcccagcagcagcaagcagcacaagactctgctgacattattttccttattgatggatcaaa

SEQ ID NO: 7390 - DNA, 201 bp, Homo sapiens; identical to SEQ ID NO: 7332
  misc_feature (1)...(201): n = A,T,C or G, or insertion/deletion polymorphism (see Tables 1-2)

SEQ ID NO: 7391 - DNA, 201 bp, Homo sapiens; identical to SEQ ID NO: 7333

SEQ ID NO: 7392 - DNA, 201 bp, Homo sapiens
tgctgacgcccatcacgaccctgacctcagagcagatccagaagctcttagccagcactcgctatccacctccagcagttgagagtgatgctgcagacatygtctttctgatcgacagctctgagggagttaggccagatggctttgcacatattcgagattttgttagcaggattgttcgaagactcaacatcggcccca

SEQ ID NO: 7393 - DNA, 201 bp, Homo sapiens; identical to SEQ ID NO: 7334

SEQ ID NO: 7394 - DNA, 201 bp, Homo sapiens; identical to SEQ ID NO: 7335

SEQ ID NO: 7395 - DNA, 201 bp, Homo sapiens
cacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatc

SEQ ID NO: 7396 - DNA, 201 bp, Homo sapiens; identical to SEQ ID NO: 7336

SEQ ID NO: 7397 - DNA, 201 bp, Homo sapiens; identical to SEQ ID NO: 7337

SEQ ID NO: 7398 - DNA, 201 bp, Homo sapiens; identical to SEQ ID NO: 7338

SEQ ID NO: 7399 - DNA, 201 bp, Homo sapiens; identical to SEQ ID NO: 7339

SEQ ID NO: 7400 - DNA, 201 bp, Homo sapiens; identical to SEQ ID NO: 7340

SEQ ID NO: 7401 - DNA, 201 bp, Homo sapiens; identical to SEQ ID NO: 7341

SEQ ID NO: 7402 - DNA, 201 bp, Homo sapiens; identical to SEQ ID NO: 7342

SEQ ID NO: 7403 - DNA, 201 bp, Homo sapiens; identical to SEQ ID NO: 7343

SEQ ID NO: 7404 - DNA, 201 bp, Homo sapiens; identical to SEQ ID NO: 7344

SEQ ID NO: 7405 - DNA, 201 bp, Homo sapiens; identical to SEQ ID NO: 7345

SEQ ID NO: 7406 - DNA, 201 bp, Homo sapiens; identical to SEQ ID NO: 7346

SEQ ID NO: 7407 - DNA, 201 bp, Homo sapiens; identical to SEQ ID NO: 7347

SEQ ID NO: 7408 - DNA, 201 bp, Homo sapiens; identical to SEQ ID NO: 7348

SEQ ID NO: 7409 - DNA, 201 bp, Homo sapiens; identical to SEQ ID NO: 7349

SEQ ID NO: 7410 - DNA, 201 bp, Homo sapiens; identical to SEQ ID NO: 7350

SEQ ID NO: 7411 - DNA, 201 bp, Homo sapiens; identical to SEQ ID NO: 7351

SEQ ID NO: 7412 - DNA, 201 bp, Homo sapiens; identical to SEQ ID NO: 7352

SEQ ID NO: 7413 - DNA, 201 bp, Homo sapiens; identical to SEQ ID NO: 7353

SEQ ID NO: 7414 - DNA, 201 bp, Homo sapiens; identical to SEQ ID NO: 7354

SEQ ID NO: 7415 - DNA, 201 bp, Homo sapiens; identical to SEQ ID NO: 7355

SEQ ID NO: 7416 - DNA, 201 bp, Homo sapiens; identical to SEQ ID NO: 7356

SEQ ID NO: 7417 - DNA, 201 bp, Homo sapiens; identical to SEQ ID NO: 7357

SEQ ID NO: 7418 - DNA, 201 bp, Homo sapiens; identical to SEQ ID NO: 7358

SEQ ID NO: 7419 - DNA, 201 bp, Homo sapiens; identical to SEQ ID NO: 7359

SEQ ID NO: 7420 - DNA, 201 bp, Homo sapiens; identical to SEQ ID NO: 7360

SEQ ID NO: 7421 - DNA, 201 bp, Homo sapiens; identical to SEQ ID NO: 7303

SEQ ID NO: 7422 - DNA, 201 bp, Homo sapiens; identical to SEQ ID NO: 7304

SEQ ID NO: 7423 - DNA, 201 bp, Homo sapiens; identical to SEQ ID NO: 7305

SEQ ID NO: 7424 - DNA, 201 bp, Homo sapiens; identical to SEQ ID NO: 7306

SEQ ID NO: 7425 - DNA, 201 bp, Homo sapiens; identical to SEQ ID NO: 7307

SEQ ID NO: 7426 - DNA, 201 bp, Homo sapiens; identical to SEQ ID NO: 7308

SEQ ID NO: 7427 - DNA, 201 bp, Homo sapiens; identical to SEQ ID NO: 7309

SEQ ID NO: 7428 - DNA, 201 bp, Homo sapiens; identical to SEQ ID NO: 7310

SEQ ID NO: 7429 - DNA, 201 bp, Homo sapiens; identical to SEQ ID NO: 7311

SEQ ID NO: 7430 - DNA, 201 bp, Homo sapiens; identical to SEQ ID NO: 7312

SEQ ID NO: 7431 - DNA, 201 bp, Homo sapiens; identical to SEQ ID NO: 7313

SEQ ID NO: 7432 - DNA, 201 bp, Homo sapiens; identical to SEQ ID NO: 7314

SEQ ID NO: 7433 - DNA, 201 bp, Homo sapiens; identical to SEQ ID NO: 7315

SEQ ID NO: 7434 - DNA, 201 bp, Homo sapiens; identical to SEQ ID NO: 7316

SEQ ID NO: 7435 - DNA, 201 bp, Homo sapiens; identical to SEQ ID NO: 7317

SEQ ID NO: 7436 - DNA, 201 bp, Homo sapiens; identical to SEQ ID NO: 7318

SEQ ID NO: 7437 - DNA, 201 bp, Homo sapiens; identical to SEQ ID NO: 7319

SEQ ID NO: 7438 - DNA, 201 bp, Homo sapiens; identical to SEQ ID NO: 7320

SEQ ID NO: 7439 - DNA, 201 bp, Homo sapiens; identical to SEQ ID NO: 7321

SEQ ID NO: 7440 - DNA, 201 bp, Homo sapiens; identical to SEQ ID NO: 7322

SEQ ID NO: 7441 - DNA, 201 bp, Homo sapiens; identical to SEQ ID NO: 7323

SEQ ID NO: 7442 - DNA, 201 bp, Homo sapiens; identical to SEQ ID NO: 7324

SEQ ID NO: 7443 - DNA, 201 bp, Homo sapiens; identical to SEQ ID NO: 7325

SEQ ID NO: 7444 - DNA, 201 bp, Homo sapiens; identical to SEQ ID NO: 7326

SEQ ID NO: 7445 - DNA, 201 bp, Homo sapiens; identical to SEQ ID NO: 7327

SEQ ID NO: 7446 - DNA, 201 bp, Homo sapiens; identical to SEQ ID NO: 7328

SEQ ID NO: 7447 - DNA, 201 bp, Homo sapiens; identical to SEQ ID NO: 7329

SEQ ID NO: 7448 - DNA, 201 bp, Homo sapiens; identical to SEQ ID NO: 7330

SEQ ID NO: 7449 - DNA, 201 bp, Homo sapiens; identical to SEQ ID NO: 7331

SEQ ID NO: 7450 - DNA, 201 bp, Homo sapiens; identical to SEQ ID NO: 7332
  misc_feature (1)...(201): n = A,T,C or G, or insertion/deletion polymorphism (see Tables 1-2)

SEQ ID NO: 7451 - DNA, 201 bp, Homo sapiens; identical to SEQ ID NO: 7333

SEQ ID NO: 7452 - DNA, 201 bp, Homo sapiens; identical to SEQ ID NO: 7392

SEQ ID NO: 7453 - DNA, 201 bp, Homo sapiens; identical to SEQ ID NO: 7334

SEQ ID NO: 7454 - DNA, 201 bp, Homo sapiens; identical to SEQ ID NO: 7335

SEQ ID NO: 7455 - DNA, 201 bp, Homo sapiens; identical to SEQ ID NO: 7395

SEQ ID NO: 7456 - DNA, 201 bp, Homo sapiens; identical to SEQ ID NO: 7336

SEQ ID NO: 7457 - DNA, 201 bp, Homo sapiens; identical to SEQ ID NO: 7337

SEQ ID NO: 7458 - DNA, 201 bp, Homo sapiens; identical to SEQ ID NO: 7338

SEQ ID NO: 7459 - DNA, 201 bp, Homo sapiens; identical to SEQ ID NO: 7339

SEQ ID NO: 7460 - DNA, 201 bp, Homo sapiens; identical to SEQ ID NO: 7340

SEQ ID NO: 7461 - DNA, 201 bp, Homo sapiens; identical to SEQ ID NO: 7341

SEQ ID NO: 7462 - DNA, 201 bp, Homo sapiens; identical to SEQ ID NO: 7342

SEQ ID NO: 7463 - DNA, 201 bp, Homo sapiens; identical to SEQ ID NO: 7343

SEQ ID NO: 7464 - DNA, 201 bp, Homo sapiens; identical to SEQ ID NO: 7344

SEQ ID NO: 7465 - DNA, 201 bp, Homo sapiens; identical to SEQ ID NO: 7346

SEQ ID NO: 7466 - DNA, 201 bp, Homo sapiens; identical to SEQ ID NO: 7347

SEQ ID NO: 7467 - DNA, 201 bp, Homo sapiens; identical to SEQ ID NO: 7348

SEQ ID NO: 7468 - DNA, 201 bp, Homo sapiens; identical to SEQ ID NO: 7350

SEQ ID NO: 7469 - DNA, 201 bp, Homo sapiens; identical to SEQ ID NO: 7351

SEQ ID NO: 7470 - DNA, 201 bp, Homo sapiens; identical to SEQ ID NO: 7352

SEQ ID NO: 7471 - DNA, 201 bp, Homo sapiens; identical to SEQ ID NO: 7353

SEQ ID NO: 7472 - DNA, 201 bp, Homo sapiens; identical to SEQ ID NO: 7354

SEQ ID NO: 7473 - DNA, 201 bp, Homo sapiens; identical to SEQ ID NO: 7355

SEQ ID NO: 7474 - DNA, 201 bp, Homo sapiens; identical to SEQ ID NO: 7356

SEQ ID NO: 7475 - DNA, 201 bp, Homo sapiens; identical to SEQ ID NO: 7357

SEQ ID NO: 7476 - DNA, 201 bp, Homo sapiens; identical to SEQ ID NO: 7358

SEQ ID NO: 7477 - DNA, 201 bp, Homo sapiens; identical to SEQ ID NO: 7359

SEQ ID NO: 7478 - DNA, 201 bp, Homo sapiens; identical to SEQ ID NO: 7360

SEQ ID NO: 7479 - DNA, 201 bp, Homo sapiens; identical to SEQ ID NO: 7303

SEQ ID NO: 7480 - DNA, 201 bp, Homo sapiens; identical to SEQ ID NO: 7304

SEQ ID NO: 7481 - DNA, 201 bp, Homo sapiens; identical to SEQ ID NO: 7305

SEQ ID NO: 7482 - DNA, 201 bp, Homo sapiens; identical to SEQ ID NO: 7306

SEQ ID NO: 7483 - DNA, 201 bp, Homo sapiens; identical to SEQ ID NO: 7307

SEQ ID NO: 7484 - DNA, 201 bp, Homo sapiens; identical to SEQ ID NO: 7308

SEQ ID NO: 7485 - DNA, 201 bp, Homo sapiens; identical to SEQ ID NO: 7309

SEQ ID NO: 7486 - DNA, 201 bp, Homo sapiens; identical to SEQ ID NO: 7310

SEQ ID NO: 7487 - DNA, 201 bp, Homo sapiens; identical to SEQ ID NO: 7311

SEQ ID NO: 7488 - DNA, 201 bp, Homo sapiens; identical to SEQ ID NO: 7312

SEQ ID NO: 7489 - DNA, 201 bp, Homo sapiens; identical to SEQ ID NO: 7313

SEQ ID NO: 7490 - DNA, 201 bp, Homo sapiens; identical to SEQ ID NO: 7314

SEQ ID NO: 7491 - DNA, 201 bp, Homo sapiens; identical to SEQ ID NO: 7315

SEQ ID NO: 7492 - DNA, 201 bp, Homo sapiens; identical to SEQ ID NO: 7316

SEQ ID NO: 7493 - DNA, 201 bp, Homo sapiens; identical to SEQ ID NO: 7317

SEQ ID NO: 7494 - DNA, 201 bp, Homo sapiens; identical to SEQ ID NO: 7318

SEQ ID NO: 7495 - DNA, 201 bp, Homo sapiens; identical to SEQ ID NO: 7319

SEQ ID NO: 7496 - DNA, 201 bp, Homo sapiens; identical to SEQ ID NO: 7320

SEQ ID NO: 7497 - DNA, 201 bp, Homo sapiens; identical to SEQ ID NO: 7321

SEQ ID NO: 7498 - DNA, 201 bp, Homo sapiens; identical to SEQ ID NO: 7322

SEQ ID NO: 7499 - DNA, 201 bp, Homo sapiens; identical to SEQ ID NO: 7323

SEQ ID NO: 7500 - DNA, 201 bp, Homo sapiens; identical to SEQ ID NO: 7324

SEQ ID NO: 7501 - DNA, 201 bp, Homo sapiens; identical to SEQ ID NO: 7325

SEQ ID NO: 7502 - DNA, 201 bp, Homo sapiens; identical to SEQ ID NO: 7326

SEQ ID NO: 7503 - DNA, 201 bp, Homo sapiens; identical to SEQ ID NO: 7327

SEQ ID NO: 7504 - DNA, 201 bp, Homo sapiens; identical to SEQ ID NO: 7328

SEQ ID NO: 7505 - DNA, 201 bp, Homo sapiens; identical to SEQ ID NO: 7329

SEQ ID NO: 7506 - DNA, 201 bp, Homo sapiens; identical to SEQ ID NO: 7330

SEQ ID NO: 7507 - DNA, 201 bp, Homo sapiens; identical to SEQ ID NO: 7331

SEQ ID NO: 7508 - DNA, 201 bp, Homo sapiens; identical to SEQ ID NO: 7332
  misc_feature (1)...(201): n = A,T,C or G, or insertion/deletion polymorphism (see Tables 1-2)

SEQ ID NO: 7509 - DNA, 201 bp, Homo sapiens; identical to SEQ ID NO: 7333

SEQ ID NO: 7510 - DNA, 201 bp, Homo sapiens; identical to SEQ ID NO: 7392

SEQ ID NO: 7511 - DNA, 201 bp, Homo sapiens; identical to SEQ ID NO: 7334

SEQ ID NO: 7512 - DNA, 201 bp, Homo sapiens; identical to SEQ ID NO: 7335

SEQ ID NO: 7513 - DNA, 201 bp, Homo sapiens; identical to SEQ ID NO: 7395

SEQ ID NO: 7514 - DNA, 201 bp, Homo sapiens; identical to SEQ ID NO: 7336

SEQ ID NO: 7515 - DNA, 201 bp, Homo sapiens; identical to SEQ ID NO: 7337

SEQ ID NO: 7516 - DNA, 201 bp, Homo sapiens; identical to SEQ ID NO: 7338

SEQ ID NO: 7517 - DNA, 201 bp, Homo sapiens; identical to SEQ ID NO: 7339

SEQ ID NO: 7518 - DNA, 201 bp, Homo sapiens; identical to SEQ ID NO: 7340

SEQ ID NO: 7519 - DNA, 201 bp, Homo sapiens; identical to SEQ ID NO: 7341

SEQ ID NO: 7520 - DNA, 201 bp, Homo sapiens; identical to SEQ ID NO: 7342

SEQ ID NO: 7521 - DNA, 201 bp, Homo sapiens; identical to SEQ ID NO: 7343

SEQ ID NO: 7522 - DNA, 201 bp, Homo sapiens; identical to SEQ ID NO: 7344

SEQ ID NO: 7523 - DNA, 201 bp, Homo sapiens; identical to SEQ ID NO: 7345

SEQ ID NO: 7524 - DNA, 201 bp, Homo sapiens; identical to SEQ ID NO: 7346

SEQ ID NO: 7525 - DNA, 201 bp, Homo sapiens; identical to SEQ ID NO: 7347

SEQ ID NO: 7526 - DNA, 201 bp, Homo sapiens; identical to SEQ ID NO: 7348

SEQ ID NO: 7527 - DNA, 201 bp, Homo sapiens; identical to SEQ ID NO: 7349

SEQ ID NO: 7528 - DNA, 201 bp, Homo sapiens; identical to SEQ ID NO: 7350

SEQ ID NO: 7529 - DNA, 201 bp, Homo sapiens; identical to SEQ ID NO: 7351

SEQ ID NO: 7530 - DNA, 201 bp, Homo sapiens; identical to SEQ ID NO: 7352

SEQ ID NO: 7531 - DNA, 201 bp, Homo sapiens; identical to SEQ ID NO: 7353

SEQ ID NO: 7532 - DNA, 201 bp, Homo sapiens; identical to SEQ ID NO: 7354

SEQ ID NO: 7533 - DNA, 201 bp, Homo sapiens; identical to SEQ ID NO: 7355

SEQ ID NO: 7534 - DNA, 201 bp, Homo sapiens; identical to SEQ ID NO: 7356

SEQ ID NO: 7535 - DNA, 201 bp, Homo sapiens; identical to SEQ ID NO: 7357

SEQ ID NO: 7536 - DNA, 201 bp, Homo sapiens; identical to SEQ ID NO: 7358

SEQ ID NO: 7537 - DNA, 201 bp, Homo sapiens; identical to SEQ ID NO: 7359

SEQ ID NO: 7538 - DNA, 201 bp, Homo sapiens; identical to SEQ ID NO: 7360

SEQ ID NO: 7539 - DNA, 201 bp, Homo sapiens; identical to SEQ ID NO: 7303

SEQ ID NO: 7540 - DNA, 201 bp, Homo sapiens; identical to SEQ ID NO: 7306

SEQ ID NO: 7541 - DNA, 201 bp, Homo sapiens; identical to SEQ ID NO: 7308

SEQ ID NO: 7542 - DNA, 201 bp, Homo sapiens; identical to SEQ ID NO: 7309

SEQ ID NO: 7543 - DNA, 201 bp, Homo sapiens; identical to SEQ ID NO: 7310

SEQ ID NO: 7544 - DNA, 201 bp, Homo sapiens; identical to SEQ ID NO: 7312

SEQ ID NO: 7545 - DNA, 201 bp, Homo sapiens; identical to SEQ ID NO: 7311

SEQ ID NO: 7546 - DNA, 201 bp, Homo sapiens; identical to SEQ ID NO: 7313

SEQ ID NO: 7547 - DNA, 201 bp, Homo sapiens
ggctaaatggaacaacaggacccaaaggcatcagaggccgaaggggaaattcgggacctccagggatagttggacagaagggagaccctggctacccaggmccagctggtcccaagggcaacaggggcgactccatcgatcaatgtgccctcatccaaagcatcaaagataaatgcccttgctgttacgggcccctggagt

SEQ ID NO: 7548 - DNA, 201 bp, Homo sapiens; identical to SEQ ID NO: 7316

SEQ ID NO: 7549 - DNA, 201 bp, Homo sapiens; identical to SEQ ID NO: 7315

SEQ ID NO: 7550 - DNA, 201 bp, Homo sapiens; identical to SEQ ID NO: 7317

SEQ ID NO: 7551 - DNA, 201 bp, Homo sapiens; identical to SEQ ID NO: 7319

SEQ ID NO: 7552 - DNA, 201 bp, Homo sapiens; identical to SEQ ID NO: 7318

SEQ ID NO: 7553 - DNA, 201 bp, Homo sapiens; identical to SEQ ID NO: 7320

SEQ ID NO: 7554 - DNA, 201 bp, Homo sapiens; identical to SEQ ID NO: 7321

SEQ ID NO: 7555 - DNA, 201 bp, Homo sapiens; identical to SEQ ID NO: 7322

SEQ ID NO: 7556 - DNA, 201 bp, Homo sapiens; identical to SEQ ID NO: 7323

SEQ ID NO: 7557 - DNA, 201 bp, Homo sapiens; identical to SEQ ID NO: 7324

SEQ ID NO: 7558 - DNA, 201 bp, Homo sapiens; identical to SEQ ID NO: 7325

SEQ ID NO: 7559 - DNA, 201 bp, Homo sapiens; identical to SEQ ID NO: 7326

SEQ ID NO: 7560 - DNA, 201 bp, Homo sapiens; identical to SEQ ID NO: 7327

SEQ ID NO: 7561 - DNA, 201 bp, Homo sapiens; identical to SEQ ID NO: 7328

SEQ ID NO: 7562 - DNA, 201 bp, Homo sapiens; identical to SEQ ID NO: 7329

SEQ ID NO: 7563 - DNA, 201 bp, Homo sapiens; identical to SEQ ID NO: 7330

SEQ ID NO: 7564 - DNA, 201 bp, Homo sapiens; identical to SEQ ID NO: 7331

SEQ ID NO: 7565 - DNA, 201 bp, Homo sapiens; identical to SEQ ID NO: 7332
  misc_feature (1)...(201): n = A,T,C or G, or insertion/deletion polymorphism (see Tables 1-2)

SEQ ID NO: 7566 - DNA, 201 bp, Homo sapiens; identical to SEQ ID NO: 7392

SEQ ID NO: 7567 - DNA, 201 bp, Homo sapiens; identical to SEQ ID NO: 7333

SEQ ID NO: 7568 - DNA, 201 bp, Homo sapiens; identical to SEQ ID NO: 7334

SEQ ID NO: 7569 - DNA, 201 bp, Homo sapiens; identical to SEQ ID NO: 7335

SEQ ID NO: 7570 - DNA, 201 bp, Homo sapiens; identical to SEQ ID NO: 7395

SEQ ID NO: 7571 - DNA, 201 bp, Homo sapiens; identical to SEQ ID NO: 7336

SEQ ID NO: 7572 - DNA, 201 bp, Homo sapiens; identical to SEQ ID NO: 7337

SEQ ID NO: 7573 - DNA, 201 bp, Homo sapiens; identical to SEQ ID NO: 7338

SEQ ID NO: 7574 - DNA, 201 bp, Homo sapiens; identical to SEQ ID NO: 7339

SEQ ID NO: 7575 - DNA, 201 bp, Homo sapiens; identical to SEQ ID NO: 7340

SEQ ID NO: 7576 - DNA, 201 bp, Homo sapiens; identical to SEQ ID NO: 7341

SEQ ID NO: 7577 - DNA, 201 bp, Homo sapiens; identical to SEQ ID NO: 7342

SEQ ID NO: 7578 - DNA, 201 bp, Homo sapiens; identical to SEQ ID NO: 7343

SEQ ID NO: 7579 - DNA, 201 bp, Homo sapiens; identical to SEQ ID NO: 7344

SEQ ID NO: 7580 - DNA, 201 bp, Homo sapiens; identical to SEQ ID NO: 7345

SEQ ID NO: 7581 - DNA, 201 bp, Homo sapiens; identical to SEQ ID NO: 7346

SEQ ID NO: 7582 - DNA, 201 bp, Homo sapiens; identical to SEQ ID NO: 7348

SEQ ID NO: 7583 - DNA, 201 bp, Homo sapiens; identical to SEQ ID NO: 7350

SEQ ID NO: 7584 - DNA, 201 bp, Homo sapiens; identical to SEQ ID NO: 7349

SEQ ID NO: 7585 - DNA, 201 bp, Homo sapiens; identical to SEQ ID NO: 7351

SEQ ID NO: 7586 - DNA, 201 bp, Homo sapiens; identical to SEQ ID NO: 7353

SEQ ID NO: 7587 - DNA, 201 bp, Homo sapiens; identical to SEQ ID NO: 7354

SEQ ID NO: 7588 - DNA, 201 bp, Homo sapiens; identical to SEQ ID NO: 7356

SEQ ID NO: 7589 - DNA, 201 bp, Homo sapiens; identical to SEQ ID NO: 7355

SEQ ID NO: 7590 - DNA, 201 bp, Homo sapiens; identical to SEQ ID NO: 7357

SEQ ID NO: 7591 - DNA, 201 bp, Homo sapiens; identical to SEQ ID NO: 7358

SEQ ID NO: 7592 - DNA, 201 bp, Homo sapiens; identical to SEQ ID NO: 7359

SEQ ID NO: 7593 - DNA, 201 bp, Homo sapiens; identical to SEQ ID NO: 7360

SEQ ID NO: 7594 - DNA, 201 bp, Homo sapiens; identical to SEQ ID NO: 7303

SEQ ID NO: 7595 - DNA, 201 bp, Homo sapiens; identical to SEQ ID NO: 7306

SEQ ID NO: 7596 - DNA, 201 bp, Homo sapiens; identical to SEQ ID NO: 7308

SEQ ID NO: 7597 - DNA, 201 bp, Homo sapiens; identical to SEQ ID NO: 7309

SEQ ID NO: 7598 - DNA, 201 bp, Homo sapiens; identical to SEQ ID NO: 7310

SEQ ID NO: 7599 - DNA, 201 bp, Homo sapiens; identical to SEQ ID NO: 7312

SEQ ID NO: 7600 - DNA, 201 bp, Homo sapiens; identical to SEQ ID NO: 7311

SEQ ID NO: 7601 - DNA, 201 bp, Homo sapiens; identical to SEQ ID NO: 7313

SEQ ID NO: 7602 - DNA, 201 bp, Homo sapiens; identical to SEQ ID NO: 7547

SEQ ID NO: 7603 - DNA, 201 bp, Homo sapiens; identical to SEQ ID NO: 7316

SEQ ID NO: 7604 - DNA, 201 bp, Homo sapiens; identical to SEQ ID NO: 7315

SEQ ID NO: 7605 - DNA, 201 bp, Homo sapiens; identical to SEQ ID NO: 7317

SEQ ID NO: 7606 - DNA, 201 bp, Homo sapiens; identical to SEQ ID NO: 7319

SEQ ID NO: 7607 - DNA, 201 bp, Homo sapiens; identical to SEQ ID NO: 7318

SEQ ID NO: 7608 - DNA, 201 bp, Homo sapiens; identical to SEQ ID NO: 7320

SEQ ID NO: 7609 - DNA, 201 bp, Homo sapiens; identical to SEQ ID NO: 7321

SEQ ID NO: 7610 - DNA, 201 bp, Homo sapiens; identical to SEQ ID NO: 7322

SEQ ID NO: 7611 - DNA, 201 bp, Homo sapiens; identical to SEQ ID NO: 7323

SEQ ID NO: 7612 - DNA, 201 bp, Homo sapiens; identical to SEQ ID NO: 7324

SEQ ID NO: 7613 - DNA, 201 bp, Homo sapiens; identical to SEQ ID NO: 7325

SEQ ID NO: 7614 - DNA, 201 bp, Homo sapiens; identical to SEQ ID NO: 7326

SEQ ID NO: 7615 - DNA, 201 bp, Homo sapiens; identical to SEQ ID NO: 7327

SEQ ID NO: 7616 - DNA, 201 bp, Homo sapiens; identical to SEQ ID NO: 7328

SEQ ID NO: 7617 - DNA, 201 bp, Homo sapiens; identical to SEQ ID NO: 7329

SEQ ID NO: 7618 - DNA, 201 bp, Homo sapiens; identical to SEQ ID NO: 7330

SEQ ID NO: 7619 - DNA, 201 bp, Homo sapiens; identical to SEQ ID NO: 7389

SEQ ID NO: 7620 - DNA, 201 bp, Homo sapiens; identical to SEQ ID NO: 7332
  misc_feature (1)...(201): n = A,T,C or G, or insertion/deletion polymorphism (see Tables 1-2)

SEQ ID NO: 7621 - DNA, 201 bp, Homo sapiens; identical to SEQ ID NO: 7392

SEQ ID NO: 7622 - DNA, 201 bp, Homo sapiens; identical to SEQ ID NO: 7333

SEQ ID NO: 7623 - DNA, 201 bp, Homo sapiens; identical to SEQ ID NO: 7334

SEQ ID NO: 7624 - DNA, 201 bp, Homo sapiens; identical to SEQ ID NO: 7335

SEQ ID NO: 7625 - DNA, 201 bp, Homo sapiens; identical to SEQ ID NO: 7395

SEQ ID NO: 7626 - DNA, 201 bp, Homo sapiens; identical to SEQ ID NO: 7336

SEQ ID NO: 7627 - DNA, 201 bp, Homo sapiens; identical to SEQ ID NO: 7337

SEQ ID NO: 7628 - DNA, 201 bp, Homo sapiens; identical to SEQ ID NO: 7338

SEQ ID NO: 7629 - DNA, 201 bp, Homo sapiens; identical to SEQ ID NO: 7339

SEQ ID NO: 7630 - DNA, 201 bp, Homo sapiens; identical to SEQ ID NO: 7340

SEQ ID NO: 7631 - DNA, 201 bp, Homo sapiens; identical to SEQ ID NO: 7341

SEQ ID NO: 7632 - DNA, 201 bp, Homo sapiens; identical to SEQ ID NO: 7342

SEQ ID NO: 7633 - DNA, 201 bp, Homo sapiens; identical to SEQ ID NO: 7343

SEQ ID NO: 7634 - DNA, 201 bp, Homo sapiens; identical to SEQ ID NO: 7344

SEQ ID NO: 7635 - DNA, 201 bp, Homo sapiens; identical to SEQ ID NO: 7345

SEQ ID NO: 7636 - DNA, 201 bp, Homo sapiens; identical to SEQ ID NO: 7346

SEQ ID NO: 7637 - DNA, 201 bp, Homo sapiens; identical to SEQ ID NO: 7348

SEQ ID NO: 7638 - DNA, 201 bp, Homo sapiens; identical to SEQ ID NO: 7350

SEQ ID NO: 7639 - DNA, 201 bp, Homo sapiens; identical to SEQ ID NO: 7349

SEQ ID NO: 7640 - DNA, 201 bp, Homo sapiens; identical to SEQ ID NO: 7351

SEQ ID NO: 7641 - DNA, 201 bp, Homo sapiens; identical to SEQ ID NO: 7353

SEQ ID NO: 7642 - DNA, 201 bp, Homo sapiens; identical to SEQ ID NO: 7354

SEQ ID NO: 7643 - DNA, 201 bp, Homo sapiens; identical to SEQ ID NO: 7356

SEQ ID NO: 7644 - DNA, 201 bp, Homo sapiens; identical to SEQ ID NO: 7355

SEQ ID NO: 7645 - DNA, 201 bp, Homo sapiens; identical to SEQ ID NO: 7357

SEQ ID NO: 7646 - DNA, 201 bp, Homo sapiens; identical to SEQ ID NO: 7358

SEQ ID NO: 7647 - DNA, 201 bp, Homo sapiens; identical to SEQ ID NO: 7359

SEQ ID NO: 7648 - DNA, 201 bp, Homo sapiens; identical to SEQ ID NO: 7360

SEQ ID NO: 7649 - DNA, 201 bp, Homo sapiens; identical to SEQ ID NO: 7303

SEQ ID NO: 7650 - DNA, 201 bp, Homo sapiens; identical to SEQ ID NO: 7306

SEQ ID NO: 7651 - DNA, 201 bp, Homo sapiens; identical to SEQ ID NO: 7308

SEQ ID NO: 7652 - DNA, 201 bp, Homo sapiens; identical to SEQ ID NO: 7309

SEQ ID NO: 7653 - DNA, 201 bp, Homo sapiens; identical to SEQ ID NO: 7310

SEQ ID NO: 7654 - DNA, 201 bp, Homo sapiens; identical to SEQ ID NO: 7312

SEQ ID NO: 7655 - DNA, 201 bp, Homo sapiens; identical to SEQ ID NO: 7313

SEQ ID NO: 7656 - DNA, 201 bp, Homo sapiens; identical to SEQ ID NO: 7547

SEQ ID NO: 7657 - DNA, 201 bp, Homo sapiens
ctggaagagatcgctttcgactcctccctggtgttcatcccagctgagttccgagccgccccattgcaaggcatgctgcctggcttgctggcacctctcasgaccctctctggaacccctgaagagagcaagcgagacattctgttcctctttgacggctcagccaatcttgtgggccagttccctgttgtccgtgacttt

SEQ ID NO: 7658 - DNA, 201 bp, Homo sapiens; identical to SEQ ID NO: 7315

SEQ ID NO: 7659 - DNA, 201 bp, Homo sapiens; identical to SEQ ID NO: 7317

SEQ ID NO: 7660 - DNA, 201 bp, Homo sapiens; identical to SEQ ID NO: 7319

SEQ ID NO: 7661 - DNA, 201 bp, Homo sapiens; identical to SEQ ID NO: 7318

SEQ ID NO: 7662 - DNA, 201 bp, Homo sapiens; identical to SEQ ID NO: 7320

SEQ ID NO: 7663 - DNA, 201 bp, Homo sapiens; identical to SEQ ID NO: 7321

SEQ ID NO: 7664 - DNA, 201 bp, Homo sapiens; identical to SEQ ID NO: 7322

SEQ ID NO: 7665 - DNA, 201 bp, Homo sapiens; identical to SEQ ID NO: 7323

SEQ ID NO: 7666 - DNA, 201 bp, Homo sapiens; identical to SEQ ID NO: 7324

SEQ ID NO: 7667 - DNA, 201 bp, Homo sapiens; identical to SEQ ID NO: 7325

SEQ ID NO: 7668 - DNA, 201 bp, Homo sapiens; identical to SEQ ID NO: 7326

SEQ ID NO: 7669 - DNA, 201 bp, Homo sapiens; identical to SEQ ID NO: 7327

SEQ ID NO: 7670 - DNA, 201 bp, Homo sapiens; identical to SEQ ID NO: 7328

SEQ ID NO: 7671 - DNA, 201 bp, Homo sapiens; identical to SEQ ID NO: 7329

SEQ ID NO: 7672 - DNA, 201 bp, Homo sapiens; identical to SEQ ID NO: 7330

SEQ ID NO: 7673 - DNA, 201 bp, Homo sapiens; identical to SEQ ID NO: 7331

SEQ ID NO: 7674 - DNA, 201 bp, Homo sapiens; identical to SEQ ID NO: 7332
  misc_feature (1)...(201): n = A,T,C or G, or insertion/deletion polymorphism (see Tables 1-2)

SEQ ID NO: 7675 - DNA, 201 bp, Homo sapiens; identical to SEQ ID NO: 7392

SEQ ID NO: 7676 - DNA, 201 bp, Homo sapiens; identical to SEQ ID NO: 7333

SEQ ID NO: 7677 - DNA, 201 bp, Homo sapiens; identical to SEQ ID NO: 7334

SEQ ID NO: 7678 - DNA, 201 bp, Homo sapiens; identical to SEQ ID NO: 7335

SEQ ID NO: 7679 - DNA, 201 bp, Homo sapiens; identical to SEQ ID NO: 7395

SEQ ID NO: 7680 - DNA, 201 bp, Homo sapiens; identical to SEQ ID NO: 7336

SEQ ID NO: 7681 - DNA, 201 bp, Homo sapiens; identical to SEQ ID NO: 7338

SEQ ID NO: 7682 - DNA, 201 bp, Homo sapiens; identical to SEQ ID NO: 7337

SEQ ID NO: 7683 - DNA, 201 bp, Homo sapiens; identical to SEQ ID NO: 7340

SEQ ID NO: 7684 - DNA, 201 bp, Homo sapiens; identical to SEQ ID NO: 7339

SEQ ID NO: 7685 - DNA, 201 bp, Homo sapiens; identical to SEQ ID NO: 7341

SEQ ID NO: 7686 - DNA, 201 bp, Homo sapiens; identical to SEQ ID NO: 7343

SEQ ID NO: 7687 - DNA, 201 bp, Homo sapiens; identical to SEQ ID NO: 7344

SEQ ID NO: 7688 - DNA, 201 bp, Homo sapiens; identical to SEQ ID NO: 7345

SEQ ID NO: 7689 - DNA, 201 bp, Homo sapiens; identical to SEQ ID NO: 7346

SEQ ID NO: 7690 - DNA, 201 bp, Homo sapiens; identical to SEQ ID NO: 7348

SEQ ID NO: 7691 - DNA, 201 bp, Homo sapiens; identical to SEQ ID NO: 7350

SEQ ID NO: 7692 - DNA, 201 bp, Homo sapiens; identical to SEQ ID NO: 7349

SEQ ID NO: 7693 - DNA, 201 bp, Homo sapiens; identical to SEQ ID NO: 7353

SEQ ID NO: 7694 - DNA, 201 bp, Homo sapiens; identical to SEQ ID NO: 7354

SEQ ID NO: 7695 - DNA, 201 bp, Homo sapiens; identical to SEQ ID NO: 7356

SEQ ID NO: 7696 - DNA, 201 bp, Homo sapiens; identical to SEQ ID NO: 7355

SEQ ID NO: 7697 - DNA, 201 bp, Homo sapiens; identical to SEQ ID NO: 7357

SEQ ID NO: 7698 - DNA, 201 bp, Homo sapiens; identical to SEQ ID NO: 7358

SEQ ID NO: 7699 - DNA, 201 bp, Homo sapiens; identical to SEQ ID NO: 7359

SEQ ID NO: 7700 - DNA, 201 bp, Homo sapiens; identical to SEQ ID NO: 7360

SEQ ID NO: 7701 - DNA, 201 bp, Homo sapiens; identical to SEQ ID NO: 7303

SEQ ID NO: 7702 - DNA, 201 bp, Homo sapiens; identical to SEQ ID NO: 7304

SEQ ID NO: 7703 - DNA, 201 bp, Homo sapiens; identical to SEQ ID NO: 7305

SEQ ID NO: 7704 - DNA, 201 bp, Homo sapiens; identical to SEQ ID NO: 7306

SEQ ID NO: 7705 - DNA, 201 bp, Homo sapiens; identical to SEQ ID NO: 7307

SEQ ID NO: 7706 - DNA, 201 bp, Homo sapiens; identical to SEQ ID NO: 7308

SEQ ID NO: 7707 - DNA, 201 bp, Homo sapiens; identical to SEQ ID NO: 7309

SEQ ID NO: 7708 - DNA, 201 bp, Homo sapiens; identical to SEQ ID NO: 7310

SEQ ID NO: 7709 - DNA, 201 bp, Homo sapiens; identical to SEQ ID NO: 7312

SEQ ID NO: 7710 - DNA, 201 bp, Homo sapiens; identical to SEQ ID NO: 7313

SEQ ID NO: 7711 - DNA, 201 bp, Homo sapiens; identical to SEQ ID NO: 7314

SEQ ID NO: 7712 - DNA, 201 bp, Homo sapiens; identical to SEQ ID NO: 7315

SEQ ID NO: 7713 - DNA, 201 bp, Homo sapiens; identical to SEQ ID NO: 7657

SEQ ID NO: 7714 - DNA, 201 bp, Homo sapiens; identical to SEQ ID NO: 7317

SEQ ID NO: 7715 - DNA, 201 bp, Homo sapiens; identical to SEQ ID NO: 7318

SEQ ID NO: 7716 - DNA, 201 bp, Homo sapiens; identical to SEQ ID NO: 7319

SEQ ID NO: 7717 - DNA, 201 bp, Homo sapiens; identical to SEQ ID NO: 7320

SEQ ID NO: 7718 - DNA, 201 bp, Homo sapiens; identical to SEQ ID NO: 7321

SEQ ID NO: 7719 - DNA, 201 bp, Homo sapiens; identical to SEQ ID NO: 7322

SEQ ID NO: 7720 - DNA, 201 bp, Homo sapiens; identical to SEQ ID NO: 7323

SEQ ID NO: 7721 - DNA, 201 bp, Homo sapiens; identical to SEQ ID NO: 7324

SEQ ID NO: 7722 - DNA, 201 bp, Homo sapiens; identical to SEQ ID NO: 7325

SEQ ID NO: 7723 - DNA, 201 bp, Homo sapiens; identical to SEQ ID NO: 7326

SEQ ID NO: 7724 - DNA, 201 bp, Homo sapiens; identical to SEQ ID NO: 7327

SEQ ID NO: 7725 - DNA, 201 bp, Homo sapiens; identical to SEQ ID NO: 7328

SEQ ID NO: 7726 - DNA, 201 bp, Homo sapiens; identical to SEQ ID NO: 7329

SEQ ID NO: 7727 - DNA, 201 bp, Homo sapiens; identical to SEQ ID NO: 7330

SEQ ID NO: 7728 - DNA, 201 bp, Homo sapiens; identical to SEQ ID NO: 7331

SEQ ID NO: 7729 - DNA, 201 bp, Homo sapiens; identical to SEQ ID NO: 7332
  misc_feature (1)...(201): n = A,T,C or G, or insertion/deletion polymorphism (see Tables 1-2)

SEQ ID NO: 7730 - DNA, 201 bp, Homo sapiens; identical to SEQ ID NO: 7333

SEQ ID NO: 7731 - DNA, 201 bp, Homo sapiens; identical to SEQ ID NO: 7392

SEQ ID NO: 7732 - DNA, 201 bp, Homo sapiens; identical to SEQ ID NO: 7334

SEQ ID NO: 7733 - DNA, 201 bp, Homo sapiens; identical to SEQ ID NO: 7335

SEQ ID NO: 7734 - DNA, 201 bp, Homo sapiens; identical to SEQ ID NO: 7395

SEQ ID NO: 7735 - DNA, 201 bp, Homo sapiens; identical to SEQ ID NO: 7336

SEQ ID NO: 7736 - DNA, 201 bp, Homo sapiens; identical to SEQ ID NO: 7337

SEQ ID NO: 7737 - DNA, 201 bp, Homo sapiens; identical to SEQ ID NO: 7338

SEQ ID NO: 7738 - DNA, 201 bp, Homo sapiens; identical to SEQ ID NO: 7339

SEQ ID NO: 7739 - DNA, 201 bp, Homo sapiens; identical to SEQ ID NO: 7340

SEQ ID NO: 7740 - DNA, 201 bp, Homo sapiens; identical to SEQ ID NO: 7341

SEQ ID NO: 7741 - DNA, 201 bp, Homo sapiens; identical to SEQ ID NO: 7343

SEQ ID NO: 7742 - DNA, 201 bp, Homo sapiens; identical to SEQ ID NO: 7344

SEQ ID NO: 7743 - DNA, 201 bp, Homo sapiens; identical to SEQ ID NO: 7345

SEQ ID NO: 7744 - DNA, 201 bp, Homo sapiens; identical to SEQ ID NO: 7346

SEQ ID NO: 7745 - DNA, 201 bp, Homo sapiens; identical to SEQ ID NO: 7347

SEQ ID NO: 7746 - DNA, 201 bp, Homo sapiens; identical to SEQ ID NO: 7348

SEQ ID NO: 7747 - DNA, 201 bp, Homo sapiens; identical to SEQ ID NO: 7349

SEQ ID NO: 7748 - DNA, 201 bp, Homo sapiens; identical to SEQ ID NO: 7350

SEQ ID NO: 7749 - DNA, 201 bp, Homo sapiens; identical to SEQ ID NO: 7352

SEQ ID NO: 7750 - DNA, 201 bp, Homo sapiens; identical to SEQ ID NO: 7353

SEQ ID NO: 7751 - DNA, 201 bp, Homo sapiens; identical to SEQ ID NO: 7354

SEQ ID NO: 7752 - DNA, 201 bp, Homo sapiens; identical to SEQ ID NO: 7355

SEQ ID NO: 7753 - DNA, 201 bp, Homo sapiens; identical to SEQ ID NO: 7356

SEQ ID NO: 7754 - DNA, 201 bp, Homo sapiens; identical to SEQ ID NO: 7357

SEQ ID NO: 7755 - DNA, 201 bp, Homo sapiens; identical to SEQ ID NO: 7358

SEQ ID NO: 7756 - DNA, 201 bp, Homo sapiens; identical to SEQ ID NO: 7359

SEQ ID NO: 7757 - DNA, 201 bp, Homo sapiens
ggagcgcctgaaacaccagtctttggggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtatgttggcaccattcct

SEQ ID NO: 7758 - DNA, 153 bp, Homo sapiens
aaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatct

SEQ ID NO: 7759 - DNA, 201 bp, Homo sapiens
ggtcatacacagaagagactccaatcgacaagaagctggaaaagaatgatgttgtccttaaacaacctacagaatatcatctataacccggtaatcccgtwtgttggcaccattcctgatcagctggatcctggaactttgattgtgatacgtgggcatgttcctagtgacgcagacagattccaggtggatctgcagaat

SEQ ID NO: 7760 - DNA, 201 bp, Homo sapiens
ccttgctgaaacgcatctcactgtcattctattgtttatattgttaaaatgagcttgtgcaccattaggtcctgctgggtgttctcagtccttgccatgamgtatggtggtgtctagcactgaatggggaaactgggggcagcaacacttatagccagttaaagccactctgccctctctcctactttggctgactcttca

SEQ ID NO: 7761 - DNA, 201 bp, Homo sapiens
  misc_feature (1)...(201): n = A,T,C or G, or insertion/deletion polymorphism (see Tables 1-2)
tctcttgagcttcgactcttctgtgcgctactgctgcgcactgctttttctacaggcattacatcaactcctaaggggtcctctgggattagttatgcagntattaaatcacccgaagacactaacttacagaagacacaactccttccccagtgatcactgtcataaccagtgctctaccgtatcccatcactgaggact

SEQ ID NO: 7762 - DNA, 201 bp, Homo sapiens
gactccaatcgacaagaagctggaaaagaatgatgttgtccttaaacaacctacagaatatcatctataacccggtaatcccgtatgttggcaccattccygatcagctggatcctggaactttgattgtgatacgtgggcatgttcctagtgacgcagacagattccaggtggatctgcagaatggcagcagcatgaaac

SEQ ID NO: 7763 - DNA, 201 bp, Homo sapiens
accaaaatacagaatggcttctgtgatactggccttgctgaaacgcatctcactgtcattctattgtttatattgttaaaatgagcttgtgcaccattagrtcctgctgggtgttctcagtccttgccatgaagtatggtggtgtctagcactgaatggggaaactgggggcagcaacacttatagccagttaaagccact

SEQ ID NO: 7764 - DNA, 201 bp, Homo sapiens
cctgttctcttgagcttcgactcttctgtgcgctactgctgcgcactgctttttctacaggcattacatcaactcctaaggggtcctctgggattagttawgcagatattaaatcacccgaagacactaacttacagaagacacaactccttccccagtgatcactgtcataaccagtgctctaccgtatcccatcactga

SEQ ID NO: 7765 - DNA, 201 bp, Homo sapiens
gcacttctatactagcaagctctgtctctaaaatgcaagttggccttttgcttgccacatttctgcattaaacttctatattagcttcaaaggcttttaawctcaatgcgaacattctacgggatgttcttagatgcctttaaaaagggggcagatctaattttatttgaaccctcactttccaacttcaccatgacccag

SEQ ID NO: 7766 - DNA, 201 bp, Homo sapiens
ttgtaagaaattcttttcttcaggagtcctggggagaagaagagagaaatattacctctttcccatttagtcctgggatgtactttgagatgataatttaytgtgatgttagagaattcaaggttgcagtaaatggcgtacacagcctggagtacaaacacagatttaaagagctcagcagtattgacacgctggaaatta

SEQ ID NO: 7767 - DNA, 201 bp, Homo sapiens
gttgtccttaaacaacctacagaatatcatctataacccggtaatcccgtatgttggcaccattcctgatcagctggatcctggaactttgattgtgataygtgggcatgttcctagtgacgcagacagattccaggtggatctgcagaatggcagcagcatgaaacctcgagccgatgtggcctttcatttcaatcctcg

SEQ ID NO: 7768 - DNA, 201 bp, Homo sapiens
  misc_feature (1)...(201): n = A,T,C or G, or insertion/deletion polymorphism (see Tables 1-2)
agattttttttggtaaaactgtgaagagctaggatatatacttggtgaaacaaaccagtatgttccctgttctcttgagcttcgactcttctgtgcgctantgctgcgcactgctttttctacaggcattacatcaactcctaaggggtcctctgggattagttatgcagatattaaatcacccgaagacactaacttaca

SEQ ID NO: 7769 - DNA, 201 bp, Homo sapiens
ggaatattttcagaacagattttagatattatttctatccatatattgaaaagaataccattgtcaatcttatttttttaaaagtactcagtgtagaaatygctagcccttaattcttttccagcttttcatattaatgtatgcagagtctcaccaagctcaaagacactggttgggggtggagggtgccacagggaaagc

SEQ ID NO: 7770 - DNA, 201 bp, Homo sapiens
  misc_feature (1)...(201): n = A,T,C or G, or insertion/deletion polymorphism (see Tables 1-2)
cgctactgctgcgcactgctttttctacaggcattacatcaactcctaaggggtcctctgggattagttatgcagatattaaatcacccgaagacactaanttacagaagacacaactccttccccagtgatcactgtcataaccagtgctctaccgtatcccatcactgaggactgatgttgactgacatcattttcttt

SEQ ID NO: 7771 - DNA, 201 bp, Homo sapiens
  misc_feature (1)...(201): n = A,T,C or G, or insertion/deletion polymorphism (see Tables 1-2)
gcacagattttttttggtaaaactgtgaagagctaggatatatacttggtgaaacaaaccagtatgttccctgttctcttgagcttcgactcttctgtgcnctactgctgcgcactgctttttctacaggcattacatcaactcctaaggggtcctctgggattagttatgcagatattaaatcacccgaagacactaact

SEQ ID NO: 7772 - DNA, 201 bp, Homo sapiens
cattcctgatcagctggatcctggaactttgattgtgatacgtgggcatgttcctagtgacgcagacagattccaggtggatctgcagaatggcagcagcrtgaaacctcgagccgatgtggcctttcatttcaatcctcgtttcaaaagggccggctgcattgtttgcaatactttgataaatgaaaaatggggacggga

SEQ ID NO: 7773 - DNA, 201 bp, Homo sapiens
gactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggt

SEQ ID NO: 7774 - DNA, 107 bp, Homo sapiens
attttgyctttacattttacataatttcagatacattttcctcatatcaaataattcagcattttttagtactaacatcatagtctgtaagccattcaaaaaatgta

SEQ ID NO: 7775 - DNA, 201 bp, Homo sapiens
ccattcctgatcagctggatcctggaactttgattgtgatacgtgggcatgttcctagtgacgcagacagattccaggtggatctgcagaatggcagcagyatgaaacctcgagccgatgtggcctttcatttcaatcctcgtttcaaaagggccggctgcattgtttgcaatactttgataaatgaaaaatggggacggg

SEQ ID NO: 7776 - DNA, 201 bp, Homo sapiens
  misc_feature (1)...(201): n = A,T,C or G, or insertion/deletion polymorphism (see Tables 1-2)
ttcttagttaaccaccaatggaactgggttcattctgaatcctggaggagcttcctcgtgccacccagtgtttctgggccctctgtgtgagcagccaggtntgagctgttttagaagcagcgtgttgccttcatctctcccgtttcccaaaagaacaaaggataaaggtgacagtcacactcctgggttaaaaaaagcatt

SEQ ID NO: 7777 - DNA, 201 bp, Homo sapiens
  misc_feature (1)...(201): n = A,T,C or G, or insertion/deletion polymorphism (see Tables 1-2)
aggctttacagtcaaaagtacttctgttgattgctaaataacttcattttcttgaaatagagcaactttgagtgaaatctgcaacatggataccatgtatntaagatactgctgtacagaagagttaaggcttacagtgcaaatgaggcgtcagctttgggtgctaaaattaacaagtctaatattattaccatcaatcag

SEQ ID NO: 7778 - DNA, 201 bp, Homo sapiens
tctgtataaaaataccgtgtatcatttactctttctgcagctctatacgataggcaggagaggcttatgtggcagcacaagccaggtggggattttgtaamgaagtgataaaacatttgtaagtaatccaagtaggtgtattaaggcaccaaaagtaacatggcacccaacacccaaaaataaaaatatgaaatatgagtg

SEQ ID NO: 7779 - DNA, 201 bp, Homo sapiens
gactcttcaagaatgccattcaacaagtatttatggagtacctactataatacagtagctaacatgtattgagcacagattttttttggtaaaactgtgaygagctaggatatatacttggtgaaacaaaccagtatgttccctgttctcttgagcttcgactcttctgtgcgctactgctgcgcactgctttttctacag

SEQ ID NO: 7780 - DNA, 201 bp, Homo sapiens
gagctgttttagaagcagcgtgttgccttcatctctcccgtttcccaaaagaacaaaggataaaggtgacagtcacactcctgggttaaaaaaagcattcmagaaccacttctctttatgggcacaacaaagaaacgaaggctgaagttcgcctacccaaaatgaaaagtaggctttacagtcaaaagtacttctgttgat

SEQ ID NO: 7781 - DNA, 201 bp, Homo sapiens
ttagcttcagctcggacttacaaagtacccaagcatctagtctggaactgacagagataagtagagaaaatgttccaaagtctggcacgccccagcttagsctgccattcgctgcaaggttgaacacccccatgggccctggacgaactgtcgtcgttaaaggagaagtgaatgcaaatgccaaaagctttaatgttgacc

SEQ ID NO: 7782 - DNA, 201 bp, Homo sapiens
agcctcctgagtagctgggactacagggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaatcccgtatgttggcaccattcct

SEQ ID NO: 7783 - DNA, 153 bp, Homo sapiens; identical to SEQ ID NO: 7758

SEQ ID NO: 7784 - DNA, 201 bp, Homo sapiens; identical to SEQ ID NO: 7759

SEQ ID NO: 7785 - DNA, 201 bp, Homo sapiens; identical to SEQ ID NO: 7760

SEQ ID NO: 7786 - DNA, 201 bp, Homo sapiens; identical to SEQ ID NO: 7761
  misc_feature (1)...(201): n = A,T,C or G, or insertion/deletion polymorphism (see Tables 1-2)

SEQ ID NO: 7787 - DNA, 201 bp, Homo sapiens; identical to SEQ ID NO: 7762

SEQ ID NO: 7788 - DNA, 201 bp, Homo sapiens
acaccagtctttggatggagtctcgttctgttgcccaggctggagtgcagtggcacaatctcggctcacttcaacctccgtctcccaggttcaagcaattstcctgtctcagcctcctgagtagctgggactacagggccagtgcctcagtttcaatccaggtaacctttaaatgaaacttgcctaaaatcttaggtcata

SEQ ID NO: 7789 - DNA, 201 bp, Homo sapiens; identical to SEQ ID NO: 7763

SEQ ID NO: 7790 - DNA, 201 bp, Homo sapiens; identical to SEQ ID NO: 7764

SEQ ID NO: 7791 - DNA, 201 bp, Homo sapiens; identical to SEQ ID NO: 7765

SEQ ID NO: 7792 - DNA, 201 bp, Homo sapiens; identical to SEQ ID NO: 7766

SEQ ID NO: 7793 - DNA, 201 bp, Homo sapiens; identical to SEQ ID NO: 7767

SEQ ID NO: 7794 - DNA, 201 bp, Homo sapiens; identical to SEQ ID NO: 7768
  misc_feature (1)...(201): n = A,T,C or G, or insertion/deletion polymorphism (see Tables 1-2)

SEQ ID NO: 7795 - DNA, 201 bp, Homo sapiens; identical to SEQ ID NO: 7769

SEQ ID NO: 7796 - DNA, 201 bp, Homo sapiens; identical to SEQ ID NO: 7770
  misc_feature (1)...(201): n = A,T,C or G, or insertion/deletion polymorphism (see Tables 1-2)

SEQ ID NO: 7797 - DNA, 201 bp, Homo sapiens; identical to SEQ ID NO: 7771
  misc_feature (1)...(201): n = A,T,C or G, or insertion/deletion polymorphism (see Tables 1-2)

SEQ ID NO: 7798 - DNA, 201 bp, Homo sapiens; identical to SEQ ID NO: 7772

SEQ ID NO: 7799 - DNA, 201 bp, Homo sapiens; identical to SEQ ID NO: 7773

SEQ ID NO: 7800 - DNA, 201 bp, Homo sapiens; identical to SEQ ID NO: 7775

SEQ ID NO: 7801 - DNA, 201 bp, Homo sapiens; identical to SEQ ID NO: 7776
  misc_feature (1)...(201): n = A,T,C or G, or insertion/deletion polymorphism (see Tables 1-2)

SEQ ID NO: 7802 - DNA, 201 bp, Homo sapiens; identical to SEQ ID NO: 7777
  misc_feature (1)...(201): n = A,T,C or G, or insertion/deletion polymorphism (see Tables 1-2)

SEQ ID NO: 7803 - DNA, 201 bp, Homo sapiens; identical to SEQ ID NO: 7778

SEQ ID NO: 7804 - DNA, 201 bp, Homo sapiens; identical to SEQ ID NO: 7779

SEQ ID NO: 7805 - DNA, 201 bp, Homo sapiens; identical to SEQ ID NO: 7780

SEQ ID NO: 7806 - DNA, 201 bp, Homo sapiens; identical to SEQ ID NO: 7781

SEQ ID NO: 7807 - DNA, 201 bp, Homo sapiens
tagagaaaatgttccaaagtctggcacgccccagcttcctagtaatagaggaggagacatttctaaaatcgcacccagaactgtctacaccaagagcaaakattcgactgtcaatcacactttgacttgcaccaaaataccacctatgaactatgtgtcaaagaggctgccattcgctgcaaggttgaacacccccatggg

SEQ ID NO: 7808 - DNA, 201 bp, Homo sapiens; identical to SEQ ID NO: 7757

SEQ ID NO: 7809 - DNA, 153 bp, Homo sapiens; identical to SEQ ID NO: 7758

SEQ ID NO: 7810 - DNA, 201 bp, Homo sapiens; identical to SEQ ID NO: 7759

SEQ ID NO: 7811 - DNA, 201 bp, Homo sapiens; identical to SEQ ID NO: 7760

SEQ ID NO: 7812 - DNA, 201 bp, Homo sapiens; identical to SEQ ID NO: 7761
  misc_feature (1)...(201): n = A,T,C or G, or insertion/deletion polymorphism (see Tables 1-2)

SEQ ID NO: 7813 - DNA, 201 bp, Homo sapiens; identical to SEQ ID NO: 7762

SEQ ID NO: 7814 - DNA, 201 bp, Homo sapiens; identical to SEQ ID NO: 7763

SEQ ID NO: 7815 - DNA, 201 bp, Homo sapiens; identical to SEQ ID NO: 7764

SEQ ID NO: 7816 - DNA, 201 bp, Homo sapiens; identical to SEQ ID NO: 7765

SEQ ID NO: 7817 - DNA, 201 bp, Homo sapiens; identical to SEQ ID NO: 7766

SEQ ID NO: 7818 - DNA, 201 bp, Homo sapiens; identical to SEQ ID NO: 7767

SEQ ID NO: 7819 - DNA, 201 bp, Homo sapiens; identical to SEQ ID NO: 7768
  misc_feature (1)...(201): n = A,T,C or G, or insertion/deletion polymorphism (see Tables 1-2)

SEQ ID NO: 7820 - DNA, 201 bp, Homo sapiens; identical to SEQ ID NO: 7769

SEQ ID NO: 7821 - DNA, 201 bp, Homo sapiens; identical to SEQ ID NO: 7770
  misc_feature (1)...(201): n = A,T,C or G, or insertion/deletion polymorphism (see Tables 1-2)

SEQ ID NO: 7822 - DNA, 201 bp, Homo sapiens; identical to SEQ ID NO: 7771
  misc_feature (1)...(201): n = A,T,C or G, or insertion/deletion polymorphism (see Tables 1-2)

SEQ ID NO: 7823 - DNA, 201 bp, Homo sapiens; identical to SEQ ID NO: 7772

SEQ ID NO: 7824 - DNA, 201 bp, Homo sapiens; identical to SEQ ID NO: 7773

SEQ ID NO: 7825 - DNA, 201 bp, Homo sapiens
ggcacgccccagcttcctagtaatagaggaggagacatttctaaaatcgcacccagaactgtctacaccaagagcaaagattcgactgtcaatcacacttwgacttgcaccaaaataccacctatgaactatgtgtcaaagaggctgccattcgctgcaaggttgaacacccccatgggccctggacgaactgtcgtcgtt

SEQ ID NO: 7826 - DNA, 201 bp, Homo sapiens; identical to SEQ ID NO: 7775

SEQ ID NO: 7827 - DNA, 107 bp, Homo sapiens; identical to SEQ ID NO: 7774

SEQ ID NO: 7828 - DNA, 201 bp, Homo sapiens; identical to SEQ ID NO: 7776
  misc_feature (1)...(201): n = A,T,C or G, or insertion/deletion polymorphism (see Tables 1-2)

SEQ ID NO: 7829 - DNA, 201 bp, Homo sapiens; identical to SEQ ID NO: 7777
  misc_feature (1)...(201): n = A,T,C or G, or insertion/deletion polymorphism (see Tables 1-2)

SEQ ID NO: 7830 - DNA, 201 bp, Homo sapiens; identical to SEQ ID NO: 7778

SEQ ID NO: 7831 - DNA, 201 bp, Homo sapiens; identical to SEQ ID NO: 7779

SEQ ID NO: 7832 - DNA, 201 bp, Homo sapiens; identical to SEQ ID NO: 7780

SEQ ID NO: 7833 - DNA, 201 bp, Homo sapiens
ttacaaagtacccaagcatctagtctggaactgacagagataagtagagaaaatgttccaaagtctggcacgccccagcttcctagtaatagaggaggagrcatttctaaaatcgcacccagaactgtctacaccaagagcaaagattcgactgtcaatcacactttgacttgcaccaaaataccacctatgaactatgtg

SEQ ID NO: 7834 - DNA, 201 bp, Homo sapiens
aaatcgcacccagaactgtctacaccaagagcaaagattcgactgtcaatcacactttgacttgcaccaaaataccacctatgaactatgtgtcaaagagsctgccattcgctgcaaggttgaacacccccatgggccctggacgaactgtcgtcgttaaaggagaagtgaatgcaaatgccaaaagctttaatgttgacc

SEQ ID NO: 7835 - DNA, 201 bp, Homo sapiens; identical to SEQ ID NO: 7757

SEQ ID NO: 7836 - DNA, 153 bp, Homo sapiens; identical to SEQ ID NO: 7758

SEQ ID NO: 7837 - DNA, 201 bp, Homo sapiens; identical to SEQ ID NO: 7761
  misc_feature (1)...(201): n = A,T,C or G, or insertion/deletion polymorphism (see Tables 1-2)

SEQ ID NO: 7838 - DNA, 201 bp, Homo sapiens; identical to SEQ ID NO: 7759

SEQ ID NO: 7839 - DNA, 201 bp, Homo sapiens; identical to SEQ ID NO: 7760

SEQ ID NO: 7840 - DNA, 201 bp, Homo sapiens; identical to SEQ ID NO: 7764

SEQ ID NO: 7841 - DNA, 201 bp, Homo sapiens; identical to SEQ ID NO: 7762

SEQ ID NO: 7842 - DNA, 201 bp, Homo sapiens; identical to SEQ ID NO: 7763

SEQ ID NO: 7843 - DNA, 201 bp, Homo sapiens; identical to SEQ ID NO: 7765

SEQ ID NO: 7844 - DNA, 201 bp, Homo sapiens; identical to SEQ ID NO: 7768
  misc_feature (1)...(201): n = A,T,C or G, or insertion/deletion polymorphism (see Tables 1-2)

SEQ ID NO: 7845 - DNA, 201 bp, Homo sapiens; identical to SEQ ID NO: 7766

SEQ ID NO: 7846 - DNA, 201 bp, Homo sapiens; identical to SEQ ID NO: 7767

SEQ ID NO: 7847 - DNA, 201 bp, Homo sapiens; identical to SEQ ID NO: 7769

SEQ ID NO: 7848 - DNA, 201 bp, Homo sapiens; identical to SEQ ID NO: 7770
  misc_feature (1)...(201): n = A,T,C or G, or insertion/deletion polymorphism (see Tables 1-2)

SEQ ID NO: 7849 - DNA, 201 bp, Homo sapiens; identical to SEQ ID NO: 7771
  misc_feature (1)...(201): n = A,T,C or G, or insertion/deletion polymorphism (see Tables 1-2)

SEQ ID NO: 7850 - DNA, 201 bp, Homo sapiens; identical to SEQ ID NO: 7772

SEQ ID NO: 7851 - DNA, 201 bp, Homo sapiens
  misc_feature (1)...(201): n = A,T,C or G, or insertion/deletion polymorphism (see Tables 1-2)
cagagataagtagagaaaatgttccaaagtctggcacgccccagcttgcagactgtctctcccctcctgggatttacagggtcatggctctgaaacattcngtagtgttctttggacacgagttttccctggagatcgctttctgcaggcctcttggtcctgactgtggcttcttttcagaggctgccattcgctgcaagg

SEQ ID NO: 7852 - DNA, 201 bp, Homo sapiens; identical to SEQ ID NO: 7773

SEQ ID NO: 7853 - DNA, 181 bp, Homo sapiens
tggacttggatccgaggcagacgaggaagctgagaaaaccctggcgttgaccccgtggacctgggcgccccgggaaggccrgcgcttggtccaggcaggcggggcctgtgcggtgaccaccctggtcctgaaaagtcccagccccgagcgccctccctcctagacctggaggcctggaaca

SEQ ID NO: 7854 - DNA, 201 bp, Homo sapiens; identical to SEQ ID NO: 7775

SEQ ID NO: 7855 - DNA, 201 bp, Homo sapiens; identical to SEQ ID NO: 7776
  misc_feature (1)...(201): n = A,T,C or G, or insertion/deletion polymorphism (see Tables 1-2)

SEQ ID NO: 7856 - DNA, 201 bp, Homo sapiens; identical to SEQ ID NO: 7777
  misc_feature (1)...(201): n = A,T,C or G, or insertion/deletion polymorphism (see Tables 1-2)

SEQ ID NO: 7857 - DNA, 201 bp, Homo sapiens; identical to SEQ ID NO: 7778

SEQ ID NO: 7858 - DNA, 201 bp, Homo sapiens; identical to SEQ ID NO: 7779

SEQ ID NO: 7859 - DNA, 201 bp, Homo sapiens; identical to SEQ ID NO: 7780

SEQ ID NO: 7860 - DNA, 201 bp, Homo sapiens
gggatttacagggtcatggctctgaaacattccgtagtgttctttggacacgagttttccctggagatcgctttctgcaggcctcttggtcctgactgtgscttcttttcagaggctgccattcgctgcaaggttgaacacccccatgggccctggacgaactgtcgtcgttaaaggagaagtgaatgcaaatgccaaaag

SEQ ID NO: 7861 - DNA, 201 bp, Homo sapiens
gagataagtagagaaaatgttccaaagtctggcacgccccagcttgcagactgtctctcccctcctgggatttacagggtcatggctctgaaacattccgkagtgttctttggacacgagttttccctggagatcgctttctgcaggcctcttggtcctgactgtggcttcttttcagaggctgccattcgctgcaaggtt

SEQ ID NO: 7862 - DNA, 201 bp, Homo sapiens
ttacaaagtacccaagcatctagtctggaactgacagagataagtagagaaaatgttccaaagtctggcacgccccagcttgcagactgtctctcccctcstgggatttacagggtcatggctctgaaacattccgtagtgttctttggacacgagttttccctggagatcgctttctgcaggcctcttggtcctgactgt

SEQ ID NO: 7863 - DNA, 201 bp, Homo sapiens
catggctctgaaacattccgtagtgttctttggacacgagttttccctggagatcgctttctgcaggcctcttggtcctgactgtggcttcttttcagagsctgccattcgctgcaaggttgaacacccccatgggccctggacgaactgtcgtcgttaaaggagaagtgaatgcaaatgccaaaagctttaatgttgacc

SEQ ID NO: 7864 - DNA, 201 bp, Homo sapiens
cattcccgatcagctggatcctggaactttgattgtgatatgtgggcatgttcctagtgacgcagacagattccaggtggatctgcagaatggcagcagtrtgaaacctcgagccgatgtggcctttcatttcaatcctcgtttcaaaagggccggctgcattgtttgcaatactttgataaatgaaaaatggggacggga

SEQ ID NO: 7865 - DNA, 201 bp, Homo sapiens
ggtcatacacagaagagactccaatcgacaagaagctggaaaagaatgatgttgtccttaaacaacctacagaatatcatctataacccggtaatcccgtwtgttggcaccattcccgatcagctggatcctggaactttgattgtgatatgtgggcatgttcctagtgacgcagacagattccaggtggatctgcagaat

SEQ ID NO: 7866 - DNA, 201 bp, Homo sapiens
gactccaatcgacaagaagctggaaaagaatgatgttgtccttaaacaacctacagaatatcatctataacccggtaatcccgtatgttggcaccattccygatcagctggatcctggaactttgattgtgatatgtgggcatgttcctagtgacgcagacagattccaggtggatctgcagaatggcagcagtgtgaaac

SEQ ID NO: 7867 - DNA, 201 bp, Homo sapiens
gttgtccttaaacaacctacagaatatcatctataacccggtaatcccgtatgttggcaccattcccgatcagctggatcctggaactttgattgtgataygtgggcatgttcctagtgacgcagacagattccaggtggatctgcagaatggcagcagtgtgaaacctcgagccgatgtggcctttcatttcaatcctcg

SEQ ID NO: 7868 - DNA, 201 bp, Homo sapiens
gggatttacagggtcatggctctgaaacattctgtagtgttctttggacacgagttttcctggagatcgctttctgcaggcctattggtctgactgtggcstcttttcagagcctgccattcgctgcaaggttgaacacccccatgggccctggacgaactgtcgtcgttaaaggagaagtgaatgcaaatgccaaaagct

SEQ ID NO: 7869 - DNA, 201 bp, Homo sapiens
  misc_feature (1)...(201): n = A,T,C or G, or insertion/deletion polymorphism (see Tables 1-2)
tctcttgagcttcgactcttctgtgctctattgctgcgcactgctttttctacaggcattacatcaactcctaaggggtcctctgggattagttaagcagntattaaatcacccgaagacactaatttacagaagacacaactccttccccagtgatcactgtcataaccagtgctctaccgtatcccatcactgaggact

SEQ ID NO: 7870 - DNA, 201 bp, Homo sapiens
cctgttctcttgagcttcgactcttctgtgctctattgctgcgcactgctttttctacaggcattacatcaactcctaaggggtcctctgggattagttawgcagctattaaatcacccgaagacactaatttacagaagacacaactccttccccagtgatcactgtcataaccagtgctctaccgtatcccatcactga

SEQ ID NO: 7871 - DNA, 201 bp, Homo sapiens
  misc_feature (1)...(201): n = A,T,C or G, or insertion/deletion polymorphism (see Tables 1-2)
agattttttttggtaaaactgtgaggagctaggatatatacttggtgaaacaaaccagtatgttccctgttctcttgagcttcgactcttctgtgctctantgctgcgcactgctttttctacaggcattacatcaactcctaaggggtcctctgggattagttaagcagctattaaatcacccgaagacactaatttaca

SEQ ID NO: 7872 - DNA, 201 bp, Homo sapiens
  misc_feature (1)...(201): n = A,T,C or G, or insertion/deletion polymorphism (see Tables 1-2)
gcacagattttttttggtaaaactgtgaggagctaggatatatacttggtgaaacaaaccagtatgttccctgttctcttgagcttcgactcttctgtgcnctattgctgcgcactgctttttctacaggcattacatcaactcctaaggggtcctctgggattagttaagcagctattaaatcacccgaagacactaatt

SEQ ID NO: 7873 - DNA, 201 bp, Homo sapiens
ccttgctgaaacgcatctcactgtcattctattgtttatattgttaaaatgagcttgtgcaccattagatcctgctgggtgttctcagtccttgccatgamgtatggtggtgtctagcactgaatggggaaactgggggcagcaacacttatagccagttaaagccactctgccctctctcctactttggctgactcttca

SEQ ID NO: 7874 - DNA, 201 bp, Homo sapiens
tttgcaatactttgataaatgaaaaatggggacgggaagagatcacctatgacacgcctttcaaaagagaaaagtcttttgagatcgtgattatggtgctraaggacaaattccaggtggctgtaaatggaaaacatactctgctctatggccacaggatcggcccagagaaaatagacactctgggcatttatggcaaag

SEQ ID NO: 7875 - DNA, 201 bp, Homo sapiens; identical to SEQ ID NO: 7763

SEQ ID NO: 7876 - DNA, 201 bp, Homo sapiens
ggacgcctgaaacaccagtctttggggccagtgcctcagtttcaatccaggtaacctttaaatgaaacttgcctaaaatcttaggtcatacacagaagagkctccaatcgacaagaagctggaaaagaatgatgttgtccttaaacaacctacagaatatcatctataacccggtaatcccgtatgttggcaccattcccg

SEQ ID NO: 7877 - DNA, 201 bp, Homo sapiens; identical to SEQ ID NO: 7766

SEQ ID NO: 7878 - DNA, 201 bp, Homo sapiens
aatactttgataaatgaaaaatggggacgggaagagatcacctatgacacgcctttcaaaagagaaaagtcttttgagatcgtgattatggtgctaaaggmcaaattccaggtggctgtaaatggaaaacatactctgctctatggccacaggatcggcccagagaaaatagacactctgggcatttatggcaaagtgaat

SEQ ID NO: 7879 - DNA, 201 bp, Homo sapiens
ccattcccgatcagctggatcctggaactttgattgtgatatgtgggcatgttcctagtgacgcagacagattccaggtggatctgcagaatggcagcagygtgaaacctcgagccgatgtggcctttcatttcaatcctcgtttcaaaagggccggctgcattgtttgcaatactttgataaatgaaaaatggggacggg

SEQ ID NO: 7880 - DNA, 201 bp, Homo sapiens
cccatcactgaggactgatgttgactgacatcattttatcgtaataaacatgtggctctattagctgcaagctttaccaagtaattggcatgacatctgaycacagaaattaaggcaaaaaaccaaagcaaaacaaatacatggtgctgaaattaacttgatgccaagcccaaggcagctgatttctgtgtatttgaactt

SEQ ID NO: 7881 - DNA, 201 bp, Homo sapiens
gactcttcaagaatgccattcaacaagtatttatggagtacctactataatacagtagctaacatgtattgagcacagattttttttggtaaaactgtgaygagctaggatatatacttggtgaaacaaaccagtatgttccctgttctcttgagcttcgactcttctgtgctctattgctgcgcactgctttttctacag

SEQ ID NO: 7882 - DNA, 201 bp, Homo sapiens
tgtaggaggctgggagaatgagaccatcgtgcagcggtttaaggagtatgcagatgtgctcttccagaggctgggagacaaggtgaagttttggatcacgytgaatgagccctttgtcattgcttaccagggctatggctacggaacagcagctccaggagtctccaataggcctggcactgccccctacattgttggcca

SEQ ID NO: 7883 - DNA, 201 bp, Homo sapiens
ccttcggggacctagttgggatctggttcaccttcagtgacttggaggaagtgatcaaggagcttccccaccaggaatcaagagcgtcacaactccagacyctcagtgatgcccacagaaaagcctatgagatttaccacgaaagctatgcttttcagggcggaaaactctctgttgtcctgcgagctgaagatatcccgg

SEQ ID NO: 7884 - DNA, 201 bp, Homo sapiens
actgcccactttcctgccagaatacttcagcagtctccatgccagtcagatcacccattataaggtatttctgtcatgggcacagctcctcccagcaggargcacccagaatccagacgagaaaacagtgcagtgctaccggcgactcctcaaggccctcaagactgcacggcttcagcccatggtcatcctgcaccacca

SEQ ID NO: 7885 - DNA, 201 bp, Homo sapiens
ctcacacaccactgagggttgagaacgatgccattggagacgtggcctgtgacagttatcacaagattgctgaggatctggtcaccctgcagaacctgggygtgtcccactaccgtttttccatctcctggtctcgcatcctccctgatggaaccaccaggtacatcaatgaagcgggcctgaactactacgtgaggctca

SEQ ID NO: 7886 - DNA, 201 bp, Homo sapiens
gcctggcactgccccctacattgttggccacaatctaataaaggctcatgctgaggcctggcatctgtacaacgatgtgtaccgcgccagtcaaggtggcrtgatttccatcaccatcagcagtgactgggctgaacccagagatccctctaaccaggaggatgtggaggcagccaggagatatgttcagttcatgggagg

SEQ ID NO: 7887 - DNA, 201 bp, Homo sapiens
atgcttttcagggcggaaaactctctgttgtcctgcgagctgaagatatcccggagctcctgctagaaccacccatatctgcgcttgcccaggacacggtsgatttcctctctcttgatttgtcttatgaatgccaaaatgaggcaagtctgcggcagaagctgagtaaattgcagaccattgagccaaaagtgaaagttt

SEQ ID NO: 7888 - DNA, 201 bp, Homo sapiens
cagaatacttcagcagtctccatgccagtcagatcacccattataaggtatttctgtcatgggcacagctcctcccagcaggaagcacccagaatccagaygagaaaacagtgcagtgctaccggcgactcctcaaggccctcaagactgcacggcttcagcccatggtcatcctgcaccaccagaccctccctgccagca

SEQ ID NO: 7889 - DNA, 201 bp, Homo sapiens
ttcgccttccactccttcggggacctagttgggatctggttcaccttcagtgacttggaggaagtgatcaaggagcttccccaccaggaatcaagagcgtyacaactccagaccctcagtgatgcccacagaaaagcctatgagatttaccacgaaagctatgcttttcagggcggaaaactctctgttgtcctgcgagct

SEQ ID NO: 7890 - DNA, 201 bp, Homo sapiens
  misc_feature (1)...(201): n = A,T,C or G, or insertion/deletion polymorphism (see Tables 1-2)
aagcatgtcttgttctctgactggcagcctggcccttcagcctgaccagcagcaggaccacgagaccacggactcctctcctgcctctgcctatcagagantctgggaagcatttgccaatcagtccagggcggaaagggatgccttcctgcaggatactttccctgaaggcttcctctggggtgcctccacaggagcctt

SEQ ID NO: 7891 - DNA, 201 bp, Homo sapiens
gggaaaacacaacgaagccaacaggaattgagcccggtgtcttcattctgatgagttaccacctcaagttctatgaagcaggcctagtttcttcatctatstttaccggccaccaaacaccttagggtcttagactctgctgatactggacttctccataaagtcctgctgcaccgttagagatgactttaatcttgaatg

SEQ ID NO: 7892 - DNA, 201 bp, Homo sapiens
aggggtgagcatctgggatccacgcaggcccctgaacaccactgagggccaagcgacgctggaggtggccagcgacagttaccacaaggtagcctctgacrtcgccctgctttgcggcctccgggctcaggtgtacaagttctccatctcctggtcccggatcttccccatggggcacgggagcagccccagcctcccagg

SEQ ID NO: 7893 - DNA, 201 bp, Homo sapiens
atcatggtggatggcagaatgagagcgtggtggatgccttcctggactatgcggccttctgcttctccacatttggggaccgtgtgaagctgtgggtgacyttccatgagccgtgggtgatgagctacgcaggctatggcaccggccagcaccctcccggcatctctgacccaggagtggcctcttttaaggtggctcact

SEQ ID NO: 7894 - DNA, 201 bp, Homo sapiens
ggaatcaagagcgtcacaactccagaccctcagtgatgcccacagaaaagcctatgagatttaccacgaaagctatgcttttcagggcggaaaactctctrttgtcctgcgagctgaagatatcccggagctcctgctagaaccacccatatctgcgcttgcccaggacacggtcgatttcctctctcttgatttgtctta

SEQ ID NO: 7895 - DNA, 201 bp, Homo sapiens
  misc_feature (1)...(201): n = A,T,C or G, or insertion/deletion polymorphism (see Tables 1-2)
tcgccctgctttgcggcctccgggctcaggtgtacaagttctccatctcctggtcccggatcttccccatggggcacgggagcagccccagcctcccaggngttgcctactacaacaagctgattgacaggctacaggatgcgggcatcgagcccatggccacgctgttccactgggacctgcctcaggccctgcaggatc

SEQ ID NO: 7896 - DNA, 201 bp, Homo sapiens
atgccttcctggactatgcggccttctgcttctccacatttggggaccgtgtgaagctgtgggtgaccttccatgagccgtgggtgatgagctacgcaggstatggcaccggccagcaccctcccggcatctctgacccaggagtggcctcttttaaggtggctcacttggtcctcaaggctcatgccagaacttggcacc

SEQ ID NO: 7897 - DNA, 201 bp, Homo sapiens
  misc_feature (1)...(201): n = A,T,C or G, or insertion/deletion polymorphism (see Tables 1-2)
agagatccctctaaccaggaggatgtggaggcagccaggagatatgttcagttcatgggaggctggtttgcacatcctattttcaagaatggagattacantgaggtgatgaagacgcggatccgtgacaggagcttggctgcaggcctcaacaagtctcggctgccagaatttacagagagtgagaagaggaggatcaac

SEQ ID NO: 7898 - DNA, 201 bp, Homo sapiens
tccccaaagcatcagcgaagttctacgcctctgtggtccgatgcaatggcttccctgaccccgctacagggcctcacgcttgtctccaccagccagatgcyggacccaccatcagccccgtgagacaggaggaggtgcagttcctggggctaatgctcggcaccacagaagcacagacagctttgtacgttctcttttctc

SEQ ID NO: 7899 - DNA, 201 bp, Homo sapiens
cctgtgctgatatctgaaaactgcccagagaactgctccattcataccaaaaccaaatacacctattactatggaaagagaaagaagatctccaagccccscatcggggaaagcaaccccgacagcggacaccccaaacccgccaggcggaggaagcgacggaaatccattttcgtgcagaagaaacggaggtcttctgcc

SEQ ID NO: 7900 - DNA, 110 bp, Homo sapiens
cccttccgacggtgcaggagtgcatggagctgaagctggggcctgccatcaagttatgccaccagatcgagagagtcaaagtggctttctacgcccagtaygccaactga

SEQ ID NO: 7901 - DNA, 201 bp, Homo sapiens
ggctggtgtgaagccaattcttatcctttgactgcaccacacaaaacagtctcacaaaagaagagaaagattgcagtcgtgcaaccagagaaacaattgcygcccacagtgcctgttaagaaaatacctcatgacctttgtttattccctcacctggacaccacaggaaccgtcaacgggaaatactgctgtcctcagctc

SEQ ID NO: 7902 - DNA, 201 bp, Homo sapiens
ggatgaagcttgagacagtgaatatgtgcgagcccttttacatctctcctgcgtcggtgactaaggtttttaacaatcacttttttcaagtgactattgaygacctaagacctgaaccaagtaaactgtcaatgctgtgccatgcagattctttggggattttgccagtacagtggtgccttaaaaatggagtcagcctca

SEQ ID NO: 7903 - DNA, 201 bp, Homo sapiens
ggaggaagattacgccttcgctatgtgggattggaggacactgaatcctatgaccagtggttgttttacttggattacagacttcgaccagttggttggtktcaagagaataaatacagaatggacccaccttcagaaatctatcctttgaagatggcctctgaatggaaatgtactctggaaaaatcccttattgatgct

SEQ ID NO: 7904 - DNA, 201 bp, Homo sapiens
tttgtttagtcctgtgctgatatctgaaaactgcccagagaactgctccattcataccaaaaccaaatacacctattactatggaaagagaaagaagatckccaagccccccatcggggaaagcaaccccgacagcggacaccccaaacccgccaggcggaggaagcgacggaaatccattttcgtgcagaagaaacggag

SEQ ID NO: 7905 - DNA, 201 bp, Homo sapiens
gagaaagccgcctccgctggaggcccggtgtggttccgcctcggcgaggaaaagttattgtcagataccgctctttctccaactttccctctttctctgcsatcacacttgggccttcactgcagcgtggtgtggccaccgtccgtgtcctctcggccttcctccgagtccaggtggactctgtggatgtgtggatgtggc

SEQ ID NO: 7906 - DNA, 201 bp, Homo sapiens
tgcacacagcctggcaccccgtggacaatgtcattgccgtggctgccaccaataacttgtacatattccaggacaaaatcaactagagacgcgaacgtgasgaccaagtcttgtcttgcatagttaagccggacatttttctgtcagagaaaaggcatcattgtccgctccattaagaacagtgacgcacctgctacttcc

SEQ ID NO: 7907 - DNA, 201 bp, Homo sapiens
gccggtggagacccaccaggtccacgagtacctgcgcagcaagctctgctctctctatgagaacgactgcatctttgacaagtttgagtgttgctggaacrgttcggatagcgccatcatgaccgggtcctataacaacttcttcaggatgtttgatagagacacgcggagggatgtgaccctggaggcctcgagagagag

SEQ ID NO: 7908 - DNA, 201 bp, Homo sapiens
acagacactccaagttttttgaagagcctgaagatcccagcagtaggtccttcttctcagaaataatttcatccatatccgatgtaaaattcagtcatagkgggcggtacatgatgaccagagactacctgtcggtgaaggtgtgggacctcaacatggagagcaggccggtggagacccaccaggtccacgagtacctgc

SEQ ID NO: 7909 - DNA, 201 bp, Homo sapiens
tccgagccttcctttccaatttatagaccaaaaaattaacatccaagagaaaagttattgtcagataccgctctttctccaactttccctctttctctgcsatcacacttgggccttcactgcagcgtggtgtggccaccgtccgtgtcctctcggccttcctccgagtccaggtggactctgtggatgtgtggatgtggc

SEQ ID NO: 7910 - DNA, 201 bp, Homo sapiens; identical to SEQ ID NO: 7906

SEQ ID NO: 7911 - DNA, 201 bp, Homo sapiens; identical to SEQ ID NO: 7907

SEQ ID NO: 7912 - DNA, 201 bp, Homo sapiens; identical to SEQ ID NO: 7908

SEQ ID NO: 7913 - DNA, 160 bp, Homo sapiens
tcctcccacctcggcctcccaaaatgctgggaatacaagcatgagccatggcatgtggcygccacttgccttttttcattaagagtctataattggagatcttacagggaactgggctttctgctcagccatactcgagctcatttgacccccggccact

SEQ ID NO: 7914 - DNA, 201 bp, Homo sapiens; identical to SEQ ID NO: 7905

SEQ ID NO: 7915 - DNA, 201 bp, Homo sapiens; identical to SEQ ID NO: 7906

SEQ ID NO: 7916 - DNA, 201 bp, Homo sapiens
caagcatgagccatggcatgtggccgccacttgccttttttcattaagagtctataattggagatcttacagggaactgggctttctgctcagccatactygagctcatttgacccccggccactgccccttgagatcggacatcatttccaccgttgagtttaattactctggagatcttcttgcaacaggagacaaggg

SEQ ID NO: 7917 - DNA, 201 bp, Homo sapiens; identical to SEQ ID NO: 7907

SEQ ID NO: 7918 - DNA, 201 bp, Homo sapiens; identical to SEQ ID NO: 7908

SEQ ID NO: 7919 - DNA, 201 bp, Homo sapiens
cttttttcattaagagtctataattggagatcttacagggaactgggctttctgctcagccatactcgagctcatttgacccccggccactgccccttgaratcggacatcatttccaccgttgagtttaattactctggagatcttcttgcaacaggagacaagggcggcagagttgttatttttcagcgtgaacaagag

SEQ ID NO: 7920 - DNA, 201 bp, Homo sapiens; identical to SEQ ID NO: 7905

SEQ ID NO: 7921 - DNA, 201 bp, Homo sapiens; identical to SEQ ID NO: 7906

SEQ ID NO: 7922 - DNA, 201 bp, Homo sapiens; identical to SEQ ID NO: 7907

SEQ ID NO: 7923 - DNA, 201 bp, Homo sapiens; identical to SEQ ID NO: 7908

SEQ ID NO: 7924 - DNA, 201 bp, Homo sapiens
  misc_feature (1)...(201): n = A,T,C or G, or insertion/deletion polymorphism (see Tables 1-2)
gaagcatggctgcgacgtgggcccgacaggcgcctcctccgcaggtatgaacagttcgcctacgatggcaaggattacatcgccctgaacgaggacctgcnctcctggaccgccgcgaacacagcggctcagatctcccagcacaagtgggaagcggacaaatactcagagcaggtcagggcctacctgagggcaagtgca

SEQ ID NO: 7925 - DNA, 135 bp, Homo sapiens
agatgggagccgtcttctcagcccaccatccccatcgtgggcatcgttgctggcctgtttctccttggagctgtggtcactggagctgtggttgctgctgrgatgtggaggaagaaaagctcaggtagggaaggg

SEQ ID NO: 7926 - DNA, 201 bp, Homo sapiens
ggaagcggacaaatactcagagcaggtcagggcctacctgagggcaagtgcatggagtggctccgcagacacctggagaacgggaaggagacgctgcagcrcgcggatcccccaaaggcacatgtgacccagcaccccatctctgaccatgaggccaccctgaggtgctgggccctgggcctctaccctgcggagatcaca

SEQ ID NO: 7927 - DNA, 129 bp, Homo sapiens
gagccgtcttctcagcccaccatccccatcgtgggcatcgttgctggcctgtttctccttggagctgtggtcactggagctgtggttgctgctgcgatgtygaggaagaaaagctcaggtagggaaggg

SEQ ID NO: 7928 - DNA, 201 bp, Homo sapiens
ggccacgcgcagatttaccgagtgaacctgcggaccctgctccgctattacaaccagagcgaggccggccatggttctcacaccatccagaggaagcatgrctgcgacgtgggcccgacaggcgcctcctccgcaggtatgaacagttcgcctacgatggcaaggattacatcgccctgaacgaggacctgcactcctgga

SEQ ID NO: 7929 - DNA, 201 bp, Homo sapiens
gtaccctaaggagggacagagacaaaattcagggcttccaggcaaagggagaagctgatatcctggccgcgctgaagaagctccaggaccagaggcagtayattgtggctgagtttgagcagggtcatcagttcctgagggagcgggaggaacacctgctggaacagctggcgaagctggagcaggagctcacggagggca

SEQ ID NO: 7930 - DNA, 201 bp, Homo sapiens
gggtgcgcgctgctgtagttgccttccatggatctataggagagcaagtcctccaggagaagaagtcctcaccagtgaacggagacctctctgaactaagrataccatggccacgtcagccccactacggagcctggaagaggaggtgacctgctccatctgtcttgattacctgcgggaccctgtgaccattgactgtgg

SEQ ID NO: 7931 - DNA, 196 bp, Homo sapiens
ccggaacagaccgccgtgagagaggaggggcgccggccgggattcgcggcccggagctcgggaccggagtcaggaatggagagaagggtaatggtkttacctcttattgtggaaacctgttgagatcacagagaatatactgacggcataaaagggcagaaccatagcagggtgcgcgctgctgtagttgccttcc

SEQ ID NO: 7932 - DNA, 201 bp, Homo sapiens
acctgcagctgtcagaggactggaagtgcgtgacctacaccagcctgtacaagagtgcctacctgcacccccagcagtttgactgtgagcctggggtgctrggcagcaagggcttcacctggggcaaggtctactgggaagtggaagtggagagggagggctggtctgaggatgaagaagagggggatgaggaggaagagg

SEQ ID NO: 7933 - DNA, 201 bp, Homo sapiens
gggagtcccgggagcacaggccccacacggccgtcctcatggagaaggccgcccagccccacagggaaaaaatcctgaaccacctgagtaccctaaggagrgacagagacaaaattcagggcttccaggcaaagggagaagctgatatcctggccgcgctgaagaagctccaggaccagaggcagtacattgtggctgagt

SEQ ID NO: 7934 - DNA, 201 bp, Homo sapiens
agagggagggctggtctgaggatgaagaagagggggatgaggaggaagagggagaagaggaggaggaggaagaggaggccggctatggggatggatatgaygactgggaaacggacgaagatgaggaatcgttgggcgatgaagaggaagaagaggaggaggaagaggaggaagttctggaaagctgcatggtgggggtgg

SEQ ID NO: 7935 - DNA, 201 bp, Homo sapiens
tcccctgctccagccaaattgatctcccagtcttgtccttacccattccaagtgctctgccagcccctgttcatccaagttttaagtcctccaccctgtthtaagagactgttccaacggctctgggcctcagtggtcacttgaccaccattgtctcagagctgcccactttgtgtgtgtcacatgctgcctgagtcacat

SEQ ID NO: 7936 - DNA, 201 bp, Homo sapiens
tttaagaatccagaacatcttgctcttgatcagcacatccaaaaacaccaagacaaacatccagtggagcagaacctctcctgcctcgggagttctgaccrggttccccagcagggtgttaagcctctgtctctggccctaccagcatccaggttccactttcctaggagagagtggagatgggaagacagggaaaggaag

SEQ ID NO: 7937 - DNA, 201 bp, Homo sapiens
tctcccagtcttgtccttacccattccaagtgctctgccagcccctgttcatccaagttttaagtcctccaccctgttctaagagactgttccaacggctytgggcctcagtggtcacttgaccaccattgtctcagagctgcccactttgtgtgtgtcacatgctgcctgagtcacatgtacatcttatttctgcctcta

SEQ ID NO: 7938 - DNA, 201 bp, Homo sapiens
agagaagggtaatggttttacctcttattgtggaaacctgttgagatcacagagaatatactgacggcataaaagggcagaaccatagcagggtgcgcgcygctgtagttgccttccatggatctataggagagcaagtcctccaggagaagaagtcctcaccagtgaacggagacctctctgaactaagaataccatggc

SEQ ID NO: 7939 - DNA, 201 bp, Homo sapiens
ctaagagactgttccaacggctctgggcctcagtggtcacttgaccaccattgtctcagagctgcccactttgtgtgtgtcacatgctgcctgagtcacaygtacatcttatttctgcctctagttttgtaagctcctggagggcggataacatcttatactactcttgtattctcatggcacctagtgcagtgctgggca

SEQ ID NO: 7940 - DNA, 201 bp, Homo sapiens
ccctggtcatctccgaactggagggcaaggcgcagcagccagctgcagagctcatgcaggacacgagagacttcctaaacaggtatccacggaagaagttytgggttgggaaacccattgctcgagtggttaaaaaaaagaccggagaattctcagataaactcctctctctgcaacgaggcctgagggaattccagggga

SEQ ID NO: 7941 - DNA, 201 bp, Homo sapiens; identical to SEQ ID NO: 7929

SEQ ID NO: 7942 - DNA, 201 bp, Homo sapiens; identical to SEQ ID NO: 7930

SEQ ID NO: 7943 - DNA, 130 bp, Homo sapiens
gagtcaggaatggagagaagggtaatggtkttacctcttattgtggaaacctgttgagatcacagagaatatactgacggcataaaagggcagaaccatagcagggtgcgcgctgctgtagttgccttcc

SEQ ID NO: 7944 - DNA, 201 bp, Homo sapiens; identical to SEQ ID NO: 7932

SEQ ID NO: 7945 - DNA, 201 bp, Homo sapiens; identical to SEQ ID NO: 7933

SEQ ID NO: 7946 - DNA, 201 bp, Homo sapiens; identical to SEQ ID NO: 7934

SEQ ID NO: 7947 - DNA, 201 bp, Homo sapiens; identical to SEQ ID NO: 7935

SEQ ID NO: 7948 - DNA, 201 bp, Homo sapiens; identical to SEQ ID NO: 7936

SEQ ID NO: 7949 - DNA, 201 bp, Homo sapiens; identical to SEQ ID NO: 7937

SEQ ID NO: 7950 - DNA, 201 bp, Homo sapiens; identical to SEQ ID NO: 7939

SEQ ID NO: 7951 - DNA, 201 bp, Homo sapiens; identical to SEQ ID NO: 7938

SEQ ID NO: 7952 - DNA, 201 bp, Homo sapiens; identical to SEQ ID NO: 7940

SEQ ID NO: 7953 - DNA, 201 bp, Homo sapiens; identical to SEQ ID NO: 7929

SEQ ID NO: 7954 - DNA, 201 bp, Homo sapiens
ttcccagcgctgctgtagttgccttccatggatctataggagagcaagtcctccaggagaagaagtcctcaccagtgaacggagacctctctgaactaagrataccatggccacgtcagccccactacggagcctggaagaggaggtgacctgctccatctgtcttgattacctgcgggaccctgtgaccattgactgtgg

SEQ ID NO: 7955 - DNA, 201 bp, Homo sapiens; identical to SEQ ID NO: 7932

SEQ ID NO: 7956 - DNA, 201 bp, Homo sapiens; identical to SEQ ID NO: 7933

SEQ ID NO: 7957 - DNA, 201 bp, Homo sapiens; identical to SEQ ID NO: 7934

SEQ ID NO: 7958 - DNA, 201 bp, Homo sapiens
acaagcccaccagccaaattgatctcccagtcttgtccttacccattccaagtgctctgccagcccctgttcatccaagttttaagtcctccaccctgtthtaagagactgttccaacggctctgggcctcagtggtcacttgaccaccattgtctcagagctgcccactttgtgtgtgtcacatgctgcctgagtcacat

SEQ ID NO: 7959 - DNA, 201 bp, Homo sapiens; identical to SEQ ID NO: 7936

SEQ ID NO: 7960 - DNA, 201 bp, Homo sapiens; identical to SEQ ID NO: 7937

SEQ ID NO: 7961 - DNA, 201 bp, Homo sapiens
gaggggcgccggccgggattcgcggcccggagctcgggaccggttgcttcattccagcctcgcagtcacctctgtgccctgctggttgtcttcccagcgcygctgtagttgccttccatggatctataggagagcaagtcctccaggagaagaagtcctcaccagtgaacggagacctctctgaactaagaataccatggc

SEQ ID NO: 7962 - DNA, 201 bp, Homo sapiens; identical to SEQ ID NO: 7939

SEQ ID NO: 7963 - DNA, 201 bp, Homo sapiens; identical to SEQ ID NO: 7940

SEQ ID NO: 7964 - DNA, 201 bp, Homo sapiens; identical to SEQ ID NO: 7929

SEQ ID NO: 7965 - DNA, 201 bp, Homo sapiens; identical to SEQ ID NO: 7954

SEQ ID NO: 7966 - DNA, 201 bp, Homo sapiens; identical to SEQ ID NO: 7933

SEQ ID NO: 7967 - DNA, 201 bp, Homo sapiens; identical to SEQ ID NO: 7961

SEQ ID NO: 7968 - DNA, 201 bp, Homo sapiens
ttgctcccagaagagaatcagatcatcatgtggggattaccattgttcctggagtactcctacccttagttgaatttccttattaaagttatatttttctrtaagaccctgacatatgtatgttacttataatctgtcttattccaaaaggaatttaaatgagtttccagagatatatttatatgaaaaagaaaaggggga

SEQ ID NO: 7969 - DNA, 201 bp, Homo sapiens
aacaaaaagcaattgtaagtattgccatactatttaaatctatttggttcctgagtttaggttaagaaaaactaggaatttggatagtgagacatttaacrgaaattttaaccagatctctttagcatataaatttggacaacaaaaaatctgatactaagtaatgccactaagtgatcactataggtgagtattttatta

SEQ ID NO: 7970 - DNA, 201 bp, Homo sapiens
tgcctatgtcggtggaggaagggcctgagtgccagggacctgtggttgacaggcgctgccctcgatgtggtcatgaaggaatggcataccacaccagacaratgcgttcagccgatgaagggcaaactgtcttctacacctgtaccaactgcaagttccaggagaaggaagactcttgacctttttcctgggcaactctac

SEQ ID NO: 7971 - DNA, 201 bp, Homo sapiens
gtctgggaattccgggcgtttcggctccttggtcgcagaggcaggaggcacccgaccgcatgtctgtcatggacctcgccaatacttgctccagctttcaktcggacctggatttctgttcagattgcggctcggtcctgcctctgcccggggctcaggatacggtcacctgtattcgctgtggcttcaacatcaacgttc

SEQ ID NO: 7972 - DNA, 201 bp, Homo sapiens
agatgcgttcagccgatgaagggcaaactgtcttctacacctgtaccaactgcaagttccaggagaaggaagactcttgacctttttcctgggcaactctrcagtccctccctcctttcggaaggtgaaggatactgggtttttagatgccttgtccatcctgtctggttgcaatgttttgctcccagaagagaatcagat

SEQ ID NO: 7973 - DNA, 201 bp, Homo sapiens
ctgtcttctacacctgtaccaactgcaagttccaggagaaggaagactcttgacctttttcctgggcaactctacagtccctccctcctttcggaaggtgmaggatactgggtttttagatgccttgtccatcctgtctggttgcaatgttttgctcccagaagagaatcagatcatcatgtggggattaccattgttcct

SEQ ID NO: 7974 - DNA, 201 bp, Homo sapiens
atttccttattaaagttatatttttctataagaccctgacatatgtatgttacttataatctgtcttattccaaaaggaatttaaatgagtttccagagawatatttatatgaaaaagaaaagggggaaaaattaggacaaaaaagtagagtcaggaatgaggctaatataaacaaaaagcaattgtaagtattgccatac

SEQ ID NO: 7975 - DNA, 201 bp, Homo sapiens; identical to SEQ ID NO: 7968

SEQ ID NO: 7976 - DNA, 201 bp, Homo sapiens; identical to SEQ ID NO: 7969

SEQ ID NO: 7977 - DNA, 201 bp, Homo sapiens; identical to SEQ ID NO: 7970

SEQ ID NO: 7978 - DNA, 201 bp, Homo sapiens
gcgtttcggctccttggtcgcagaggcaggaggcgtgcgtggcaggaggacccgaccgcatgtctgtcatggacctcgccaatacttgctccagctttcaktcggacctggatttctgttcagattgcggctcggtcctgcctctgcccggggctcaggatacggtcacctgtattcgctgtggcttcaacatcaacgttc

SEQ ID NO: 7979 - DNA, 201 bp, Homo sapiens; identical to SEQ ID NO: 7972

SEQ ID NO: 7980 - DNA, 201 bp, Homo sapiens; identical to SEQ ID NO: 7973

SEQ ID NO: 7981 - DNA, 201 bp, Homo sapiens; identical to SEQ ID NO: 7974

SEQ ID NO: 7982 - DNA, 201 bp, Homo sapiens; identical to SEQ ID NO: 7968

SEQ ID NO: 7983 - DNA, 201 bp, Homo sapiens; identical to SEQ ID NO: 7970

SEQ ID NO: 7984 - DNA, 201 bp, Homo sapiens
acaggaactcttctctcttttgttaataaacttccaactccctcctcagacccgaccgcatgtctgtcatggacctcgccaatacttgctccagctttcaktcggacctggatttctgttcagattgcggctcggtcctgcctctgcccggggctcaggatacggtcacctgtattcgctgtggcttcaacatcaacgttc

SEQ ID NO: 7985 - DNA, 201 bp, Homo sapiens; identical to SEQ ID NO: 7974

SEQ ID NO: 7986 - DNA, 201 bp, Homo sapiens; identical to SEQ ID NO: 7969

SEQ ID NO: 7987 - DNA, 201 bp, Homo sapiens; identical to SEQ ID NO: 7972

SEQ ID NO: 7988 - DNA, 201 bp, Homo sapiens; identical to SEQ ID NO: 7973

SEQ ID NO: 7989 - DNA, 201 bp, Homo sapiens
tcgcagaggcaggaggcgtgcgtggcaggagggttcgggttatatactcctaggtcctgggacagaatagttacgacctctgggacaggaactcttctctsttttgttaataaacttccaactccctcctcagacccgaccgcatgtctgtcatggacctcgccaatacttgctccagctttcagtcggacctggatttct

SEQ ID NO: 7990 - DNA, 201 bp, Homo sapiens
gctactcgggaggctgaggcaggagaatggtgtgaacccgggaggcggaacttgcagtgagccgagatcacgccactgcactccagcctgggcaacagagygagactgtctcaaaaaaaaaccaaccaaacaaacaaaaaagcactgaaagagacagactccagttcccggaaggctgacccagtcagcactaaaaacagg

SEQ ID NO: 7991 - DNA, 201 bp, Homo sapiens
gcaggagaatggtgtgaacccgggaggcggaacttgcagtgagccgagatcacgccactgcactccagcctgggcaacagagtgagactgtctcaaaaaamaaccaaccaaacaaacaaaaaagcactgaaagagacagactccagttcccggaaggctgacccagtcagcactaaaaacaggattaatgtatagctatta

SEQ ID NO: 7992 - DNA, 201 bp, Homo sapiens
  misc_feature (1)...(201): n = A,T,C or G, or insertion/deletion polymorphism (see Tables 1-2)
cagcacagcttttgcccctggaaggtcctaaagaggagaaagtagcaatgcacgctcccctggctgtttcttcctcctcatcctcctcctgtgaacaaganggtgtggagaatgatctggagatgggccctccccagagactgatggtgaacagtgcagtcaacacagatcccatctttcttgagatgcctctgagacaga

SEQ ID NO: 7993 - DNA, 201 bp, Homo sapiens
gtcaacacagatcccatctttcttgagatgcctctgagacagagtggcctctgccagcctgagtggaggtattggaagagaaacgggcctgagccatgccytgggaagccaggaacaagatattccaacatctgcaaagaagaaaaggatcacaaacagcagagagcacaaactgtagtagtggggactaccaaggagctg

SEQ ID NO: 7994 - DNA, 201 bp, Homo sapiens
tgcaaagaagaaaaggatcacaaacagcagagagcacaaactgtagtagtggggactaccaaggagctggtctcgaaagcaacccacatgaagccaccgcrgaccccgccaggggaagctgaacacagaaagcggagtcagagccttgcaatatgtcagtggaacaagaattcccgttagactaagagccctgaggatcta

SEQ ID NO: 7995 - DNA, 201 bp, Homo sapiens
gtgccagggctgcctctgtggctgcccgccatgtggcacgacttggtggcctctaaccaggacctcagaagtcatggccagagaacttccagagttggagsccacagcacagcttttgcccctggaaggtcctaaagaggagaaagtagcaatgcacgctcccctggctgtttcttcctcctcatcctcctcctgtgaaca

SEQ ID NO: 7996 - DNA, 201 bp, Homo sapiens
tagcaagaagggaagcagatggtttttactaccgggcccaaataaaggccactcccgagctggagagacagggggtcctgcttgtggaattcgaggctccwcttgtcgcaggcccaaagctgccagcccagcagcagagagtggtcttagaagaggatgtcattcctctctcaccatctgtaggatactcactgagaccag

SEQ ID NO: 7997 - DNA, 201 bp, Homo sapiens
  misc_feature (1)...(201): n = A,T,C or G, or insertion/deletion polymorphism (see Tables 1-2)
aagagaaacgggcctgagccatgccctgggaagccaggaacaagatattccaacatctgcaaagaagaaaaggatcacaaacagcagagagcacaaactgnagtagtggggactaccaaggagctggtctcgaaagcaacccacatgaagccaccgcggaccccgccaggggaagctgaacacagaaagcggagtcagagc

SEQ ID NO: 7998 - DNA, 201 bp, Homo sapiens
aatactgcagcgtggccacaagcctgaaggcccctggctgggacggtgctgctccaccttgggacctctccttcacctacccctttgccctccaagcaccstggctcaccgggcacaagccccttgcaaggcatgcctcttcttgcccatgtctccacgttgccgacccagcatggcaggggcctggctggctgggaagag

SEQ ID NO: 7999 - DNA, 201 bp, Homo sapiens
ttgtggaattcgaggctcctcttgtcgcaggcccaaagctgccagcccagcagcagagagtggtcttagaagaggatgtcattcctctctcaccatctgtrggatactcactgagaccaggggataaggtgctggcactctgggagccaggccaacagcagtatggccctggcactgttcttttgggcttggagatgagag

SEQ ID NO: 8000 - DNA, 201 bp, Homo sapiens
agacagggggtcctgcttgtggaattcgaggctcctcttgtcgcaggcccaaagctgccagcccagcagcagagagtggtcttagaagaggatgtcattcytctctcaccatctgtaggatactcactgagaccaggggataaggtgctggcactctgggagccaggccaacagcagtatggccctggcactgttcttttg

SEQ ID NO: 8001 - DNA, 201 bp, Homo sapiens
tcaaatactgcagcgtggccacaagcctgaaggcccctggctgggacggtgctgctccaccttgggacctctccttcacctacccctttgccctccaagcrccctggctcaccgggcacaagccccttgcaaggcatgcctcttcttgcccatgtctccacgttgccgacccagcatggcaggggcctggctggctgggaa

SEQ ID NO: 8002 - DNA, 201 bp, Homo sapiens
tttgggcttggagatgagagatccccagagagcatcaaaggaaaaagaaatcactgttcatttctggaatggcaaagctgctaaagtgcccctaggtgggstccagtcggtgtccctgaccatctggaagaaggctgtggagaggctgcacaagtctttcaccagggagcaccccaggccccttcactgggccccttgctg

SEQ ID NO: 8003 - DNA, 201 bp, Homo sapiens
tacaaaaaaaatagccgggcatggtggcgggtgcctgtagtgccagctactcgggaggctgaggcaggagaatggtgtgaacccgggaggcggaacttgcrgtgagccgagatcacgccactgcactccagcctgggcaacagagtgagactgtctcaaaaaaaaaccaaccaaacaaacaaaaaagcactgaaagagaca

SEQ ID NO: 8004 - DNA, 201 bp, Homo sapiens; identical to SEQ ID NO: 7990

SEQ ID NO: 8005 - DNA, 201 bp, Homo sapiens; identical to SEQ ID NO: 7991

SEQ ID NO: 8006 - DNA, 201 bp, Homo sapiens; identical to SEQ ID NO: 7992
  misc_feature (1)...(201): n = A,T,C or G, or insertion/deletion polymorphism (see Tables 1-2)

SEQ ID NO: 8007 - DNA, 201 bp, Homo sapiens; identical to SEQ ID NO: 7993

SEQ ID NO: 8008 - DNA, 201 bp, Homo sapiens; identical to SEQ ID NO: 7994

SEQ ID NO: 8009 - DNA, 201 bp, Homo sapiens; identical to SEQ ID NO: 7995

SEQ ID NO: 8010 - DNA, 201 bp, Homo sapiens
gtttttactaccgggcccaaataaaggccactcccgaggcaatgttttctttcccacagctggagagacagggggtcctgcttgtggaattcgaggctccwcttgtcgcaggcccaaagctgccagcccagcagcagagagtggtcttagaagaggatgtcattcctctctcaccatctgtaggatactcactgagaccag

SEQ ID NO: 8011 - DNA, 201 bp, Homo sapiens; identical to SEQ ID NO: 7997
  misc_feature (1)...(201): n = A,T,C or G, or insertion/deletion polymorphism (see Tables 1-2)

SEQ ID NO: 8012 - DNA, 201 bp, Homo sapiens; identical to SEQ ID NO: 7998

SEQ ID NO: 8013 - DNA, 201 bp, Homo sapiens; identical to SEQ ID NO: 7999

SEQ ID NO: 8014 - DNA, 201 bp, Homo sapiens; identical to SEQ ID NO: 8000

SEQ ID NO: 8015 - DNA, 201 bp, Homo sapiens; identical to SEQ ID NO: 8001

SEQ ID NO: 8016 - DNA, 201 bp, Homo sapiens; identical to SEQ ID NO: 8002

SEQ ID NO: 8017 - DNA, 201 bp, Homo sapiens; identical to SEQ ID NO: 8003

SEQ ID NO: 8018 - DNA, 200 bp, Homo sapiens
agctgcgccggcgccgccgggagcgctaggcctggtccctcttcctaggatagcgttgcgcgcatgcgccttgacgagtgagccggggagccatggacamctgtttggcggccgcagcgctgaatggggtggaccgacgttccctgcagcgttcagcaaggctggctctagaagtgctggagagggccaagaggagggcg

SEQ ID NO: 8019 - DNA, 201 bp, Homo sapiens
cctgtttttagtgctgactgggtcagccttccgggaactggagtctgtctctttcagtgcttttttgtttgtttggttggtttttttttgagacagtctcrctctgttgcccaggctggagtgcagtggcgtgatctcggctcactgcaagttccgcctcccgggttcacaccattctcctgcctcagcctcccgagtagc

SEQ ID NO: 8020 - DNA, 201 bp, Homo sapiens
taatagctatacattaatcctgtttttagtgctgactgggtcagccttccgggaactggagtctgtctctttcagtgcttttttgtttgtttggttggttkttttttgagacagtctcactctgttgcccaggctggagtgcagtggcgtgatctcggctcactgcaagttccgcctcccgggttcacaccattctcctgc

SEQ ID NO: 8021 - DNA, 201 bp, Homo sapiens
ccgggagagaaatattattcatctgtgccagaggaaggaggggcaacccatgtctatcgttatcacagaggcgagtcgaagctgcacatgtgcttggacayagggaatggtcagagaaaagacagaaaaaagacatcccttggtcctggaggcagctatcaaatatcagagcatgctccagaggcatcccagcctgctgag

SEQ ID NO: 8022 - DNA, 201 bp, Homo sapiens
gcgcatgcgccttgacgagtgagccggggagccatggacaactgtttggcggccgcagcgctgaatggggtggaccgacgttccctgcagcgttcagcaargctggctctagaagtgctggagagggccaagaggagggcggtggactggcatgccctggagcgtcccaaaggctgcatgggggtccttgcccgggaggcg

SEQ ID NO: 8023 - DNA, 201 bp, Homo sapiens
tgtctctttcagtgcttttttgtttgtttggttggtttttttttgagacagtctcactctgttgcccaggctggagtgcagtggcgtgatctcggctcacygcaagttccgcctcccgggttcacaccattctcctgcctcagcctcccgagtagctggcactacaggcacccgccaccatgcccggctattttttttgta

SEQ ID NO: 8024 - DNA, 200 bp, Homo sapiens; identical to SEQ ID NO: 8018

SEQ ID NO: 8025 - DNA, 201 bp, Homo sapiens
cagtgtgggaaatattattcatctgtgccagaggaaggaggggcaacccatgtctatcgttatcacagaggcgagtcgaagctgcacatgtgcttggacayagggaatggtcagagaaaagacagaaaaaagacatcccttggtcctggaggcagctatcaaatatcagagcatgctccagaggcatcccagcctgtgagt

SEQ ID NO: 8026 - DNA, 201 bp, Homo sapiens; identical to SEQ ID NO: 8022

SEQ ID NO: 8027 - DNA, 102 bp, Homo sapiens
agaaaagacagaaaaaagacatcccttggtcctggaggcagctatcaaatatcagagcatgctccagaggcatcccagcctgtgagtacggaactgcttayg

SEQ ID NO: 8028 - DNA, 200 bp, Homo sapiens; identical to SEQ ID NO: 8018

SEQ ID NO: 8029 - DNA, 201 bp, Homo sapiens; identical to SEQ ID NO: 8019

SEQ ID NO: 8030 - DNA, 201 bp, Homo sapiens; identical to SEQ ID NO: 8020

SEQ ID NO: 8031 - DNA, 201 bp, Homo sapiens
cagtgtgggaaatattattcatctgtgccagaggaaggaggggcaacccatgtctatcgttatcacagaggcgagtcgaagctgcacatgtgcttggacayagggaatggtcagagaaaagacagaaaaaagacatcccttggtcctggaggcagctatcaaatatcagagcatgctccagaggcatcccagcctgctgag

SEQ ID NO: 8032 - DNA, 201 bp, Homo sapiens; identical to SEQ ID NO: 8022

SEQ ID NO: 8033 - DNA, 201 bp, Homo sapiens; identical to SEQ ID NO: 8023

SEQ ID NO: 8034 - DNA, 200 bp, Homo sapiens; identical to SEQ ID NO: 8018

SEQ ID NO: 8035 - DNA, 201 bp, Homo sapiens
cagtgtgggaaatattattcatctgtgccagaggaaggaggggcaacccatgtctatcgttatcacagaggcgagtcgaagctgcacatgtgcttggacayagggaatggtcaggctgagaacatctctaaggacctctacatagaagtatatccagggacctattctgtcactgtgggctcaaatgacttaaccaagaag

SEQ ID NO: 8036 - DNA, 201 bp, Homo sapiens; identical to SEQ ID NO: 8022

SEQ ID NO: 8037 - DNA, 201 bp, Homo sapiens
cagctgcgccggcgccgccgggagcgctaggcctggtccctcttcctaggatagcgttgcgcgcatgcgccttgacgagtgagccggggagccatggacamctgtttggcggccgcagcgctgaatggggtggaccgacgttccctgcagcgttcagcaaggctggctctagaagtgctggagagggccaagaggagggcg

SEQ ID NO: 8038 - DNA, 201 bp, Homo sapiens; identical to SEQ ID NO: 8019

SEQ ID NO: 8039 - DNA, 201 bp, Homo sapiens; identical to SEQ ID NO: 8020

SEQ ID NO: 8040 - DNA, 201 bp, Homo sapiens; identical to SEQ ID NO: 8031

SEQ ID NO: 8041 - DNA, 201 bp, Homo sapiens; identical to SEQ ID NO: 8022

SEQ ID NO: 8042 - DNA, 201 bp, Homo sapiens; identical to SEQ ID NO: 8023

SEQ ID NO: 8043 - DNA, 201 bp, Homo sapiens
cttgacctcgagtgggataacagtgaagccgaagttcaggagtacaaggttgtgtacagcaccctggcgggtgagcaatatcatgaggtactggtccccargggcattggtccaaccaccagggccaccctgacagatctggtacctggcactgagtatggagttggaatatctgccgtcatgaactcacagcaaagcgtg

SEQ ID NO: 8044 - DNA, 201 bp, Homo sapiens
tggctctgaaagaacaggcccgcagcccccctacctcggccagcgtctccacagtcattgacggccccacgcagatcctggttcgcgatgtctcggacacygtggcttttgtggagtggattccccctcgagccaaagtcgatttcattcttttgaaatatggcctggtgggcggggaaggtgggaggaccaccttccggc

SEQ ID NO: 8045 - DNA, 201 bp, Homo sapiens
tcgggaacgtggaggatgagttctggctggggctggacaatatacacaggatcacatcccagggccgctatgagctgcgcgtggacatgcgggatggccargaggccgccttcgcctcctacgacaggttctctgtcgaggacagcagaaacctgtacaaactccgcataggaagctacaacggcactgcgggggactccc

SEQ ID NO: 8046 - DNA, 201 bp, Homo sapiens
gaatatctgccgtcatgaactcacagcaaagcgtgccagccaccatgaatgccaggactgaacttgacagtccccgagacctcatggtgacagcctcctcrgagacctccatctccctcatctggaccaaggccagtggccccattgaccactaccgaattacctttaccccatcctctgggattgcctcagaagtcaccg

SEQ ID NO: 8047 - DNA, 201 bp, Homo sapiens
agacgagactctggcagagtacatgggccagacctcagaccacgagagccaggtcacctttacacacaggatcaacttccccaaaaaggcctgtccatgtkccagttcagcccaggtgctgcaggagctgctgagccggatcgagatgctggagagggaggtgtcggtgctgcgagaccagtgcaacgccaactgctgcca

SEQ ID NO: 8048 - DNA, 201 bp, Homo sapiens
gactgttcggggaaggggagatgtgccaacggtacctgtttatgcgaggagggctacgttggtgaggactgcggccagcggcagtgtctgaatgcctgcartgggcgaggacaatgtgaggaggggctctgcgtctgtgaagagggctaccagggccctgactgctcagcagttgcccctccagaggacttgcgagtggct

SEQ ID NO: 8049 - DNA, 201 bp, Homo sapiens
gggtccagagacagtcagtggaggaggagggaggcattgccaactacaacacgtccagcaaagagcagcctgtggtcttcaaccacgtgtacaacattaaygtgcccttggacaacctctgctcctcagggctagaggcctctgctgagcaggaggtgagtgcagaagacgagactctggcagagtacatgggccagacct

SEQ ID NO: 8050 - DNA, 201 bp, Homo sapiens
ggaggtgtcggtgctgcgagaccagtgcaacgccaactgctgccaagaaagtgctgccacaggacaactggactatatccctcactgcagtggccacggcmactttagctttgagtcctgtggctgcatctgcaacgaaggctggtttggcaagaattgctcggagccctactgcccgctgggttgctccagccggggggt

SEQ ID NO: 8051 - DNA, 201 bp, Homo sapiens
gctccatgatcaagccttcagagtgtcagctggaggtcaccacagaaagggtccagagacagtcagtggaggaggagggaggcattgccaactacaacacrtccagcaaagagcagcctgtggtcttcaaccacgtgtacaacattaacgtgcccttggacaacctctgctcctcagggctagaggcctctgctgagcagg

SEQ ID NO: 8052 - DNA, 201 bp, Homo sapiens
gctcctcagggctagaggcctctgctgagcaggaggtgagtgcagaagacgagactctggcagagtacatgggccagacctcagaccacgagagccaggtyacctttacacacaggatcaacttccccaaaaaggcctgtccatgtgccagttcagcccaggtgctgcaggagctgctgagccggatcgagatgctggaga

SEQ ID NO: 8053 - DNA, 201 bp, Homo sapiens
cacatcccagggccgctatgagctgcgcgtggacatgcgggatggccaggaggccgccttcgcctcctacgacaggttctctgtcgaggacagcagaaacytgtacaaactccgcataggaagctacaacggcactgcgggggactccctcagctatcatcaaggacgccctttctccacagaggatagagacaatgatgt

SEQ ID NO: 8054 - DNA, 201 bp, Homo sapiens
acactttgagtggggtttaccccatcttcctcaatggggagctgagccagaaattacaagtgtactgtgatatgaccaccgacgggggcggctggattgtrttccagaggcggcagaatggccaaactgattttttccggaaatgggctgattaccgtgttggcttcgggaacgtggaggatgagttctggctggggctgg

SEQ ID NO: 8055 - DNA, 201 bp, Homo sapiens
gacctctcaccagtggcaccatcagcaccaacttttctactctcctggaccctccggcaaacctgacagccagtgaagtcaccagacaaagtgccctgatytcctggcagcctcccagggcagagattgaaaattatgtcttgacctacaaatccaccgacggaagccgcaaggagctgattgtggatgcagaagacacct

SEQ ID NO: 8056 - DNA, 201 bp, Homo sapiens
gacaccacgtggagcagcatcacctccaccgctttcaccacaggaggccgggtgttccctcatccccaagactgtgcccagcatttgatgaatggagacaytttgagtggggtttaccccatcttcctcaatggggagctgagccagaaattacaagtgtactgtgatatgaccaccgacgggggcggctggattgtattc

SEQ ID NO: 8057 - DNA, 201 bp, Homo sapiens
tcttgacctacaaatccaccgacggaagccgcaaggagctgattgtggatgcagaagacacctggattcgactggagggcctgttggagaacacagactayacggtgctcctgcaggcagcacaggacaccacgtggagcagcatcacctccaccgctttcaccacaggaggccgggtgttccctcatccccaagactgtg

SEQ ID NO: 8058 - DNA, 201 bp, Homo sapiens
gtgcccaacactgtgacagaattcaccatcaccagactgaacccagctaccgaatacgaaatcagcctcaacagcgtgcggggcagggaggaaagcgagcscatctgtactcttgtgcacacagccatggacaaccctgtggatctgattgctaccaatatcactccaacagaagccctgctgcagtggaaggcaccagtg

SEQ ID NO: 8059 - DNA, 201 bp, Homo sapiens
cccgagacctcatggtgacagcctcctcggagacctccatctccctcatctggaccaaggccagtggccccattgaccactaccgaattacctttaccccrtcctctgggattgcctcagaagtcaccgtacccaaggacaggacctcatacacactaacagatctagagcctggggcagagtacatcatttccgtcactg

SEQ ID NO: 8060 - DNA, 201 bp, Homo sapiens
acctgacagccagtgaagtcaccagacaaagtgccctgatctcctggcagcctcccagggcagagattgaaaattatgtcttgacctacaaatccaccgayggaagccgcaaggagctgattgtggatgcagaagacacctggattcgactggagggcctgttggagaacacagactacacggtgctcctgcaggcagcac

SEQ ID NO: 8061 - DNA, 201 bp, Homo sapiens; identical to SEQ ID NO: 8045

SEQ ID NO: 8062 - DNA, 201 bp, Homo sapiens; identical to SEQ ID NO: 8046

SEQ ID NO: 8063 - DNA, 201 bp, Homo sapiens; identical to SEQ ID NO: 8053

SEQ ID NO: 8064 - DNA, 201 bp, Homo sapiens; identical to SEQ ID NO: 8054

SEQ ID NO: 8065 - DNA, 201 bp, Homo sapiens; identical to SEQ ID NO: 8055

SEQ ID NO: 8066 - DNA, 201 bp, Homo sapiens; identical to SEQ ID NO: 8056

SEQ ID NO: 8067 - DNA, 201 bp, Homo sapiens; identical to SEQ ID NO: 8057

SEQ ID NO: 8068 - DNA, 201 bp, Homo sapiens; identical to SEQ ID NO: 8058

SEQ ID NO: 8069 - DNA, 201 bp, Homo sapiens; identical to SEQ ID NO: 8059

SEQ ID NO: 8070 - DNA, 201 bp, Homo sapiens; identical to SEQ ID NO: 8060

SEQ ID NO: 8071 - DNA, 201 bp, Homo sapiens
  misc_feature (1)...(201): n = A,T,C or G, or insertion/deletion polymorphism (see Tables 1-2)
aggcacgccacgtgaagctgaacgtggaggagcgctccgtggggccgctcacccgcaaaggcttctacctggccttccaggatatcggtgcctgtgtggcnctgctctccgtccgtgtctactacaagaagtgccccgagctgctgcagggcctggcccacttccctgagaccatcgccggctctgatgcaccttccctgg

SEQ ID NO: 8072 - DNA, 201 bp, Homo sapiens
ttgtcatgtgggaggtgatgacctatggcgagcggccctactgggagttgtccaaccacgaggtgatgaaagccatcaatgatggcttccggctccccacrcccatggactgcccctccgccatctaccagctcatgatgcagtgctggcagcaggagcgtgcccgccgccccaagttcgctgacatcgtcagcatcctgg

SEQ ID NO: 8073 - DNA, 201 bp, Homo sapiens
tcacttaccgcaagaagggagactccaacagctacaatgtgcgccgcaccgagggtttctccgtgaccctggacgacctggccccagacaccacctacctkgtccaggtgcaggcactgacgcaggagggccagggggccggcagcaaggtgcacgaattccagacgctgtccccggagggatctggcaacttggcggtga

SEQ ID NO: 8074 - DNA, 201 bp, Homo sapiens
aaccaggctgtgttgaagttcactaccgagatccatccatcctgtgtcactcggcagaaggtgatcggagcaggagagtttggggaggtgtacaagggcaygctgaagacatcctcggggaagaaggaggtgccggtggccatcaagacgctgaaagccggctacacagagaagcagcgagtggacttcctcggcgaggcc

SEQ ID NO: 8075 - DNA, 201 bp, Homo sapiens
cgaggacattgtctacagcgtcacctgcgaacagtgctggcccgagtctggggaatgcgggccgtgtgaggccagtgtgcgctactcggagcctcctcacrgactgacccgcaccagtgtgacagtgagcgacctggagccccacatgaactacaccttcaccgtggaggcccgcaatggcgtctcaggcctggtaaccag

SEQ ID NO: 8076 - DNA, 201 bp, Homo sapiens
aggatatcggtgcctgtgtggcgctgctctccgtccgtgtctactacaagaagtgccccgagctgctgcagggcctggcccacttccctgagaccatcgcyggctctgatgcaccttccctggccactgtggccggcacctgtgtggaccatgccgtggtgccaccggggggtgaagagccccgtatgcactgtgcagtgg

SEQ ID NO: 8077 - DNA, 201 bp, Homo sapiens
ccctccgccatctaccagctcatgatgcagtgctggcagcaggagcgtgcccgccgccccaagttcgctgacatcgtcagcatcctggacaagctcattcrtgcccctgactccctcaagaccctggctgactttgacccccgcgtgtctatccggctccccagcacgagcggctcggagggggtgcccttccgcacggtg

SEQ ID NO: 8078 - DNA, 201 bp, Homo sapiens
ccggaagttcacctctgccagcgacgtgtggagctttggcattgtcatgtgggaggtgatgacctatggcgagcggccctactgggagttgtccaaccacraggtgatgaaagccatcaatgatggcttccggctccccacacccatggactgcccctccgccatctaccagctcatgatgcagtgctggcagcaggagcg

SEQ ID NO: 8079 - DNA, 201 bp, Homo sapiens
tcaagacgctgaaagccggctacacagagaagcagcgagtggacttcctcggcgaggccggcatcatgggccagttcagccaccacaacatcatccgcctrgagggcgtcatctccaaatacaagcccatgatgatcatcactgagtacatggagaatggggccctggacaagttccttcgggagaaggatggcgagttca

SEQ ID NO: 8080 - DNA, 201 bp, Homo sapiens
tgcagggcctggcccacttccctgagaccatcgccggctctgatgcaccttccctggccactgtggccggcacctgtgtggaccatgccgtggtgccaccsgggggtgaagagccccgtatgcactgtgcagtggatggcgagtggctggtgcccattgggcagtgcctgtgccaggcaggctacgagaaggtggaggatg

SEQ ID NO: 8081 - DNA, 201 bp, Homo sapiens
tcatggcggccggctacactgccatcgagaaggtggtgcagatgaccaacgacgacatcaagaggattggggtgcggctgcccggccaccagaagcgcatygcctacagcctgctgggactcaaggaccaggtgaacactgtggggatccccatctgagcctcgacagggcctggagccccatcggccaagaatacttgaa

SEQ ID NO: 8082 - DNA, 201 bp, Homo sapiens
acacgctgccatcccctgagggtgccacctcctgcgagtgtgaggaaggcttcttccgggcacctcaggacccagcgtcgatgccttgcacacgacccccytccgccccacactacctcacagccgtgggcatgggtgccaaggtggagctgcgctggacgccccctcaggacagcgggggccgcgaggacattgtctaca

SEQ ID NO: 8083 - DNA, 201 bp, Homo sapiens
  misc_feature (1)...(201): n = A,T,C or G, or insertion/deletion polymorphism (see Tables 1-2)
cacgccacgtgaagctgaacgtggaggagcgctccgtggggccgctcacccgcaaaggcttctacctggccttccaggatatcggtgcctgtgtggcgctnctctccgtccgtgtctactacaagaagtgccccgagctgctgcagggcctggcccacttccctgagaccatcgccggctctgatgcaccttccctggcca

SEQ ID NO: 8084 - DNA, 201 bp, Homo sapiens
acaagggcatgctgaagacatcctcggggaagaaggaggtgccggtggccatcaagacgctgaaagccggctacacagagaagcagcgagtggacttcctyggcgaggccggcatcatgggccagttcagccaccacaacatcatccgcctagagggcgtcatctccaaatacaagcccatgatgatcatcactgagtaca

SEQ ID NO: 8085 - DNA, 201 bp, Homo sapiens
gcaggcactgacgcaggagggccagggggccggcagcaaggtgcacgaattccagacgctgtccccggagggatctggcaacttggcggtgattggcggcrtggctgtcggtgtggtcctgcttctggtgctggcaggagttggcttctttatccaccgcaggaggaagaaccagcgtgcccgccagtccccggaggacgt

SEQ ID NO: 8086 - DNA, 201 bp, Homo sapiens; identical to SEQ ID NO: 8071
  misc_feature (1)...(201): n = A,T,C or G, or insertion/deletion polymorphism (see Tables 1-2)

SEQ ID NO: 8087 - DNA, 201 bp, Homo sapiens; identical to SEQ ID NO: 8072

SEQ ID NO: 8088 - DNA, 201 bp, Homo sapiens; identical to SEQ ID NO: 8073

SEQ ID NO: 8089 - DNA, 201 bp, Homo sapiens; identical to SEQ ID NO: 8074

SEQ ID NO: 8090 - DNA, 201 bp, Homo sapiens; identical to SEQ ID NO: 8075

SEQ ID NO: 8091 - DNA, 201 bp, Homo sapiens
ctttccctgcgagacgcacacagctgagcacttagcaggcaccgccacgtcccagcatccctggagcaggagccccgccacagccttcggacagacatatrggatattcccaagccgaccttccctccgccttctcccacatgaggccatctcaggagatggagggcttggcccagcgccaagtaaacagggtacctcaag

SEQ ID NO: 8092 - DNA, 201 bp, Homo sapiens; identical to SEQ ID NO: 8076

SEQ ID NO: 8093 - DNA, 201 bp, Homo sapiens; identical to SEQ ID NO: 8077

SEQ ID NO: 8094 - DNA, 201 bp, Homo sapiens; identical to SEQ ID NO: 8078

SEQ ID NO: 8095 - DNA, 201 bp, Homo sapiens; identical to SEQ ID NO: 8079

SEQ ID NO: 8096 - DNA, 201 bp, Homo sapiens; identical to SEQ ID NO: 8080

SEQ ID NO: 8097 - DNA, 201 bp, Homo sapiens; identical to SEQ ID NO: 8081

SEQ ID NO: 8098 - DNA, 201 bp, Homo sapiens; identical to SEQ ID NO: 8082

SEQ ID NO: 8099 - DNA, 201 bp, Homo sapiens; identical to SEQ ID NO: 8083
  misc_feature (1)...(201): n = A,T,C or G, or insertion/deletion polymorphism (see Tables 1-2)

SEQ ID NO: 8100 - DNA, 201 bp, Homo sapiens; identical to SEQ ID NO: 8084

SEQ ID NO: 8101 - DNA, 201 bp, Homo sapiens; identical to SEQ ID NO: 8085

SEQ ID NO: 8102 - DNA, 201 bp, Homo sapiens
ggagcacagtcttccttttcaatagatttataaggggccttgatgctctcagcaagaaagcgaaggcttccacagtcgatttgcctatagagtccgtaagyctaagtctgcaggatctcattggctacttccaccccccagatgagcatttagagcatgaagacaaacagaacagactacgagccctgaagaatcggcaaa

SEQ ID NO: 8103 - DNA, 201 bp, Homo sapiens
acagactttgtttcttggagtccacttccaattccaagaatgtgcccccagacctctccatctgcacctttgtgctggagcagtccctctctgtccgggcrctgcaggagatgctggctaacaccgtggagaaatcagaaggggcaattgatgtggaaaaatggactgctcaaggtggtggtcatcgaacactcctctacg

SEQ ID NO: 8104 - DNA, 201 bp, Homo sapiens
gtccgttctaaccagcatctcatctgtgacaatctcctaccaggaagagacttgttattgcagacacgtcttgtgaaccatgtcagcagcatgagacccartatttttctgggcgtcagtgaaggttctgctcagtataagaaatggtactatgaattgatggtggaccacacagagccctttgtgacagctgaagcaact

SEQ ID NO: 8105 - DNA, 201 bp, Homo sapiens
tggctggttgtggactgcaaagttgccagatgctggtgtctaagggctatccagacattgggtggaacccagttgaaggagagagatatcttgactttctyagatttgctgtcttctgtaatggggagagtgtggaggaaaatgcaaatgtcgtggtgagattgctcattcggaggcctgagtgttttggtcctgctttga

SEQ ID NO: 8106 - DNA, 201 bp, Homo sapiens
tagaagtttgtttactctctatttgtggacaactgagaccttctatgatgcagcacttactcagaagattagtatttgatgttccattattaaatgaacaygcaaagatgcctcttaaactgctgacaaatcattatgaaagatgctggaaatattactgcctgcctggagggtggggaaactttggtgctgcctcagaag

SEQ ID NO: 8107 - DNA, 201 bp, Homo sapiens
aaccctacccctctctctccctctctcaatttctctgctctcttggaaacattttgctgattttgtgaattgccagcgttgtgtgttttctgggagcatcraagctctgtttcggaagagctgtttcctccccccaccttttgtatttactttgagactaaagactgaagaataatctaaattcatactcagacaaaaaaa

SEQ ID NO: 8108 - DNA, 201 bp, Homo sapiens
ttcctccaacaactcattcgctatgtggatgaagcccatcagtatatcctggagtttgatggtggcagcagaggcaaaggagaacatttcccttatgaacragaaatcaagttctttgcaaaagtcgttcttcctttaattgatcagtatttcaaaaaccatcgtttatacttcttatctgcagcaagcagacctctctgc

SEQ ID NO: 8109 - DNA, 201 bp, Homo sapiens
tcttgaacagaagtctaaacgtgtgggtcggagacattactgtctgggaagtggaacatcctcagagatctaaaaaggctgtatggcataaactactgtcyaagcagaggaaaagggctgttgtagcctgcttccggatggcccccttatataatctgccaaggcatcgggctgtcaatctctttcttcagggatatgaaa

SEQ ID NO: 8110 - DNA, 201 bp, Homo sapiens; identical to SEQ ID NO: 8102

SEQ ID NO: 8111 - DNA, 201 bp, Homo sapiens
acagactttgtttcttggagtccacttccaattccaagaatgtgcccccagacctctccatctgcacctttgtgctggagcagtccctctctgtccgggcrctgcaggagatgctggctaacaccgtggagaaatcagaaggggcaattactcttttgtgtttttctctcttgttctccttttttctcttctctctaaaga

SEQ ID NO: 8112 - DNA, 201 bp, Homo sapiens; identical to SEQ ID NO: 8104

SEQ ID NO: 8113 - DNA, 201 bp, Homo sapiens; identical to SEQ ID NO: 8105

SEQ ID NO: 8114 - DNA, 201 bp, Homo sapiens; identical to SEQ ID NO: 8106

SEQ ID NO: 8115 - DNA, 201 bp, Homo sapiens; identical to SEQ ID NO: 8107

SEQ ID NO: 8116 - DNA, 201 bp, Homo sapiens; identical to SEQ ID NO: 8108

SEQ ID NO: 8117 - DNA, 201 bp, Homo sapiens; identical to SEQ ID NO: 8109

SEQ ID NO: 8118 - DNA, 201 bp, Homo sapiens; identical to SEQ ID NO: 8102

SEQ ID NO: 8119 - DNA, 201 bp, Homo sapiens; identical to SEQ ID NO: 8111

SEQ ID NO: 8120 - DNA, 201 bp, Homo sapiens; identical to SEQ ID NO: 8104

SEQ ID NO: 8121 - DNA, 201 bp, Homo sapiens; identical to SEQ ID NO: 8105

SEQ ID NO: 8122 - DNA, 201 bp, Homo sapiens; identical to SEQ ID NO: 8106

SEQ ID NO: 8123 - DNA, 201 bp, Homo sapiens
aaccctacccctctctctccctctctcaatttctctgctctcttggaaacattttgctgattttgtgaattgccagcgttgtgtgttttctgggagcatcraagctctgtttcggaagagctgtttcctcccccatatgctcctgctattattttggtaatgctctgatgcaacattgcaactttatgaaatctttgtatg

SEQ ID NO: 8124 - DNA, 201 bp, Homo sapiens
cagccacctgtgatcagttttgttgattaaggacttcttgtcaggccattttttaatatcaaagctgaagcaatatccattcagggatttcatcagttgcrtcacaaaacacggatgataatatacatcactccattttttccattttgagtccttttaaatgtaatgctaacctttacaattaaaaagtcagattcagaa

SEQ ID NO: 8125 - DNA, 201 bp, Homo sapiens; identical to SEQ ID NO: 8108

SEQ ID NO: 8126 - DNA, 201 bp, Homo sapiens
cggtagaaagagtattggatatagcaaatgtgctttttcatcttgaacaggtggaacatcctcagagatctaaaaaggctgtatggcataaactactgtcyaagcagaggaaaagggctgttgtagcctgcttccggatggcccccttatataatctgccaaggcatcgggctgtcaatctctttcttcagggatatgaaa

SEQ ID NO: 8127 - DNA, 201 bp, Homo sapiens; identical to SEQ ID NO: 8104

SEQ ID NO: 8128 - DNA, 201 bp, Homo sapiens
aaccctacccctctctctccctctctcaatttctctgctctcttggaaacattttgctgattttgtgaattgccagcgatgtgtgttttctgggagcatcraagctctgtttcggaagagctgtttcctccccccaccttttgtatttactttgagactaaagactgaagaataatctaaattcatactcagacaaaaaaa

SEQ ID NO: 8129 - DNA, 201 bp, Homo sapiens; identical to SEQ ID NO: 8108

SEQ ID NO: 8130 - DNA, 201 bp, Homo sapiens
aaaacctcaagcagggccagttcactcacacccgaaaccagcccaaaggggttactcagattatcaattacaccacagtggccctgctgccaatgctgtcktcattatttgaacatattggccagcatcagttcggagaagacctaatattggaagatgtccaggtgtcttgttatagaattctgactagcttatatgctt

SEQ ID NO: 8131 - DNA, 201 bp, Homo sapiens
acagactttgtttcttggagtccacttccaattccaagaatgtgcccccagacctctccatctgcacctttgtgctggagcagtccctctctgtccgggcrctgcaggagatgctggctaacaccgtggagaaatcagaagggcaagttgatgtggaaaaatggaaattcatgatgaagactgctcaaggtggtggtcatc

SEQ ID NO: 8132 - DNA, 201 bp, Homo sapiens
aagacaaggtgaaaaaaatgaagctacccaagaattaccagctgacaagtggatacaagcctgcccctatggacctgagctttatcaaactcaccccatcrcaagaagcaatggtggacaagttggcagaaaatgcacataatgtgtgggcgcgggatcgaatccggcagggctggacttatggcatccaacaggacgtaa

SEQ ID NO: 8133 - DNA, 201 bp, Homo sapiens
cagctctgaagcggttactgcccattgggttgaacatctgtgcccctggggaccaggagctcattgctctggccaaaaatcgatttagcctgaaagatacygaggatgaagtacgagatataatccgcagcaatattcatttacaaggcaagttggaggatcctgctattagatggcaaatggctctttacaaagacttac

SEQ ID NO: 8134 - DNA, 201 bp, Homo sapiens; identical to SEQ ID NO: 8102

SEQ ID NO: 8135 - DNA, 201 bp, Homo sapiens
tcttgaacagaagtctaaacgtgtgggtcgaagacattactgtctggtggaacatcctcagagatctaaaaaggctgtatggcataaactactgtctaagyagaggaaaagggctgttgtagcctgcttccggatggcccccttatataatctgccaaggcatcgggctgtcaatctctttcttcagggatatgaaaagtc

SEQ ID NO: 8136 - DNA, 201 bp, Homo sapiens; identical to SEQ ID NO: 8105

SEQ ID NO: 8137 - DNA, 201 bp, Homo sapiens
tagaagtttgtttactctctatttgtggacaactgagaccttctatgatgcagcacttactcagaagattagtatttgatgtcccattattaaatgaacaygcaaagatgcctcttaaactgctgacaaatcattatgaaagatgctggaaatattactgcctgcctggagggtggggaaactttggtgctgcctcagaag

SEQ ID NO: 8138 - DNA, 201 bp, Homo sapiens
aggctgggcgccgcgatgttcgacgggacaccggcggagagcgacctcggggttaaggggtggggctgacgtcaggagccaagatggcggcggtggtcgcmctctccttgaggcgccggttgccggccacaacccttggcggagcctgcctgcaggcctcccgaggagcccagacagctgcagccacagctccccgtatca

SEQ ID NO: 8139 - DNA, 201 bp, Homo sapiens
ggagcctgcctgcaggcctcccgaggagcccagacagctgcagccacagctccccgtatcaagaaatttgccatctatcgatgggacccagacaaggctgragacaaacctcatatgcagacttatgaagttgaccttaataaatgtggccccatggtattggatgctttaatcaagattaagaatgaagttgactctact

SEQ ID NO: 8140 - DNA, 114 bp, Homo sapiens
cacccgggaaacckgaagccgcctcccacttggttgctcgtacgcggctagtgggtcctcagtggatgtaggctgggcgccgcgatgttcgacgggacaccggcggagagcgac

SEQ ID NO: 8141 - DNA, 201 bp, Homo sapiens
ccgaggagcccagacagctgcagccacagctccccgtatcaagaaatttgccatctatcgatgggacccagacaaggctggagacaaacctcatatgcagrcttatgaagttgaccttaataaatgtggccccatggtattggatgctttaatcaagattaagaatgaagttgactctactttgaccttccgaagatcatg

SEQ ID NO: 8142 - DNA, 201 bp, Homo sapiens
tcttccacacatgtatgtgataaaggatcttgttcccgatttgagcaacttctatgcacagtacaaatccattgagccttatttgaagaagaaggatgaayctcaggaaggcaagcagcagtatctgcagtccatagaagagcgtgagaaactggacgggctctacgagtgcattctctgtgcctgctgtagcaccagctg

SEQ ID NO: 8143 - DNA, 201 bp, Homo sapiens
gctagtgggtcctcagtggatgtaggctgggcgccgcgatgttcgacgggacaccggcggagagcgacctcggggttaaggggtggggctgacgtcaggarccaagatggcggcggtggtcgcactctccttgaggcgccggttgccggccacaacccttggcggagcctgcctgcaggcctcccgaggagcccagacagc

SEQ ID NO: 8144 - DNA, 201 bp, Homo sapiens
caggcctcccgaggagcccagacagctgcagccacagctccccgtatcaagaaatttgccatctatcgatgggacccagacaaggctggagacaaacctcrtatgcagacttatgaagttgaccttaataaatgtggccccatggtattggatgctttaatcaagattaagaatgaagttgactctactttgaccttccga

SEQ ID NO: 8145 - DNA, 123 bp, Homo sapiens
ccaagatggcggcggtggtcgcmctctccttgaggcgccggttgccggccacaacccttggcggagcctgcctgcctcccgaggagcccagacagctgcagccacagctccccgtatcaagaa

SEQ ID NO: 8146 - DNA, 201 bp, Homo sapiens
tggcggagcctgcctgcctcccgaggagcccagacagctgcagccacagctccccgtatcaagaaatttgccatctatcgatgggacccagacaaggctgragacaaacctcatatgcagacttatgaagttgaccttaataaatgtggccccatggtattggatgctttaatcaagattaagaatgaagttgactctact

SEQ ID NO: 8147 - DNA, 201 bp, Homo sapiens; identical to SEQ ID NO: 8141

SEQ ID NO: 8148 - DNA, 201 bp, Homo sapiens; identical to SEQ ID NO: 8142

SEQ ID NO: 8149 - DNA, 201 bp, Homo sapiens
cctgcctcccgaggagcccagacagctgcagccacagctccccgtatcaagaaatttgccatctatcgatgggacccagacaaggctggagacaaacctcrtatgcagacttatgaagttgaccttaataaatgtggccccatggtattggatgctttaatcaagattaagaatgaagttgactctactttgaccttccga

SEQ ID NO: 8150 - DNA, 201 bp, Homo sapiens
gcatcagtggccgctggatttccagctggacagactcatttgaagacacgattagaagagatcagattggctgtggaagatggagctacagaaatcgacgyggtaattaacagaagcttggtgctgacaggccagtgggaagccctgtatgatgagattcgtcagtttcgcaaggcctgtggggaggctcatcttaaaact

SEQ ID NO: 8151 - DNA, 201 bp, Homo sapiens
agcgggcaggggcggggcgagcgctccagctggcgggaaggaggaagggccgggcgcggcgcagaggcgggcgcctaccagccggcagctccggagctgcycgcgccatgtccgcgcacaatcggggcaccgagctcgaccttagctggatctccaaaatacaagtgaatcacccggcagttctgaggcgtgcggaacaaa

SEQ ID NO: 8152 - DNA, 201 bp, Homo sapiens
catcttccaacattcaaaggctctgttataaagccaaatacccaatccgggaagatctcttaaaagctttaaatatgcatgataaaggcattactacagcygccgtttgtgtttatcccgcccgggtgtgtgatgctgtaaaagcactcaaggctgcaggctgtaatatccctgtggcatcagtggccgctggatttccag

SEQ ID NO: 8153 - DNA, 201 bp, Homo sapiens
agtactctgctctcggacattgagaggcagatttaccatcatgtgactggaagatatgcagcttatcatgatcttccaatgtcttaaatcagtcaccagtwccagaaaagttctttacgacaatgtttaaaaattatttttctacgtaattgctaaaattatttaattaaaaaattgggcagtaggtaactggcattcctc

SEQ ID NO: 8154 - DNA, 201 bp, Homo sapiens; identical to SEQ ID NO: 8150

SEQ ID NO: 8155 - DNA, 201 bp, Homo sapiens; identical to SEQ ID NO: 8151

SEQ ID NO: 8156 - DNA, 201 bp, Homo sapiens
atctccaaaatacaagtgaatcacccggcagttctgaggcgtgcggaacaaatccaggctcgcagaaccgtgaaaaaggagtggcaggcattactacagcygccgtttgtgtttatcccgcccgggtgtgtgatgctgtaaaagcactcaaggctgcaggctgtaatatccctgtggcatcagtggccgctggatttccag

SEQ ID NO: 8157 - DNA, 201 bp, Homo sapiens; identical to SEQ ID NO: 8153

SEQ ID NO: 8158 - DNA, 201 bp, Homo sapiens; identical to SEQ ID NO: 8150

SEQ ID NO: 8159 - DNA, 201 bp, Homo sapiens
agcgggcaggggcggggcgagcgctccagctggcgggaaggaggaagggccgggcgcggcgcagaggcgggcgcctaccagccggcagctccggagctgcycgcgccatgtccgcgcacaatcggggcaccgagctcgtttgtttcagagaagatgcaatttatcctgagggagaatggaaaagtccaaactttggtagat

SEQ ID NO: 8160 - DNA, 201 bp, Homo sapiens; identical to SEQ ID NO: 8152

SEQ ID NO: 8161 - DNA, 201 bp, Homo sapiens; identical to SEQ ID NO: 8153

SEQ ID NO: 8162 - DNA, 201 bp, Homo sapiens; identical to SEQ ID NO: 8150

SEQ ID NO: 8163 - DNA, 201 bp, Homo sapiens; identical to SEQ ID NO: 8153

SEQ ID NO: 8164 - DNA, 201 bp, Homo sapiens; identical to SEQ ID NO: 8152

SEQ ID NO: 8165 - DNA, 201 bp, Homo sapiens
tctgcgactccaatgccactgcactggagcttcccggccttcctctttccctgccccagcccagcatccccgcggctgtcccgcagagtgctccaccggakccccaccgggaagagaccgtgaccgccaccgccacttcccaggtagcccagcagcctccagccgctgccgcccctggggaacaggccgtcgcgggccctg

SEQ ID NO: 8166 - DNA, 201 bp, Homo sapiens
tcctctgtcttcacagaatctcgagtgagcagccaacagacagtttcatatggttcccaacatgaacaggcacattctacaggcacagtcccagggcatayaccttctactgtccaagcacagtctcagccccatggggtatatccaccctcaagtgtggcacaggggcagagccagggtcagccatcctcaagtagctta

SEQ ID NO: 8167 - DNA, 201 bp, Homo sapiens
aggatcttgatgctcaattgagaagaacacttagtccagagattatcacagtgacttctgcggttggtcctgtgtccatggcggctccaacagcaatcacrgaagcaggaacacagcctcagaagggtgtttctcaagtcaaagaaggccctgtcctagcaactagttcaggagctggtgtttttaagatgggacgatttc

SEQ ID NO: 8168 - DNA, 201 bp, Homo sapiens
acaaagtagcaattcctgaagtgaaggaaattattgaaggatgcatacgacaaaacaaagatgaaagatattccatcaaagaccttttgaaccatgccttyttccaagaggaaacaggagtacgggtagaattagcagaagaagatgatggagaaaaaatagccataaaattatggctacgtattgaagatattaagaaat

SEQ ID NO: 8169 - DNA, 201 bp, Homo sapiens
tttagcacaagcccccactacatcctcccagcaagcagttttggagagtactcagggagtctctcaggttgctcctgcagagccagttgcagtagcacagmcccaagctacccagccgaccactttggcttcctctgtagacagtgcacattcagatgttgcttcaggtatgagtgatggcaatgagaacgtcccatcttc

SEQ ID NO: 8170 - DNA, 201 bp, Homo sapiens
cagcaacctctagaggatcttgatgctcaattgagaagaacacttagtccagagattatcacagtgacttctgcggttggtcctgtgtccatggcggctcyaacagcaatcacagaagcaggaacacagcctcagaagggtgtttctcaagtcaaagaaggccctgtcctagcaactagttcaggagctggtgtttttaag

SEQ ID NO: 8171 - DNA, 201 bp, Homo sapiens
ccgccgcagctgggcccagcggtccgcctgtccctcgttgcggcttgtcggtgctgagtgaggcgtcgtccgggtcggcgcgaacccgcccggccgcggtkccctgcagacctctgcgcgggcggctcggcccttcacgcccttttcgttcacgaatccgagcccgctcgcctctctccagcgaaccgaccatgtctggcg

SEQ ID NO: 8172 - DNA, 201 bp, Homo sapiens
agcctttctgctccaggtcaaggtaataaagcaaccatcatcgtccaaaaacaataaaatggagatgttgccatacctgggacaaaagcctgttaaggcgsgttgggagactagctgaccagaacacagcctgtgtgttgtacactgaagaatctgggtgaaaagggaagtggagtgataatgagaatcggtgggctcact

SEQ ID NO: 8173 - DNA, 201 bp, Homo sapiens
agggaatacagcagacagcccctcctcaacagacagtgcagtattcactttcacagacatcaacctccagtgaggccactactgcacagccagtgagtcarcctcaagctccacaagtcttgcctcaagtatcagctggaaaacagcttccagtttcccagccagtaccaactatccaaggcgaacctcagatcccagttg

SEQ ID NO: 8174 - DNA, 201 bp, Homo sapiens
tacgacaaaacaaagatgaaagatattccatcaaagaccttttgaaccatgccttcttccaagaggaaacaggagtacgggtagaattagcagaagaagaygatggagaaaaaatagccataaaattatggctacgtattgaagatattaagaaattaaagggaaaatacaaagataatgaagctattgagttttcttttg

SEQ ID NO: 8175 - DNA, 201 bp, Homo sapiens
ccccgcggctgtcccgcagagtgctccaccggagccccaccgggaagagaccgtgaccgccaccgccacttcccaggtagcccagcagcctccagccgctrccgcccctggggaacaggccgtcgcgggccctgccccctcgactgtccccagcagtaccagcaaagaccgcccagtgtcccagcctagccttgtggggag

SEQ ID NO: 8176 - DNA, 201 bp, Homo sapiens
aatggagatgttgccatacctgggacaaaagcctgttaaggcgggttgggagactagctgaccagaacacagcctgtgtgttgtacactgaagaatctggrtgaaaagggaagtggagtgataatgagaatcggtgggctcactgctcccattaggtgaaattactttttttcaaggaattacagtgaaaagttacatctg

SEQ ID NO: 8177 - DNA, 201 bp, Homo sapiens
  misc_feature (1)...(201): n = A,T,C or G, or insertion/deletion polymorphism (see Tables 1-2)
agtacaggcgccgccgccacactatggacaaggacagccgtggggcggccgcgaccactaccaccactgagcaccgcttcttccgccggagcgtcatctgngactccaatgccactgcactggagcttcccggccttcctctttccctgccccagcccagcatccccgcggctgtcccgcagagtgctccaccggagcccc

SEQ ID NO: 8178 - DNA, 201 bp, Homo sapiens
cctgaggcagatcaacatcaacaactacagtaccagcaacccagtatatctgtgttatctgatgggacggttgacagtggtcagggatcctctgtcttcayagaatctcgagtgagcagccaacagacagtttcatatggttcccaacatgaacaggcacattctacaggcacagtcccagggcatataccttctactgtc

SEQ ID NO: 8179 - DNA, 201 bp, Homo sapiens
aggacaagatcactgacacaaagaaagaaggaccagtggcatctcctccttttatggatttggaacaagctgttcttcctgctgtgataccaaagaaagaraagcctgaactgtcagagccttcacatctaaatgggccgtcttctgacccggaggccgcttttttaagtagggatgtggatgatggttccggtagtccac

SEQ ID NO: 8180 - DNA, 201 bp, Homo sapiens
  misc_feature (1)...(201): n = A,T,C or G, or insertion/deletion polymorphism (see Tables 1-2)
ctcagagccctggaatgaacttgtctcactctgcatcatcccttagtctacaacaggccttttctgaacttagacgtgcccaaatgacagaaggacccaanacagcacctccaaactttagtcatacaggaccaacatttccagtagtacctcctttcttaagtagcattgctggagtcccaactacagcagcagccacag

SEQ ID NO: 8181 - DNA, 201 bp, Homo sapiens
tgacagaaggacccaacacagcacctccaaactttagtcatacaggaccaacatttccagtagtacctcctttcttaagtagcattgctggagtcccaacyacagcagcagccacagcaccagtccctgcaacaagcagccctcctaatgacatttccacatcagtaattcagtctgaggttacagtgcccactgaagagg

SEQ ID NO: 8182 - DNA, 201 bp, Homo sapiens
cgacacaaccctcggttgttccagtccactctggtgctcatttccttccagtgggacagccgctccctactcccttgctccctcagtaccctgtctctcarattcccatatcaactcctcatgtgtctacggctcagacaggtttctcatcccttcccatcacaatggcagctggcattactcagcctctgctcacgttgg

SEQ ID NO: 8183 - DNA, 201 bp, Homo sapiens
agcggagctcgggccccgcggtgagcggccctcccctccccgccgttccctcctccgtcagcccccggcaccggcccgggaggagacgggtttgccaggcrtggggcgggcggggaggcctcggggaagggggggcccgctcctcaggcgccgaggctccgaggctccggcccttcgcctctgggcgatgggcgacctgtg

SEQ ID NO: 8184 - DNA, 201 bp, Homo sapiens
gcgagcagctgccaccttttccaggaccttctctaacccagtcccagcaacctctagaggatcttgatgctcaattgagaagaacacttagtccagagatkatcacagtgacttctgcggttggtcctgtgtccatggcggctccaacagcaatcacagaagcaggaacacagcctcagaagggtgtttctcaagtcaaag

SEQ ID NO: 8185 - DNA, 201 bp, Homo sapiens
gctgtagtatctcagcaggcagcaggcagcactactgtgggagccacattaacatcagtttctaccaccacttcattcccaagcacagcttcacagctgtscattcagcttagcagcagtacttctactcctactttagctgaaaccgtggtagttagcgcacactcactagataagacatctcatagcagtacaactgga

SEQ ID NO: 8186 - DNA, 201 bp, Homo sapiens
acagtaccagcaacccagtatatctgtgttatctgatgggacggttgacagtggtcagggatcctctgtcttcacagaatctcgagtgagcagccaacagrcagtttcatatggttcccaacatgaacaggcacattctacaggcacagtcccagggcatataccttctactgtccaagcacagtctcagccccatggggt

SEQ ID NO: 8187 - DNA, 201 bp, Homo sapiens
aggagaaatatgatgaatccgttgacgtttatgcttttgggatgtgcatgcttgagatggctacatctgaatatccttactcggagtgccaaaatgctgcrcagatctaccgtcgcgtgaccagtggggtgaagccagccagttttgacaaagtagcaattcctgaagtgaaggaaattattgaaggatgcatacgacaaa

SEQ ID NO: 8188 - DNA, 201 bp, Homo sapiens
agtgattgctgaaaaaattcccacagaggaaagagcttttagtcatattagaacaagaattgaaaagacttgggcatctgggtgagaagaatgaaaaaaayataggtactggcttatgtgcctttgccacagtttcacagaaattagagatcagtctcttcacaggaagaatgcacttgattggtaaggagggcaaactag

SEQ ID NO: 8189 - DNA, 201 bp, Homo sapiens; identical to SEQ ID NO: 8165

SEQ ID NO: 8190 - DNA, 201 bp, Homo sapiens; identical to SEQ ID NO: 8166

SEQ ID NO: 8191 - DNA, 201 bp, Homo sapiens; identical to SEQ ID NO: 8167

SEQ ID NO: 8192 - DNA, 201 bp, Homo sapiens; identical to SEQ ID NO: 8168

SEQ ID NO: 8193 - DNA, 201 bp, Homo sapiens; identical to SEQ ID NO: 8169

SEQ ID NO: 8194 - DNA, 201 bp, Homo sapiens; identical to SEQ ID NO: 8170

SEQ ID NO: 8195 - DNA, 201 bp, Homo sapiens; identical to SEQ ID NO: 8171

SEQ ID NO: 8196 - DNA, 201 bp, Homo sapiens; identical to SEQ ID NO: 8173

SEQ ID NO: 8197 - DNA, 201 bp, Homo sapiens; identical to SEQ ID NO: 8174

SEQ ID NO: 8198 - DNA, 201 bp, Homo sapiens; identical to SEQ ID NO: 8175

SEQ ID NO: 8199 - DNA, 181 bp, Homo sapiens
actccctcaagaatccgaaccacaggacaaaaaccacctactgggctctctcctaccctgccctcctcccttttttttacccctctcttttttattttttytttgctctttagaacccagtgaaaaattaagcaaaagatattagcagctttgactgcagcattagcaattaggaaaaaaa

SEQ ID NO: 8200 - DNA, 201 bp, Homo sapiens; identical to SEQ ID NO: 8177
  misc_feature (1)...(201): n = A,T,C or G, or insertion/deletion polymorphism (see Tables 1-2)

SEQ ID NO: 8201 - DNA, 201 bp, Homo sapiens; identical to SEQ ID NO: 8178

SEQ ID NO: 8202 - DNA, 201 bp, Homo sapiens
  misc_feature (1)...(201): n = A,T,C or G, or insertion/deletion polymorphism (see Tables 1-2)
agggcacattcacagatgacttgcacaagttggtagacaattgggcccgagatgccatgaatctctcaggcaggagaggaagcaaagggcacatgaattangagggccctggaatggcaaggaagttctctgcacctgggcaactgtgcatctccatgacctcgaacctgggtggctctgcccccatctctgcagcatcag

SEQ ID NO: 8203 - DNA, 201 bp, Homo sapiens; identical to SEQ ID NO: 8180
  misc_feature (1)...(201): n = A,T,C or G, or insertion/deletion polymorphism (see Tables 1-2)

SEQ ID NO: 8204 - DNA, 201 bp, Homo sapiens; identical to SEQ ID NO: 8179

SEQ ID NO: 8205 - DNA, 201 bp, Homo sapiens; identical to SEQ ID NO: 8181

SEQ ID NO: 8206 - DNA, 201 bp, Homo sapiens; identical to SEQ ID NO: 8182

SEQ ID NO: 8207 - DNA, 201 bp, Homo sapiens; identical to SEQ ID NO: 8183

SEQ ID NO: 8208 - DNA, 201 bp, Homo sapiens; identical to SEQ ID NO: 8184

SEQ ID NO: 8209 - DNA, 201 bp, Homo sapiens; identical to SEQ ID NO: 8185

SEQ ID NO: 8210 - DNA, 201 bp, Homo sapiens; identical to SEQ ID NO: 8186

SEQ ID NO: 8211 - DNA, 201 bp, Homo sapiens; identical to SEQ ID NO: 8187

SEQ ID NO: 8212 - DNA, 201 bp, Homo sapiens
tttatatgccctttagattattagaaagagattggctactattcttctttgctgtgtgcttcttttttttttttttgcatgtcttgctgttttgctaattyattgacccccaacctgctctaactcaccttcctcatttctgtcacagggcttcccacctcgactgccaccacagtacccaggagattcaaatattgctcc

SEQ ID NO: 8213 - DNA, 201 bp, Homo sapiens; identical to SEQ ID NO: 8167

SEQ ID NO: 8214 - DNA, 201 bp, Homo sapiens; identical to SEQ ID NO: 8169

SEQ ID NO: 8215 - DNA, 201 bp, Homo sapiens; identical to SEQ ID NO: 8170

SEQ ID NO: 8216 - DNA, 201 bp, Homo sapiens; identical to SEQ ID NO: 8172

SEQ ID NO: 8217 - DNA, 201 bp, Homo sapiens; identical to SEQ ID NO: 8184

SEQ ID NO: 8218 - DNA, 201 bp, Homo sapiens; identical to SEQ ID NO: 8176

SEQ ID NO: 8219 - DNA, 201 bp, Homo sapiens; identical to SEQ ID NO: 8179

SEQ ID NO: 8220 - DNA, 201 bp, Homo sapiens; identical to SEQ ID NO: 8180
  misc_feature (1)...(201): n = A,T,C or G, or insertion/deletion polymorphism (see Tables 1-2)

SEQ ID NO: 8221 - DNA, 201 bp, Homo sapiens; identical to SEQ ID NO: 8185

SEQ ID NO: 8222 - DNA, 201 bp, Homo sapiens; identical to SEQ ID NO: 8181

SEQ ID NO: 8223 - DNA, 201 bp, Homo sapiens; identical to SEQ ID NO: 8188

SEQ ID NO: 8224 - DNA, 201 bp, Homo sapiens; identical to SEQ ID NO: 8165

SEQ ID NO: 8225 - DNA, 201 bp, Homo sapiens
tcctctgtcttcacagaatctcgagtgagcagccaacagacagtttcatatggttcccaacatgaacaggcacattctacaggcacagtcccagggcatayaccttctactgtccaagcacagtctcagccccatggggtatatccaccctcaagtgtgcagggaatacagcagacagcccctcctcaacagacagtgcag

SEQ ID NO: 8226 - DNA, 201 bp, Homo sapiens; identical to SEQ ID NO: 8167

SEQ ID NO: 8227 - DNA, 201 bp, Homo sapiens; identical to SEQ ID NO: 8168

SEQ ID NO: 8228 - DNA, 201 bp, Homo sapiens
acctcaagctccacaagtcttgcctcaagtatcagctggaaaacagagtactcagggagtctctcaggttgctcctgcagagccagttgcagtagcacagmcccaagctacccagccgaccactttggcttcctctgtagacagtgcacattcagatgttgcttcaggtatgagtgatggcaatgagaacgtcccatcttc

SEQ ID NO: 8229 - DNA, 201 bp, Homo sapiens; identical to SEQ ID NO: 8170

SEQ ID NO: 8230 - DNA, 201 bp, Homo sapiens; identical to SEQ ID NO: 8171

SEQ ID NO: 8231 - DNA, 201 bp, Homo sapiens
agggaatacagcagacagcccctcctcaacagacagtgcagtattcactttcacagacatcaacctccagtgaggccactactgcacagccagtgagtcarcctcaagctccacaagtcttgcctcaagtatcagctggaaaacagagtactcagggagtctctcaggttgctcctgcagagccagttgcagtagcacagc

SEQ ID NO: 8232 - DNA, 201 bp, Homo sapiens; identical to SEQ ID NO: 8174

SEQ ID NO: 8233 - DNA, 201 bp, Homo sapiens; identical to SEQ ID NO: 8175

SEQ ID NO: 8234 - DNA, 181 bp, Homo sapiens; identical to SEQ ID NO: 8199

SEQ ID NO: 8235 - DNA, 201 bp, Homo sapiens; identical to SEQ ID NO: 8177
  misc_feature (1)...(201): n = A,T,C or G, or insertion/deletion polymorphism (see Tables 1-2)

SEQ ID NO: 8236 - DNA, 201 bp, Homo sapiens; identical to SEQ ID NO: 8178

SEQ ID NO: 8237 - DNA, 201 bp, Homo sapiens; identical to SEQ ID NO: 8202
  misc_feature (1)...(201): n = A,T,C or G, or insertion/deletion polymorphism (see Tables 1-2)

SEQ ID NO: 8238 - DNA, 201 bp, Homo sapiens; identical to SEQ ID NO: 8179

SEQ ID NO: 8239 - DNA, 201 bp, Homo sapiens; identical to SEQ ID NO: 8180
  misc_feature (1)...(201): n = A,T,C or G, or insertion/deletion polymorphism (see Tables 1-2)

SEQ ID NO: 8240 - DNA, 201 bp, Homo sapiens; identical to SEQ ID NO: 8181

SEQ ID NO: 8241 - DNA, 201 bp, Homo sapiens; identical to SEQ ID NO: 8183

SEQ ID NO: 8242 - DNA, 201 bp, Homo sapiens; identical to SEQ ID NO: 8184

SEQ ID NO: 8243 - DNA, 201 bp, Homo sapiens; identical to SEQ ID NO: 8185

SEQ ID NO: 8244 - DNA, 201 bp, Homo sapiens; identical to SEQ ID NO: 8186

SEQ ID NO: 8245 - DNA, 201 bp, Homo sapiens; identical to SEQ ID NO: 8187

SEQ ID NO: 8246 - DNA, 152 bp, Homo sapiens
atggttcccaacatgaacaggcacattctacaggcacagtcccagggcatayaccttctactgtccaagcacagtctcagccccatggggtatatccaccctcaagtgtgcagcagggaatacagcagacagcccctcctcaacagacagtg

SEQ ID NO: 8247 - DNA, 201 bp, Homo sapiens; identical to SEQ ID NO: 8167

SEQ ID NO: 8248 - DNA, 201 bp, Homo sapiens; identical to SEQ ID NO: 8228

SEQ ID NO: 8249 - DNA, 201 bp, Homo sapiens; identical to SEQ ID NO: 8170

SEQ ID NO: 8250 - DNA, 201 bp, Homo sapiens; identical to SEQ ID NO: 8184

SEQ ID NO: 8251 - DNA, 201 bp, Homo sapiens; identical to SEQ ID NO: 8231

SEQ ID NO: 8252 - DNA, 181 bp, Homo sapiens; identical to SEQ ID NO: 8199

SEQ ID NO: 8253 - DNA, 201 bp, Homo sapiens; identical to SEQ ID NO: 8202
  misc_feature (1)...(201): n = A,T,C or G, or insertion/deletion polymorphism (see Tables 1-2)

SEQ ID NO: 8254 - DNA, 201 bp, Homo sapiens; identical to SEQ ID NO: 8179

SEQ ID NO: 8255 - DNA, 201 bp, Homo sapiens; identical to SEQ ID NO: 8180
  misc_feature (1)...(201): n = A,T,C or G, or insertion/deletion polymorphism (see Tables 1-2)

SEQ ID NO: 8256 - DNA, 201 bp, Homo sapiens; identical to SEQ ID NO: 8185

SEQ ID NO: 8257 - DNA, 201 bp, Homo sapiens; identical to SEQ ID NO: 8181

SEQ ID NO: 8258 - DNA, 201 bp, Homo sapiens; identical to SEQ ID NO: 8165

SEQ ID NO: 8259 - DNA, 201 bp, Homo sapiens; identical to SEQ ID NO: 8225

SEQ ID NO: 8260 - DNA, 201 bp, Homo sapiens
attgctctcagaaaaactgtttggattgctttcctcttgttgcacatgtaccatgcatttctcagcttggggtactacattttgtggaaagttaatctathtatctttccacatctgaattaatcattctaggaaagaatacttattcctactcatttcctttatgatgtccaaatggttgcaggatcataatctattgtg

SEQ ID NO: 8261 - DNA, 201 bp, Homo sapiens; identical to SEQ ID NO: 8167

SEQ ID NO: 8262 - DNA, 201 bp, Homo sapiens; identical to SEQ ID NO: 8168

SEQ ID NO: 8263 - DNA, 201 bp, Homo sapiens; identical to SEQ ID NO: 8228

SEQ ID NO: 8264 - DNA, 153 bp, Homo sapiens
cagtggagcctcatgcagcacattatcatttgttatttgggtttaataataattttgacatcttttcactcatacacaaaaaaagtcagaactggtgttayttactgttgatttcatcctcctgtgtatgaaataacaagcctagaggaatga

SEQ ID NO: 8265 - DNA, 201 bp, Homo sapiens; identical to SEQ ID NO: 8170

SEQ ID NO: 8266 - DNA, 201 bp, Homo sapiens; identical to SEQ ID NO: 8171

SEQ ID NO: 8267 - DNA, 201 bp, Homo sapiens; identical to SEQ ID NO: 8231

SEQ ID NO: 8268 - DNA, 201 bp, Homo sapiens; identical to SEQ ID NO: 8174

SEQ ID NO: 8269 - DNA, 201 bp, Homo sapiens; identical to SEQ ID NO: 8175

SEQ ID NO: 8270 - DNA, 201 bp, Homo sapiens
actccctcaagaatccgaaccacaggacaaaaaccacctactgggctctctcctaccctgccctcctcccttttttttacccctctcttttttattttttytttgctctttagaacccagtgaaaaataccagggtactggggtgcaactctttcttatgataggtcattagtgctttaagcaaaagatattagcagcttt

SEQ ID NO: 8271 - DNA, 201 bp, Homo sapiens; identical to SEQ ID NO: 8177
  misc_feature (1)...(201): n = A,T,C or G, or insertion/deletion polymorphism (see Tables 1-2)

SEQ ID NO: 8272 - DNA, 201 bp, Homo sapiens; identical to SEQ ID NO: 8178

SEQ ID NO: 8273 - DNA, 201 bp, Homo sapiens; identical to SEQ ID NO: 8202
  misc_feature (1)...(201): n = A,T,C or G, or insertion/deletion polymorphism (see Tables 1-2)

SEQ ID NO: 8274 - DNA, 201 bp, Homo sapiens; identical to SEQ ID NO: 8179

SEQ ID NO: 8275 - DNA, 201 bp, Homo sapiens; identical to SEQ ID NO: 8180
  misc_feature (1)...(201): n = A,T,C or G, or insertion/deletion polymorphism (see Tables 1-2)

SEQ ID NO: 8276 - DNA, 201 bp, Homo sapiens; identical to SEQ ID NO: 8181

SEQ ID NO: 8277 - DNA, 201 bp, Homo sapiens; identical to SEQ ID NO: 8183

SEQ ID NO: 8278 - DNA, 201 bp, Homo sapiens; identical to SEQ ID NO: 8184

SEQ ID NO: 8279 - DNA, 201 bp, Homo sapiens
atggcatattctgggaatcaccaccaccaccaccactaccacagaaagaggctggaggctcctgtaccctgttcattccttaagggccctgcttcccttartaagtaagtaagttggtctacggccctaaatatgcaaatgagagctgaaggtttttaaaaggtagaaaggaaaagggcaagggcttccacccctgcttta

SEQ ID NO: 8280 - DNA, 118 bp, Homo sapiens
tttgggtttaataataattttgacatcttttcactcatacacaaaaaaagtcagaactggtgttatttactgttgatttcatcctcctgtgtatgaaatamcaagcctagaggaatga

SEQ ID NO: 8281 - DNA, 201 bp, Homo sapiens; identical to SEQ ID NO: 8185

SEQ ID NO: 8282 - DNA, 201 bp, Homo sapiens; identical to SEQ ID NO: 8186

SEQ ID NO: 8283 - DNA, 201 bp, Homo sapiens
gactcttagttgggaaactgaaaatatttccaaccttttacccacgtcaatggcatattctgggaatcaccaccaccaccaccactaccacagaaagaggstggaggctcctgtaccctgttcattccttaagggccctgcttcccttaataagtaagtaagttggtctacggccctaaatatgcaaatgagagctgaagg

SEQ ID NO: 8284 - DNA, 201 bp, Homo sapiens; identical to SEQ ID NO: 8187

SEQ ID NO: 8285 - DNA, 201 bp, Homo sapiens
cttgctggacattttagtgccttggacttctattgcttctgccattagcatcaacttaccagaccccagatcaataaagggcatgtggaaggaaatcgtargtccatgtgaccccagcagtccagcagtggttatgccaaagggaaattgaaaaagtatttttttaagtcattcaacaactttgtctagagcaggtgtaag

SEQ ID NO: 8286 - DNA, 201 bp, Homo sapiens; identical to SEQ ID NO: 8165

SEQ ID NO: 8287 - DNA, 201 bp, Homo sapiens; identical to SEQ ID NO: 8166

SEQ ID NO: 8288 - DNA, 201 bp, Homo sapiens; identical to SEQ ID NO: 8260

SEQ ID NO: 8289 - DNA, 201 bp, Homo sapiens; identical to SEQ ID NO: 8167

SEQ ID NO: 8290 - DNA, 201 bp, Homo sapiens; identical to SEQ ID NO: 8168

SEQ ID NO: 8291 - DNA, 201 bp, Homo sapiens; identical to SEQ ID NO: 8169

SEQ ID NO: 8292 - DNA, 153 bp, Homo sapiens; identical to SEQ ID NO: 8264

SEQ ID NO: 8293 - DNA, 201 bp, Homo sapiens; identical to SEQ ID NO: 8170

SEQ ID NO: 8294 - DNA, 201 bp, Homo sapiens; identical to SEQ ID NO: 8171

SEQ ID NO: 8295 - DNA, 201 bp, Homo sapiens; identical to SEQ ID NO: 8173

SEQ ID NO: 8296 - DNA, 201 bp, Homo sapiens; identical to SEQ ID NO: 8174

SEQ ID NO: 8297 - DNA, 201 bp, Homo sapiens; identical to SEQ ID NO: 8175

SEQ ID NO: 8298 - DNA, 201 bp, Homo sapiens; identical to SEQ ID NO: 8270

SEQ ID NO: 8299 - DNA, 201 bp, Homo sapiens; identical to SEQ ID NO: 8177
  misc_feature (1)...(201): n = A,T,C or G, or insertion/deletion polymorphism (see Tables 1-2)

SEQ ID NO: 8300 - DNA, 201 bp, Homo sapiens; identical to SEQ ID NO: 8178

SEQ ID NO: 8301 - DNA, 201 bp, Homo sapiens; identical to SEQ ID NO: 8202
  misc_feature (1)...(201): n = A,T,C or G, or insertion/deletion polymorphism (see Tables 1-2)

SEQ ID NO: 8302 - DNA, 201 bp, Homo sapiens; identical to SEQ ID NO: 8180
  misc_feature (1)...(201): n = A,T,C or G, or insertion/deletion polymorphism (see Tables 1-2)

SEQ ID NO: 8303 - DNA, 201 bp, Homo sapiens; identical to SEQ ID NO: 8179

SEQ ID NO: 8304 - DNA, 201 bp, Homo sapiens; identical to SEQ ID NO: 8181

SEQ ID NO: 8305 - DNA, 201 bp, Homo sapiens; identical to SEQ ID NO: 8182

SEQ ID NO: 8306 - DNA, 201 bp, Homo sapiens; identical to SEQ ID NO: 8183

SEQ ID NO: 8307 - DNA, 201 bp, Homo sapiens; identical to SEQ ID NO: 8184

SEQ ID NO: 8308 - DNA, 201 bp, Homo sapiens; identical to SEQ ID NO: 8279

SEQ ID NO: 8309 - DNA, 118 bp, Homo sapiens; identical to SEQ ID NO: 8280

SEQ ID NO: 8310 - DNA, 201 bp, Homo sapiens; identical to SEQ ID NO: 8185

SEQ ID NO: 8311 - DNA, 201 bp, Homo sapiens; identical to SEQ ID NO: 8186

SEQ ID NO: 8312 - DNA, 201 bp, Homo sapiens; identical to SEQ ID NO: 8283

SEQ ID NO: 8313 - DNA, 201 bp, Homo sapiens; identical to SEQ ID NO: 8187

SEQ ID NO: 8314 - DNA, 201 bp, Homo sapiens; identical to SEQ ID NO: 8285

SEQ ID NO: 8315 - DNA, 201 bp, Homo sapiens
ctgggtcatggtgaagttggaaagtgagggttcaaataaaattagatctgccccctttttaaaggcatctaagaacatcccgtagaatgttcgcattgagwttaaaagcctttgaagctaatatagaagtttaatgcagaaatgtggcaagcaaaaggccaacttgcattttagagacagagcttgctagtatagaagtgc

SEQ ID NO: 8316 - DNA, 201 bp, Homo sapiens
atgcaagaattttggtgcagaaaatccagatccttttgtcccagtgctgaacactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaat

SEQ ID NO: 8317 - DNA, 201 bp, Homo sapiens
gctttccctgtggcaccctccacccccaaccagtgtctttgagcttggtgagactctgcatacattaatatgaaaagctggaaaagaattaagggctagcratttctacactgagtacttttaaaaaaataagattgacaatggtattcttttcaatatatggatagaaataatatctaaaatctgttctgaaaatattcc

SEQ ID NO: 8318 - DNA, 201 bp, Homo sapiens
cccatccttgttcaacttgttgatacactgggtgcagagaaattcctctggattctcctcatcttgctttttgaacagtatgtcacaaaaacagtgctggyggctgcctgtggcgaaaaggatgctattttagaagcagacactgaattttggttttcagtctgttgtgagtttagtgtccagcatcagatacaaagcttg

SEQ ID NO: 8319 - DNA, 201 bp, Homo sapiens
cagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcggccacaatcgacagggacaccgccttcgccattggatgtactggcctggaagagttgc

SEQ ID NO: 8320 - DNA, 201 bp, Homo sapiens
accagtgtctttgagcttggtgagactctgcatacattaatatgaaaagctggaaaagaattaagggctagcgatttctacactgagtacttttaaaaaaataagattgacaatggtattcttttcaatatatggatagaaataatatctaaaatctgttctgaaaatattcctaaatcctggcagagttctgccccagtc

SEQ ID NO: 8321 - DNA, 201 bp, Homo sapiens
  misc_feature (1)...(201): n = A,T,C or G, or insertion/deletion polymorphism (see Tables 1-2)
aatgctttttttaacccaggagtgtgactgtcacctttatcctttgttcttttgggaaacgggagagatgaaggcaacacgctgcttctaaaacagctcanacctggctgctcacacagagggcccagaaacactgggtggcacgaggaagctcctccaggattcagaatgaacccagttccattggtggttaactaagaa

SEQ ID NO: 8322 - DNA, 201 bp, Homo sapiens
  misc_feature (1)...(201): n = A,T,C or G, or insertion/deletion polymorphism (see Tables 1-2)
ctgattgatggtaataatattagacttgttaattttagcacccaaagctgacgcctcatttgcactgtaagccttaactcttctgtacagcagtatcttanatacatggtatccatgttgcagatttcactcaaagttgctctatttcaagaaaatgaagttatttagcaatcaacagaagtacttttgactgtaaagcct

SEQ ID NO: 8323 - DNA, 201 bp, Homo sapiens
acatgggtccgtttatgagcatcttgcaagagcatattggggtgatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaac

SEQ ID NO: 8324 - DNA, 201 bp, Homo sapiens
tgctatcaagatgtttagaacccttgccacaagagcagggaaatatggaatacaccaaacaattaattcttagttgtctgctcaacatctgccaaaaactrtctccagatggtggcaaaatacccaaagatattttagatgaggagaagttcaacgtggagttgatagttcagtgcatccgcctttcggagatgccgcaga

SEQ ID NO: 8325 - DNA, 201 bp, Homo sapiens
cactcatatttcatatttttatttttgggtgttgggtgccatgttacttttggtgccttaatacacctacttggattacttacaaatgttttatcacttckttacaaactgcagaaagagtaaatgatacacggtatttttatacagactgctgtgtttgtttaaacatttattattctcttcctgattgatggtaataat

SEQ ID NO: 8326 - DNA, 201 bp, Homo sapiens
gtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggaagccctggacttccgagcccagcactctgagaacgatctggag

SEQ ID NO: 8327 - DNA, 201 bp, Homo sapiens
tgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagggattgaaatcatctttaccagattacagagctgcaacatacatgataatatgtc

SEQ ID NO: 8328 - DNA, 201 bp, Homo sapiens
attcttagttgtctgctcaacatctgccaaaaactatctccagatggtggcaaaatacccaaagatattttagatgaggagaagttcaacgtggagttgayagttcagtgcatccgcctttcggagatgccgcagacccatcaccatgcccttttacttttgggcactgttgctggaatatttccggataaagttttacac

SEQ ID NO: 8329 - DNA, 201 bp, Homo sapiens
actcctcgcctaaggttcgatttgctgctttgattactgtgttagcactggctgaaaaactaaaggagaattatattgtcttgctaccagaatccattccyttcttagcagagttgatggaagatgaatgtgaagaagtagaacatcagtgccaaaagactattcagcaactggaaactgtcctgggagagccactccaga

SEQ ID NO: 8330 - DNA, 201 bp, Homo sapiens
ccttagcccagcagctgcaacgactcgccctccctcaaagtgatgccagcctcttatctagagatgaagttgcttctttgttatttgaccctaaggaagcrgccacaatcgacagggacaccgccttcgccattggatgtactggcctggaagagttgcttggaattgatccttcctttgagcagtttgaagcaccgttgt

SEQ ID NO: 8331 - DNA, 201 bp, Homo sapiens
atcaacagaagtacttttgactgtaaagcctacttttcattttgggtaggcgaacttcagccttcgtttctttgttgtgcccataaagagaagtggttctkgaatgctttttttaacccaggagtgtgactgtcacctttatcctttgttcttttgggaaacgggagagatgaaggcaacacgctgcttctaaaacagctc

SEQ ID NO: 8332 - DNA, 201 bp, Homo sapiens
  misc_feature (1)...(201): n = A,T,C or G, or insertion/deletion polymorphism (see Tables 1-2)
tcttccaataattttctgaaaaaggtagttgagagtggtggtcctgagattttaaaaggccttgaagagaggttgctggagaccgttctcggctatatcantgcagttgcacagtccatggaaaggaacgcagacaaactcaccgtgaagttctggcgcgcgctccttagtaaagcttacgacctgttagataaggtcaat

SEQ ID NO: 8333 - DNA, 201 bp, Homo sapiens
tgttgcagaaaaaaataaagaagcttgaaagtgtcattactgcagtggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatg

SEQ ID NO: 8334 - DNA, 201 bp, Homo sapiens
  misc_feature (1)...(201): n = A,T,C or G, or insertion/deletion polymorphism (see Tables 1-2)
gaaaactaatcggtgtagcaaatcagaagatgattgagttgttggctgataatataaatttaggagatccttcttcaatgttaaagatggtggaggatttnataagcgtgggtgaggaggagtcctttaacctgaagcagaaagtaacgtttcatgtgatcctgtctgtgctcgtctcttgttgttcatctttaaaagaaa

SEQ ID NO: 8335 - DNA, 201 bp, Homo sapiens
tattgtcttgctaccagaatccattcctttcttagcagagttgatggaagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttt

SEQ ID NO: 8336 - DNA, 201 bp, Homo sapiens
  misc_feature (1)...(201): n = A,T,C or G, or insertion/deletion polymorphism (see Tables 1-2)
agccttgggaaaaagccattccctcacttatgtaatgttcctgatcttattacaatacttcatgggatttctgaaacttacgatgtcagtcctcttctgcnttacatgcttccccatctggtcgtctccatcattcatcatgttacaggagaagaaactgaaggaatggatggtcaaatctacaagagacacttagaagct

SEQ ID NO: 8337 - DNA, 201 bp, Homo sapiens
  misc_feature (1)...(201): n = A,T,C or G, or insertion/deletion polymorphism (see Tables 1-2)
tagttacccgtttcctaaaactggttccagaccttttggccattgtgcagcgtaagaaaaaggaaggggaagaagaacaagcaatcaacagacagacagcnttgtataccttaaagcttttatgcaagaattttggtgcagaaaatccagatccttttgtcccagtgctgaacactgctgtgaaactgattgctccagaga

SEQ ID NO: 8338 - DNA, 201 bp, Homo sapiens
  misc_feature (1)...(201): n = A,T,C or G, or insertion/deletion polymorphism (see Tables 1-2)
gaagaacaagcaatcaacagacagacagcgttgtataccttaaagcttttatgcaagaattttggtgcagaaaatccagatccttttgtcccagtgctgancactgctgtgaaactgattgctccagagagaaaggaggagaagaatgtcctgggaagcgcgctgctgtgcatagcagaggtgacctccaccctggaggcg

SEQ ID NO: 8339 - DNA, 201 bp, Homo sapiens
gcagggactatctgcacttgctcattgggctgtttgagatgatgctcaatggtgccgatgctgttcatttcagagttctgatgaaacttttcataaaggtkcatctagaagatgtttttcagttattcaagttctgttctgttttatggacctatggttctagcctttcaaatccactaaactgcagtgtgaaaacagtgc

SEQ ID NO: 8340 - DNA, 201 bp, Homo sapiens
  misc_feature (1)...(201): n = A,T,C or G, or insertion/deletion polymorphism (see Tables 1-2)
tgatgcctctggtggatcagctggaaaacaggcttgggggagaagagaaattccaggaacgggtgacaaagcacctgataccatgcatcgcacagttttcngtggccatggcggatgactctctttggaaaccactgaactaccagattctgctaaagacgagagactcctcgcctaaggttcgatttgctgctttgatta

SEQ ID NO: 8341 - DNA, 201 bp, Homo sapiens
taagaaaaaggaaggggaagaagaacaagcaatcaacagacagacagcgttgtataccttaaagcttttatgcaagaattttggtgcagaaaatccagatscttttgtcccagtgctgaacactgctgtgaaactgattgctccagagagaaaggaggagaagaatgtcctgggaagcgcgctgctgtgcatagcagaggt

SEQ ID NO: 8342 - DNA, 201 bp, Homo sapiens
gttcaacttgttgatacactgggtgcagagaaattcctctggattctcctcatcttgctttttgaacagtatgtcacaaaaacagtgctggcggctgcctrtggcgaaaaggatgctattttagaagcagacactgaattttggttttcagtctgttgtgagtttagtgtccagcatcagatacaaagcttgatgaatatc

SEQ ID NO: 8343 - DNA, 201 bp, Homo sapiens
gaccctgaaaagtgctgcttgctgttgcagtttattttgaactgtttatacaaaatcttcctttttgatacccagcattttataagtaaagagagagcagragccttgatgatgcctctggtggatcagctggaaaacaggcttgggggagaagagaaattccaggaacgggtgacaaagcacctgataccatgcatcgca

SEQ ID NO: 8344 - DNA, 201 bp, Homo sapiens
  misc_feature (1)...(201): n = A,T,C or G, or insertion/deletion polymorphism (see Tables 1-2)
cacctgataccatgcatcgcacagttttcggtggccatggcggatgactctctttggaaaccactgaactaccagattctgctaaagacgagagactcctngcctaaggttcgatttgctgctttgattactgtgttagcactggctgaaaaactaaaggagaattatattgtcttgctaccagaatccattcctttctta

SEQ ID NO: 8345 - DNA, 201 bp, Homo sapiens
  misc_feature (1)...(201): n = A,T,C or G, or insertion/deletion polymorphism (see Tables 1-2)
gttgacattttacaacttggcagattgcattgctgaaaagctgaaagggctttttactctgtttgccggccacttagtgaagccttttgctgacaccttgnaccaggtgaacatctccaaaacagatgaagcattttttgactctgaaaatgaccctgaaaagtgctgcttgctgttgcagtttattttgaactgtttata

SEQ ID NO: 8346 - DNA, 201 bp, Homo sapiens
cgaggtacttaagatagccgctgacatattaattaaagaagagatactgagtgaaaatgatcagttgtcaaatcaggtggttgtatgtttgctgccatttytggttatcaataatgatgatacggaatctgctgagatgaaaattgctatatatttatcaaaatcaggaatctgctccctgcaccctctattaagaggctg

SEQ ID NO: 8347 - DNA, 201 bp, Homo sapiens; identical to SEQ ID NO: 8335

SEQ ID NO: 8348 - DNA, 201 bp, Homo sapiens
  misc_feature (1)...(201): n = A,T,C or G, or insertion/deletion polymorphism (see Tables 1-2)
ggtgctagtcagaggccattccctcacttatgtaatgttcctgatcttattacaatacttcatgggatttctgaaacttacgatgtcagtcctcttctgcnttacatgcttccccatctggtcgtctccatcattcatcatgttacaggagaagaaactgaaggaatggatggtcaaatctacaagagacacttagaagct

SEQ ID NO: 8349 - DNA, 201 bp, Homo sapiens; identical to SEQ ID NO: 8315

SEQ ID NO: 8350 - DNA, 201 bp, Homo sapiens; identical to SEQ ID NO: 8316

SEQ ID NO: 8351 - DNA, 201 bp, Homo sapiens; identical to SEQ ID NO: 8317

SEQ ID NO: 8352 - DNA, 201 bp, Homo sapiens; identical to SEQ ID NO: 8318

SEQ ID NO: 8353 - DNA, 201 bp, Homo sapiens; identical to SEQ ID NO: 8319

SEQ ID NO: 8354 - DNA, 201 bp, Homo sapiens; identical to SEQ ID NO: 8320

SEQ ID NO: 8355 - DNA, 201 bp, Homo sapiens; identical to SEQ ID NO: 8337
  misc_feature (1)...(201): n = A,T,C or G, or insertion/deletion polymorphism (see Tables 1-2)

SEQ ID NO: 8356 - DNA, 201 bp, Homo sapiens; identical to SEQ ID NO: 8338
  misc_feature (1)...(201): n = A,T,C or G, or insertion/deletion polymorphism (see Tables 1-2)

SEQ ID NO: 8357 - DNA, 201 bp, Homo sapiens; identical to SEQ ID NO: 8321
  misc_feature (1)...(201): n = A,T,C or G, or insertion/deletion polymorphism (see Tables 1-2)

SEQ ID NO: 8358 - DNA, 201 bp, Homo sapiens; identical to SEQ ID NO: 8322
  misc_feature (1)...(201): n = A,T,C or G, or insertion/deletion polymorphism (see Tables 1-2)

SEQ ID NO: 8359 - DNA, 201 bp, Homo sapiens; identical to SEQ ID NO: 8323

SEQ ID NO: 8360 - DNA, 201 bp, Homo sapiens; identical to SEQ ID NO: 8339

SEQ ID NO: 8361 - DNA, 201 bp, Homo sapiens; identical to SEQ ID NO: 8324

SEQ ID NO: 8362 - DNA, 201 bp, Homo sapiens
cactcatatttcatatttttatttttgggtgttgggtgccatgttacttttggtgccttaatacacctacttggattacttacaaatgttttatcacttckttacaaaatccccacctggcttgtgctgccacataagcctctcctgcctatcgtatagagctgcagaaagagtaaatgatacacggtatttttatacaga

SEQ ID NO: 8363 - DNA, 201 bp, Homo sapiens; identical to SEQ ID NO: 8326

SEQ ID NO: 8364 - DNA, 201 bp, Homo sapiens; identical to SEQ ID NO: 8340
  misc_feature (1)...(201): n = A,T,C or G, or insertion/deletion polymorphism (see Tables 1-2)

SEQ ID NO: 8365 - DNA, 201 bp, Homo sapiens
tgaaggtttttgctgagtacccgggcagctcagctcagttgagggtgctcttggctttctatgcttctaccatagtgtcggcgctggtagctgcagaggaygtatcagacaatatcatcgccaaactatttccctatatccaaaagtctttgtacctcactggaaggaggacggagcagacagtctctttgaggcatcatc

SEQ ID NO: 8366 - DNA, 201 bp, Homo sapiens; identical to SEQ ID NO: 8328

SEQ ID NO: 8367 - DNA, 201 bp, Homo sapiens; identical to SEQ ID NO: 8329

SEQ ID NO: 8368 - DNA, 201 bp, Homo sapiens; identical to SEQ ID NO: 8342

SEQ ID NO: 8369 - DNA, 201 bp, Homo sapiens; identical to SEQ ID NO: 8341

SEQ ID NO: 8370 - DNA, 201 bp, Homo sapiens; identical to SEQ ID NO: 8343

SEQ ID NO: 8371 - DNA, 201 bp, Homo sapiens; identical to SEQ ID NO: 8330

SEQ ID NO: 8372 - DNA, 201 bp, Homo sapiens; identical to SEQ ID NO: 8331

SEQ ID NO: 8373 - DNA, 201 bp, Homo sapiens; identical to SEQ ID NO: 8344
  misc_feature (1)...(201): n = A,T,C or G, or insertion/deletion polymorphism (see Tables 1-2)

SEQ ID NO: 8374 - DNA, 201 bp, Homo sapiens; identical to SEQ ID NO: 8345
  misc_feature (1)...(201): n = A,T,C or G, or insertion/deletion polymorphism (see Tables 1-2)

SEQ ID NO: 8375 - DNA, 201 bp, Homo sapiens; identical to SEQ ID NO: 8332
  misc_feature (1)...(201): n = A,T,C or G, or insertion/deletion polymorphism (see Tables 1-2)

SEQ ID NO: 8376 - DNA, 201 bp, Homo sapiens; identical to SEQ ID NO: 8346

SEQ ID NO: 8377 - DNA, 201 bp, Homo sapiens
tggctgataatataaatttaggagatccttcttcaatgttaaagatggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatg

SEQ ID NO: 8378 - DNA, 201 bp, Homo sapiens; identical to SEQ ID NO: 8335

SEQ ID NO: 8379 - DNA, 201 bp, Homo sapiens; identical to SEQ ID NO: 8348
  misc_feature (1)...(201): n = A,T,C or G, or insertion/deletion polymorphism (see Tables 1-2)

SEQ ID NO: 8380 - DNA, 201 bp, Homo sapiens; identical to SEQ ID NO: 8315

SEQ ID NO: 8381 - DNA, 201 bp, Homo sapiens; identical to SEQ ID NO: 8316

SEQ ID NO: 8382 - DNA, 201 bp, Homo sapiens; identical to SEQ ID NO: 8317

SEQ ID NO: 8383 - DNA, 201 bp, Homo sapiens; identical to SEQ ID NO: 8318

SEQ ID NO: 8384 - DNA, 201 bp, Homo sapiens; identical to SEQ ID NO: 8319

SEQ ID NO: 8385 - DNA, 201 bp, Homo sapiens; identical to SEQ ID NO: 8320

SEQ ID NO: 8386 - DNA, 201 bp, Homo sapiens; identical to SEQ ID NO: 8337
  misc_feature (1)...(201): n = A,T,C or G, or insertion/deletion polymorphism (see Tables 1-2)

SEQ ID NO: 8387 - DNA, 201 bp, Homo sapiens; identical to SEQ ID NO: 8338
  misc_feature (1)...(201): n = A,T,C or G, or insertion/deletion polymorphism (see Tables 1-2)

SEQ ID NO: 8388 - DNA, 201 bp, Homo sapiens; identical to SEQ ID NO: 8321
  misc_feature (1)...(201): n = A,T,C or G, or insertion/deletion polymorphism (see Tables 1-2)

SEQ ID NO: 8389 - DNA, 201 bp, Homo sapiens; identical to SEQ ID NO: 8322
  misc_feature (1)...(201): n = A,T,C or G, or insertion/deletion polymorphism (see Tables 1-2)

SEQ ID NO: 8390 - DNA, 201 bp, Homo sapiens; identical to SEQ ID NO: 8323

SEQ ID NO: 8391 - DNA, 201 bp, Homo sapiens; identical to SEQ ID NO: 8339

SEQ ID NO: 8392 - DNA, 201 bp, Homo sapiens; identical to SEQ ID NO: 8324

SEQ ID NO: 8393 - DNA, 201 bp, Homo sapiens; identical to SEQ ID NO: 8325

SEQ ID NO: 8394 - DNA, 201 bp, Homo sapiens; identical to SEQ ID NO: 8326

SEQ ID NO: 8395 - DNA, 201 bp, Homo sapiens; identical to SEQ ID NO: 8340
  misc_feature (1)...(201): n = A,T,C or G, or insertion/deletion polymorphism (see Tables 1-2)

SEQ ID NO: 8396 - DNA, 201 bp, Homo sapiens; identical to SEQ ID NO: 8365

SEQ ID NO: 8397 - DNA, 201 bp, Homo sapiens; identical to SEQ ID NO: 8328

SEQ ID NO: 8398 - DNA, 201 bp, Homo sapiens; identical to SEQ ID NO: 8329

SEQ ID NO: 8399 - DNA, 201 bp, Homo sapiens; identical to SEQ ID NO: 8342

SEQ ID NO: 8400 - DNA, 201 bp, Homo sapiens; identical to SEQ ID NO: 8341

SEQ ID NO: 8401 - DNA, 201 bp, Homo sapiens; identical to SEQ ID NO: 8343

SEQ ID NO: 8402 - DNA, 201 bp, Homo sapiens; identical to SEQ ID NO: 8330

SEQ ID NO: 8403 - DNA, 201 bp, Homo sapiens; identical to SEQ ID NO: 8331

SEQ ID NO: 8404 - DNA, 201 bp, Homo sapiens; identical to SEQ ID NO: 8344
  misc_feature (1)...(201): n = A,T,C or G, or insertion/deletion polymorphism (see Tables 1-2)

SEQ ID NO: 8405 - DNA, 201 bp, Homo sapiens; identical to SEQ ID NO: 8345
  misc_feature (1)...(201): n = A,T,C or G, or insertion/deletion polymorphism (see Tables 1-2)

SEQ ID NO: 8406 - DNA, 201 bp, Homo sapiens; identical to SEQ ID NO: 8332
  misc_feature (1)...(201): n = A,T,C or G, or insertion/deletion polymorphism (see Tables 1-2)

SEQ ID NO: 8407 - DNA, 201 bp, Homo sapiens; identical to SEQ ID NO: 8346

SEQ ID NO: 8408 - DNA, 201 bp, Homo sapiens; identical to SEQ ID NO: 8377

SEQ ID NO: 8409 - DNA, 201 bp, Homo sapiens; identical to SEQ ID NO: 8335

SEQ ID NO: 8410 - DNA, 201 bp, Homo sapiens; identical to SEQ ID NO: 8348
  misc_feature (1)...(201): n = A,T,C or G, or insertion/deletion polymorphism (see Tables 1-2)

SEQ ID NO: 8411 - DNA, 201 bp, Homo sapiens; identical to SEQ ID NO: 8315

SEQ ID NO: 8412 - DNA, 201 bp, Homo sapiens; identical to SEQ ID NO: 8316

SEQ ID NO: 8413 - DNA, 201 bp, Homo sapiens; identical to SEQ ID NO: 8317

SEQ ID NO: 8414 - DNA, 201 bp, Homo sapiens; identical to SEQ ID NO: 8318

SEQ ID NO: 8415 - DNA, 201 bp, Homo sapiens; identical to SEQ ID NO: 8319

SEQ ID NO: 8416 - DNA, 201 bp, Homo sapiens; identical to SEQ ID NO: 8320

SEQ ID NO: 8417 - DNA, 201 bp, Homo sapiens; identical to SEQ ID NO: 8337
  misc_feature (1)...(201): n = A,T,C or G, or insertion/deletion polymorphism (see Tables 1-2)

SEQ ID NO: 8418 - DNA, 201 bp, Homo sapiens; identical to SEQ ID NO: 8338
  misc_feature (1)...(201): n = A,T,C or G, or insertion/deletion polymorphism (see Tables 1-2)

SEQ ID NO: 8419 - DNA, 201 bp, Homo sapiens; identical to SEQ ID NO: 8321
  misc_feature (1)...(201): n = A,T,C or G, or insertion/deletion polymorphism (see Tables 1-2)

SEQ ID NO: 8420 - DNA, 201 bp, Homo sapiens; identical to SEQ ID NO: 8322
  misc_feature (1)...(201): n = A,T,C or G, or insertion/deletion polymorphism (see Tables 1-2)

SEQ ID NO: 8421 - DNA, 201 bp, Homo sapiens; identical to SEQ ID NO: 8323

SEQ ID NO: 8422 - DNA, 201 bp, Homo sapiens; identical to SEQ ID NO: 8339

SEQ ID NO: 8423 - DNA, 201 bp, Homo sapiens; identical to SEQ ID NO: 8324

SEQ ID NO: 8424 - DNA, 201 bp, Homo sapiens; identical to SEQ ID NO: 8362

SEQ ID NO: 8425 - DNA, 201 bp, Homo sapiens; identical to SEQ ID NO: 8326

SEQ ID NO: 8426 - DNA, 201 bp, Homo sapiens; identical to SEQ ID NO: 8340
  misc_feature (1)...(201): n = A,T,C or G, or insertion/deletion polymorphism (see Tables 1-2)

SEQ ID NO: 8427 - DNA, 201 bp, Homo sapiens; identical to SEQ ID NO: 8365

SEQ ID NO: 8428 - DNA, 201 bp, Homo sapiens; identical to SEQ ID NO: 8328

SEQ ID NO: 8429 - DNA, 201 bp, Homo sapiens; identical to SEQ ID NO: 8329

SEQ ID NO: 8430 - DNA, 201 bp, Homo sapiens; identical to SEQ ID NO: 8342

SEQ ID NO: 8431 - DNA, 201 bp, Homo sapiens; identical to SEQ ID NO: 8341

SEQ ID NO: 8432 - DNA, 201 bp, Homo sapiens; identical to SEQ ID NO: 8343

SEQ ID NO: 8433 - DNA, 201 bp, Homo sapiens; identical to SEQ ID NO: 8330

SEQ ID NO: 8434 - DNA, 201 bp, Homo sapiens; identical to SEQ ID NO: 8331

SEQ ID NO: 8435 - DNA, 201 bp, Homo sapiens; identical to SEQ ID NO: 8344
  misc_feature (1)...(201): n = A,T,C or G, or insertion/deletion polymorphism (see Tables 1-2)

SEQ ID NO: 8436 - DNA, 201 bp, Homo sapiens; identical to SEQ ID NO: 8345
  misc_feature (1)...(201): n = A,T,C or G, or insertion/deletion polymorphism (see Tables 1-2)

SEQ ID NO: 8437 - DNA, 201 bp, Homo sapiens; identical to SEQ ID NO: 8332
  misc_feature (1)...(201): n = A,T,C or G, or insertion/deletion polymorphism (see Tables 1-2)

SEQ ID NO: 8438 - DNA, 201 bp, Homo sapiens; identical to SEQ ID NO: 8346

SEQ ID NO: 8439 - DNA, 201 bp, Homo sapiens; identical to SEQ ID NO: 8377

SEQ ID NO: 8440 - DNA, 201 bp, Homo sapiens; identical to SEQ ID NO: 8321
  misc_feature (1)...(201): n = A,T,C or G, or insertion/deletion polymorphism (see Tables 1-2)

SEQ ID NO: 8441 - DNA, 201 bp, Homo sapiens; identical to SEQ ID NO: 8323

SEQ ID NO: 8442 - DNA, 201 bp, Homo sapiens; identical to SEQ ID NO: 8335

SEQ ID NO: 8443 - DNA, 201 bp, Homo sapiens; identical to SEQ ID NO: 8322
  misc_feature (1)...(201): n = A,T,C or G, or insertion/deletion polymorphism (see Tables 1-2)

SEQ ID NO: 8444 - DNA, 201 bp, Homo sapiens; identical to SEQ ID NO: 8340
  misc_feature (1)...(201): n = A,T,C or G, or insertion/deletion polymorphism (see Tables 1-2)

SEQ ID NO: 8445 - DNA, 201 bp, Homo sapiens; identical to SEQ ID NO: 8326

SEQ ID NO: 8446 - DNA, 201 bp, Homo sapiens; identical to SEQ ID NO: 8362

SEQ ID NO: 8447 - DNA, 201 bp, Homo sapiens; identical to SEQ ID NO: 8329

SEQ ID NO: 8448 - DNA, 201 bp, Homo sapiens; identical to SEQ ID NO: 8315

SEQ ID NO: 8449 - DNA, 201 bp, Homo sapiens; identical to SEQ ID NO: 8343

SEQ ID NO: 8450 - DNA, 201 bp, Homo sapiens; identical to SEQ ID NO: 8317

SEQ ID NO: 8451 - DNA, 201 bp, Homo sapiens; identical to SEQ ID NO: 8331

SEQ ID NO: 8452 - DNA, 201 bp, Homo sapiens; identical to SEQ ID NO: 8344
  misc_feature (1)...(201): n = A,T,C or G, or insertion/deletion polymorphism (see Tables 1-2)

SEQ ID NO: 8453 - DNA, 201 bp, Homo sapiens; identical to SEQ ID NO: 8345
  misc_feature (1)...(201): n = A,T,C or G, or insertion/deletion polymorphism (see Tables 1-2)

SEQ ID NO: 8454 - DNA, 201 bp, Homo sapiens; identical to SEQ ID NO: 8320

SEQ ID NO: 8455 - DNA, 201 bp, Homo sapiens; identical to SEQ ID NO: 8335

SEQ ID NO: 8456 - DNA, 201 bp, Homo sapiens; identical to SEQ ID NO: 8336
  misc_feature (1)...(201): n = A,T,C or G, or insertion/deletion polymorphism (see Tables 1-2)

SEQ ID NO: 8457 - DNA, 201 bp, Homo sapiens; identical to SEQ ID NO: 8315

SEQ ID NO: 8458 - DNA, 201 bp, Homo sapiens; identical to SEQ ID NO: 8316

SEQ ID NO: 8459 - DNA, 201 bp, Homo sapiens; identical to SEQ ID NO: 8317

SEQ ID NO: 8460 - DNA, 201 bp, Homo sapiens; identical to SEQ ID NO: 8318

SEQ ID NO: 8461 - DNA, 201 bp, Homo sapiens; identical to SEQ ID NO: 8319

SEQ ID NO: 8462 - DNA, 201 bp, Homo sapiens; identical to SEQ ID NO: 8320

SEQ ID NO: 8463 - DNA, 201 bp, Homo sapiens; identical to SEQ ID NO: 8337
  misc_feature (1)...(201): n = A,T,C or G, or insertion/deletion polymorphism (see Tables 1-2)

SEQ ID NO: 8464 - DNA, 201 bp, Homo sapiens; identical to SEQ ID NO: 8338
  misc_feature (1)...(201): n = A,T,C or G, or insertion/deletion polymorphism (see Tables 1-2)

SEQ ID NO: 8465 - DNA, 201 bp, Homo sapiens; identical to SEQ ID NO: 8321
  misc_feature (1)...(201): n = A,T,C or G, or insertion/deletion polymorphism (see Tables 1-2)

SEQ ID NO: 8466 - DNA, 201 bp, Homo sapiens; identical to SEQ ID NO: 8322
  misc_feature (1)...(201): n = A,T,C or G, or insertion/deletion polymorphism (see Tables 1-2)

SEQ ID NO: 8467 - DNA, 201 bp, Homo sapiens; identical to SEQ ID NO: 8323

SEQ ID NO: 8468 - DNA, 201 bp, Homo sapiens; identical to SEQ ID NO: 8339

SEQ ID NO: 8469 - DNA, 201 bp, Homo sapiens; identical to SEQ ID NO: 8324

SEQ ID NO: 8470 - DNA, 201 bp, Homo sapiens; identical to SEQ ID NO: 8362

SEQ ID NO: 8471 - DNA, 201 bp, Homo sapiens; identical to SEQ ID NO: 8326

SEQ ID NO: 8472 - DNA, 201 bp, Homo sapiens; identical to SEQ ID NO: 8340
  misc_feature (1)...(201): n = A,T,C or G, or insertion/deletion polymorphism (see Tables 1-2)

SEQ ID NO: 8473 - DNA, 201 bp, Homo sapiens; identical to SEQ ID NO: 8327

SEQ ID NO: 8474 - DNA, 201 bp, Homo sapiens; identical to SEQ ID NO: 8328

SEQ ID NO: 8475 - DNA, 201 bp, Homo sapiens; identical to SEQ ID NO: 8329

SEQ ID NO: 8476 - DNA, 201 bp, Homo sapiens; identical to SEQ ID NO: 8342

SEQ ID NO: 8477 - DNA, 201 bp, Homo sapiens; identical to SEQ ID NO: 8341

SEQ ID NO: 8478 - DNA, 201 bp, Homo sapiens; identical to SEQ ID NO: 8343

SEQ ID NO: 8479 - DNA, 201 bp, Homo sapiens; identical to SEQ ID NO: 8330

SEQ ID NO: 8480 - DNA, 201 bp, Homo sapiens; identical to SEQ ID NO: 8331

SEQ ID NO: 8481 - DNA, 201 bp, Homo sapiens; identical to SEQ ID NO: 8344
  misc_feature (1)...(201): n = A,T,C or G, or insertion/deletion polymorphism (see Tables 1-2)

SEQ ID NO: 8482 - DNA, 201 bp, Homo sapiens; identical to SEQ ID NO: 8345
  misc_feature (1)...(201): n = A,T,C or G, or insertion/deletion polymorphism (see Tables 1-2)

SEQ ID NO: 8483 - DNA, 201 bp, Homo sapiens; identical to SEQ ID NO: 8332
  misc_feature (1)...(201): n = A,T,C or G, or insertion/deletion polymorphism (see Tables 1-2)

SEQ ID NO: 8484 - DNA, 201 bp, Homo sapiens; identical to SEQ ID NO: 8346

SEQ ID NO: 8485 - DNA, 201 bp, Homo sapiens; identical to SEQ ID NO: 8377

SEQ ID NO: 8486 - DNA, 201 bp, Homo sapiens
atgcaagaattttggtgcagaaaatccagatccttttgtcccagtgctgagcactgctgtgaaactgattgctccagagagaaaggaggagaagaatgtcytgggaagcgcgctgctgtgcatagcagaggtgacctccaccctggaggcgctggccatcccccagcttcccagcctgatgccatcgttgctgacaacaat

SEQ ID NO: 8487 - DNA, 201 bp, Homo sapiens
  misc_feature (1)...(201): n = A,T,C or G, or insertion/deletion polymorphism (see Tables 1-2)
tagttacccgtttcctaaaactggttccagaccttttggccattgtgcagcgtaagaaaaaggaaggggaagaagaacaagcaatcaacagacagacagcnttgtataccttaaagcttttatgcaagaattttggtgcagaaaatccagatccttttgtcccagtgctgagcactgctgtgaaactgattgctccagaga

SEQ ID NO: 8488 - DNA, 201 bp, Homo sapiens; identical to SEQ ID NO: 8329

SEQ ID NO: 8489 - DNA, 201 bp, Homo sapiens
  misc_feature (1)...(201): n = A,T,C or G, or insertion/deletion polymorphism (see Tables 1-2)
gaagaacaagcaatcaacagacagacagcgttgtataccttaaagcttttatgcaagaattttggtgcagaaaatccagatccttttgtcccagtgctgancactgctgtgaaactgattgctccagagagaaaggaggagaagaatgtcttgggaagcgcgctgctgtgcatagcagaggtgacctccaccctggaggcg

SEQ ID NO: 8490 - DNA, 201 bp, Homo sapiens
taagaaaaaggaaggggaagaagaacaagcaatcaacagacagacagcgttgtataccttaaagcttttatgcaagaattttggtgcagaaaatccagatscttttgtcccagtgctgagcactgctgtgaaactgattgctccagagagaaaggaggagaagaatgtcttgggaagcgcgctgctgtgcatagcagaggt

SEQ ID NO: 8491 - DNA, 201 bp, Homo sapiens
  misc_feature (1)...(201): n = A,T,C or G, or insertion/deletion polymorphism (see Tables 1-2)
cacctgataccatgcatcgcacagttttcagtggccatggcggatgactctctttggaaaccactgaactaccagattctgctaaagacgagagactcctngcctaaggttcgatttgctgctttgattactgtgttagcactggctgaaaaactaaaggagaattatattgtcttgctaccagaatccattcctttctta

SEQ ID NO: 8492 - DNA, 201 bp, Homo sapiens; identical to SEQ ID NO: 8324

SEQ ID NO: 8493 - DNA, 201 bp, Homo sapiens; identical to SEQ ID NO: 8328

SEQ ID NO: 8494 - DNA, 201 bp, Homo sapiens
  misc_feature (1)...(201): n = A,T,C or G, or insertion/deletion polymorphism (see Tables 1-2)
tcttccaatgattttctgaaaaaggtagttgagagtggtggtcctgagattttaaaaggccttgaagagaggttgctggagaccgttctcggctatatcantgcagttgcacagtccatggaaaggaacgcagacaaactcaccgtgaagttctggcgcgcgctccttagtaaagcttacgacctgttagataaggtcaat

SEQ ID NO: 8495 - DNA, 201 bp, Homo sapiens
cccatccttgttcaacttgttgatacactgggtgcagagaaattcctctggattctcctcatcttgctttttgaacagtatgtcacaaaaacagtgctggyggctgcctatggcgaaaaggatgctattttagaagcagacactgaattttggttttcagtctgttgtgagtttagtgtccagcatcagatacaaagcttg

SEQ ID NO: 8496 - DNA, 198 bp, Homo sapiens
cactcatatttcatatttttatttttgggtgttgggtgccatgttacttttggtgccttaatacacctacttggattacttacaaatgttttatcacttcmttacaaaatccccacctggcttgtgctgccacataagcctctcctgcctatcgtatagagctgcagaaagagtaaatgatacacggtatttttatac

SEQ ID NO: 8497 - DNA, 201 bp, Homo sapiens
  misc_feature (1)...(201): n = A,T,C or G, or insertion/deletion polymorphism (see Tables 1-2)
tgatgcctctggtggatcagctggtaaacaggcttgggggagaagagaaattccaggaacgggtgacaaagcacctgataccatgcatcgcacagttttcngtggccatggcggatgactctctttggaaaccactgaactaccagattctgctaaagacgagagactcctcgcctaaggttcgatttgctgctttgatta

SEQ ID NO: 8498 - DNA, 201 bp, Homo sapiens
gaccctgaaaagtgctgcttgctgttgcagtttattttgaactgtttatacaaaatcttcctttttgatacccagcattttataagtaaagagagagcagragccttgatgatgcctctggtggatcagctggtaaacaggcttgggggagaagagaaattccaggaacgggtgacaaagcacctgataccatgcatcgca

SEQ ID NO: 8499 - DNA, 201 bp, Homo sapiens; identical to SEQ ID NO: 8345
  misc_feature (1)...(201): n = A,T,C or G, or insertion/deletion polymorphism (see Tables 1-2)

SEQ ID NO: 8500 - DNA, 201 bp, Homo sapiens
acatgggtccgtttatgagcatcttgcaagagcatattggggcgatgaagaaggaagagctcacctcccatcagtctcagctaaccgcctttttcctggargccctggacttccgagcccagcactctgagaacgatctggaggaagttggaaaaacggaaaattgtatcattgactgtctagtagccatggttgtcaaac

SEQ ID NO: 8501 - DNA, 201 bp, Homo sapiens
gtcctgttgcccgccatcaaaaaaacttacaagcagattgagaagaactggaagaatcacatgggtccgtttatgagcatcttgcaagagcatattggggygatgaagaaggaagagctcacctcccatcagtctcagctaaccgcctttttcctggaggccctggacttccgagcccagcactctgagaacgatctggag

SEQ ID NO: 8502 - DNA, 201 bp, Homo sapiens; identical to SEQ ID NO: 8342

SEQ ID NO: 8503 - DNA, 201 bp, Homo sapiens
gaacatgtccggtctaagaccaaggttcctgtgcaggaccaggttcttttgctgggctccaagatcttaaagccacggagaagcctctcatcttatggcaytgacaaagagaagaccatccaccttaccctgaaagtggtgaagcccagtgatgaggagctgcccttgtttcttgtggagtcaggtgatgaggcaaagagg

SEQ ID NO: 8504 - DNA, 201 bp, Homo sapiens
cctgagacccagattgtgacttgcaatggaaagagactggaagatgggaagatgatggcagattacggcatcagaaagggcaacttactcttcctggcatsttattgtattggagggtgaccaccctgggcatggggtgttggcaggggtcaaaaagcttatttcttttaatctcttactcaacgaacacatcttctgatg

SEQ ID NO: 8505 - DNA, 201 bp, Homo sapiens
acccagattgtgacttgcaatggaaagagactggaagatgggaagatgatggcagattacggcatcagaaagggcaacttactcttcctggcatcttattktattggagggtgaccaccctgggcatggggtgttggcaggggtcaaaaagcttatttcttttaatctcttactcaacgaacacatcttctgatgatttcc

SEQ ID NO: 8506 - DNA, 201 bp, Homo sapiens
tatggcattgacaaagagaagaccatccaccttaccctgaaagtggtgaagcccagtgatgaggagctgcccttgtttcttgtggagtcaggtgatgaggsaaagaggcacctcctccaggtgcgaaggtccagctcagtggcacaagtgaaagcaatgatcgagactaagacgggtataatccctgagacccagattgtg

SEQ ID NO: 8507 - DNA, 201 bp, Homo sapiens
aagagactggaagatgggaagatgatggcagattacggcatcagaaagggcaacttactcttcctggcatcttattgtattggagggtgaccaccctgggsatggggtgttggcaggggtcaaaaagcttatttcttttaatctcttactcaacgaacacatcttctgatgatttcccaaaattaatgagaatgagatgag

SEQ ID NO: 8508 - DNA, 201 bp, Homo sapiens
aagcctctcatcttatggcattgacaaagagaagaccatccaccttaccctgaaagtggtgaagcccagtgatgaggagctgcccttgtttcttgtggagycaggtgatgaggcaaagaggcacctcctccaggtgcgaaggtccagctcagtggcacaagtgaaagcaatgatcgagactaagacgggtataatccctga

SEQ ID NO: 8509 - DNA, 201 bp, Homo sapiens
tcaaagaacatgtccggtctaagaccaaggttcctgtgcaggaccaggttcttttgctgggctccaagatcttaaagccacggagaagcctctcatcttayggcattgacaaagagaagaccatccaccttaccctgaaagtggtgaagcccagtgatgaggagctgcccttgtttcttgtggagtcaggtgatgaggcaa

SEQ ID NO: 8510 - DNA, 201 bp, Homo sapiens
gatttaatgacctttgatgccaacccatatgacagcgtgaaaaaaatcaaagaacatgtccggtctaagaccaaggttcctgtgcaggaccaggttctttygctgggctccaagatcttaaagccacggagaagcctctcatcttatggcattgacaaagagaagaccatccaccttaccctgaaagtggtgaagcccagt

SEQ ID NO: 8511 - DNA, 201 bp, Homo sapiens
accaggttcttttgctgggctccaagatcttaaagccacggagaagcctctcatcttatggcattgacaaagagaagaccatccaccttaccctgaaagtrgtgaagcccagtgatgaggagctgcccttgtttcttgtggagtcaggtgatgaggcaaagaggcacctcctccaggtgcgaaggtccagctcagtggcac

SEQ ID NO: 8512 - DNA, 201 bp, Homo sapiens
agaactgagggtcctatggcccagaaccaggcatctgtacttaagaaccaagcacctgtgaccaggacccaggcacccatcactggaaccctctgtcaggwtgccagatccaactctcatccagtgaagccctcaagactcaatgtcttctgttgcccccattgttctttgacttttagcaagaaatcctatctctccaga

SEQ ID NO: 8513 - DNA, 201 bp, Homo sapiens
cccaggaacccatatttagaactgagggtcctatggcccagaaccaggcatctgtacttaagaaccaagcacctgtgaccaggacccaggcacccatcacyggaaccctctgtcaggatgccagatccaactctcatccagtgaagccctcaagactcaatgtcttctgttgcccccattgttctttgacttttagcaaga

SEQ ID NO: 8514 - DNA, 201 bp, Homo sapiens
gatacaccaaaaccaggagccagtggatggaaaccaggagtgtactttgaggattccaggcacccaggctgaattccagacacccatcgccagaagccagrggtccatccaggggcttttggatgtgaaccatgcaccagtggccaggtcccaggaacccatatttagaactgagggtcctatggcccagaaccaggcatc

SEQ ID NO: 8515 - DNA, 201 bp, Homo sapiens
agaggcccttctgttgcacgctctgtgacaagacctactgtgatgcttctggactaagtcgtcaccgccgcgtccatctgggttaccggccccattcatgytctgtgtgtgggaagagcttccgggaccagtctgagctcaaacgccaccagaagatacaccaaaaccaggagccagtggatggaaaccaggagtgtactt

SEQ ID NO: 8516 - DNA, 201 bp, Homo sapiens
gtgcttcaagcatcccaggctgggccaccctttttttgctacacctgtggcaaatgtttcagcaggcgctcctacctctatagccaccagtttgttcacartcccaagctgactaacagctgcagtcagtgtgggaagttgtttcggagccccaagtccctcagctatcacagacgcatgcatcttggggagaggcccttc

SEQ ID NO: 8517 - DNA, 201 bp, Homo sapiens
aaaaccaggagccagtggatggaaaccaggagtgtactttgaggattccaggcacccaggctgaattccagacacccatcgccagaagccagaggtccatmcaggggcttttggatgtgaaccatgcaccagtggccaggtcccaggaacccatatttagaactgagggtcctatggcccagaaccaggcatctgtactta

SEQ ID NO: 8518 - DNA, 201 bp, Homo sapiens
atctgccccagctgggactatggacaggacccgggtgcttcaagcatcccaggctgggccaccctttttttgctacacctgtggcaaatgtttcagcaggygctcctacctctatagccaccagtttgttcacaatcccaagctgactaacagctgcagtcagtgtgggaagttgtttcggagccccaagtccctcagcta

SEQ ID NO: 8519 - DNA, 201 bp, Homo sapiens; identical to SEQ ID NO: 8512

SEQ ID NO: 8520 - DNA, 201 bp, Homo sapiens; identical to SEQ ID NO: 8513

SEQ ID NO: 8521 - DNA, 201 bp, Homo sapiens; identical to SEQ ID NO: 8514

SEQ ID NO: 8522 - DNA, 201 bp, Homo sapiens; identical to SEQ ID NO: 8515

SEQ ID NO: 8523 - DNA, 201 bp, Homo sapiens; identical to SEQ ID NO: 8516

SEQ ID NO: 8524 - DNA, 201 bp, Homo sapiens; identical to SEQ ID NO: 8517

SEQ ID NO: 8525 - DNA, 201 bp, Homo sapiens
tgagcaagaagaggaacagtggagagagacccgggtgcttcaagcatcccaggctgggccaccctttttttgctacacctgtggcaaatgtttcagcaggygctcctacctctatagccaccagtttgttcacaatcccaagctgactaacagctgcagtcagtgtgggaagttgtttcggagccccaagtccctcagcta

SEQ ID NO: 8526 - DNA, 201 bp, Homo sapiens
gcagcgggatggggaggaacagacccaggacacagagcttgtggagaccaggcctgcaggggatggaaccttccagaagtgggccgctgtggtggtgcctyctggagaggaacagagatacacatgccatgtgcagcacgaggggctgccccagcccctcatcctgagatgggagcagtctccccagcccaccatccccat

SEQ ID NO: 8527 - DNA, 201 bp, Homo sapiens
aggttctaaagtcccacgcaccccgcgggactcatatttttcccagacgcggaggttggggtcatggcgccccgaagcctcctcctgctgctctcaggggycctggccctgaccgatacttgggcgggctcccactccttgaggtatttcagcaccgctgtgtcgcggcccggccgcggggagccccgctacatcgccgtg

SEQ ID NO: 8528 - DNA, 190 bp, Homo sapiens
cagtgtcttgggccgccggaaggtgggtgacatgtggatcttgttttttttgtggctgtggacatctttcaacactgccttcttggccttgcaaagccttygctttggcttcggctttaggaggggcaggagcttccttcttcgttcttggcaccatcttatgaaaagggtccagattaagatttttgac

SEQ ID NO: 8529 - DNA, 201 bp, Homo sapiens
ttttcccagacgcggaggttggggtcatggcgccccgaagcctcctcctgctgctctcaggggccctggccctgaccgatacttgggcgggctcccactcmttgaggtatttcagcaccgctgtgtcgcggcccggccgcggggagccccgctacatcgccgtggagtacgtagacgacacgcaattcctgcggttcgaca

SEQ ID NO: 8530 - DNA, 201 bp, Homo sapiens
ggaaacttgatgataacatggtggtcaagcttatttctcctgggggtgctcttccaaggatatttgggctgcctccggagtcacagtgtcttgggccgccrgaaggtgggtgacatgtggatcttgttttttttgtggctgtggacatctttcaacactgccttcttggccttgcaaagccttcgctttggcttcggcttt

SEQ ID NO: 8531 - DNA, 201 bp, Homo sapiens
tccttggggtgaattttcttccaaaagagtccggggagtccaggtccttcttcctggatactcataacgcggccccatttctcactcccattgggcgtcgsgtttctagagaagccaatcagtgtcgccgcagttcccaggttctaaagtcccacgcaccccgcgggactcatatttttcccagacgcggaggttggggtc

SEQ ID NO: 8532 - DNA, 201 bp, Homo sapiens
cgggactcatatttttcccagacgcggaggttggggtcatggcgccccgaagcctcctcctgctgctctcaggggccctggccctgaccgatacttgggcrggctcccactccttgaggtatttcagcaccgctgtgtcgcggcccggccgcggggagccccgctacatcgccgtggagtacgtagacgacacgcaattcc

SEQ ID NO: 8533 - DNA, 201 bp, Homo sapiens
tacaccttcattctcaggacaagttcattgtctggcaccaagctccttggggtgaattttcttccaaaagagtccggggagtccaggtccttcttcctggwtactcataacgcggccccatttctcactcccattgggcgtcgcgtttctagagaagccaatcagtgtcgccgcagttcccaggttctaaagtcccacgca

SEQ ID NO: 8534 - DNA, 201 bp, Homo sapiens
ctgtctctacaccttcattctcaggacaagttcattgtctggcaccaagctccttggggtgaattttcttccaaaagagtccggggagtccaggtccttcwtcctggatactcataacgcggccccatttctcactcccattgggcgtcgcgtttctagagaagccaatcagtgtcgccgcagttcccaggttctaaagtc

SEQ ID NO: 8535 - DNA, 201 bp, Homo sapiens
actggagctgtggtcgctgctgtgatgtggaggaagaagagctcagatagaaacagagggagctactctcaggctgcagcctactcagtggtcagcggaawcttgatgataacatggtggtcaagcttatttctcctgggggtgctcttccaaggatatttgggctgcctccggagtcacagtgtcttgggccgccggaag

SEQ ID NO: 8536 - DNA, 201 bp, Homo sapiens; identical to SEQ ID NO: 8526

SEQ ID NO: 8537 - DNA, 201 bp, Homo sapiens
acaaccagagcgaggctgggtctcacaccctccagggaatgaatggctgcgacatggggcccgacggacgcctcctccgcgggtatcaccagcacgcgtamgacggcaaggattacatctccctgaacgaggacctgcgctcctggaccgcggcggacaccgtggctcagatcacccagcgcttctatgaggcagaggaat

SEQ ID NO: 8538 - DNA, 127 bp, Homo sapiens
cataaattttaaaaataaagaataaamttgaggtatttcagcaccgctgtgtcgcggcccggccgcggggagccccgctacatcgccgtggagtacgtagacgacacgcaattcctgcggttcgaca

SEQ ID NO: 8539 - DNA, 201 bp, Homo sapiens
ctgtggtcactggagctgtggtcgctgctgtgatgtggaggaagaagagctcagatagaaacagagggagctactctcaggctgcagtcactgacagtgcycagggctctggggtgtctctcacagctaataaagtgtgagacagcttccttgtgtgggactgagaagcaagatatcaatgtagcagaattgcacttgtgc

SEQ ID NO: 8540 - DNA, 139 bp, Homo sapiens
ctcacgaacatacataaattttaaaaataaagaataaarggctcccactccttgaggtatttcagcaccgctgtgtcgcggcccggccgcggggagccccgctacatcgccgtggagtacgtagacgacacgcaattcc

SEQ ID NO: 8541 - DNA, 201 bp, Homo sapiens
ggaattgaaagtagaagatcctttctactgggtgagccctggagtgctggttctcctcgcggtgctgcctgtgctcctcctgcagatcactgttggcctcrtcttcctctgcctgcagtacagactgagaggaaaacttcgagcagagatagagaatctccaccggacttttgagtcctttggtgttctaggaccccaggt

SEQ ID NO: 8542 - DNA, 201 bp, Homo sapiens
accgcccccccttctctagggtggttcatctctacagaaatggcaaggaccaagatggagaccaggcacctgaatatcggggccggacagagctgctgaargatgctattggtgagggaaaggtgactctcaggatccggaatgtaaggttctcagatgaaggaggtttcacctgcttcttccgagatcattcttaccaag

SEQ ID NO: 8543 - DNA, 201 bp, Homo sapiens
ttcagcagtaaggggacatgcaccccaagggcctccacttggcctgaccttgctgcgggggctctctgtccccaggaacagtagagatggcaagcttatcragaccctctctgcccagctgcctctgctccttcctcctcctcctcctcctccaagtgtcttccagctatgcagggcagttcagagtgataggaccaagac

SEQ ID NO: 8544 - DNA, 201 bp, Homo sapiens
ggcagcaatggaattgaaagtagaagatcctttctactgggtgagccctggagtgctggttctcctcgcggtgctgcctgtgctcctcctgcagatcactsttggcctcgtcttcctctgcctgcagtacagactgagaggaaaacttcgagcagagatagagaatctccaccggacttttgagtcctttggtgttctagg

SEQ ID NO: 8545 - DNA, 201 bp, Homo sapiens
cctggcaagggtgacgtggggctgtttctgcgggcacagctgcagcaattaccggagtggaggcagggcccaggcagcactgccctccaagatcttccctygggcttttcagcagtaaggggacatgcaccccaagggcctccacttggcctgaccttgctgcgggggctctctgtccccaggaacagtagagatggcaag

SEQ ID NO: 8546 - DNA, 201 bp, Homo sapiens; identical to SEQ ID NO: 8541

SEQ ID NO: 8547 - DNA, 201 bp, Homo sapiens; identical to SEQ ID NO: 8542

SEQ ID NO: 8548 - DNA, 201 bp, Homo sapiens; identical to SEQ ID NO: 8543

SEQ ID NO: 8549 - DNA, 201 bp, Homo sapiens; identical to SEQ ID NO: 8544

SEQ ID NO: 8550 - DNA, 201 bp, Homo sapiens; identical to SEQ ID NO: 8545

SEQ ID NO: 8551 - DNA, 201 bp, Homo sapiens; identical to SEQ ID NO: 8542

SEQ ID NO: 8552 - DNA, 196 bp, Homo sapiens
ggaattgaaagtagaagatcctttctactgggtgagccctggagtgctggttctcctcgcggtgctgcctgtgctcctcctgcagatcactgttggcctcrtcttcctctgcctgcagtacagactgagaggaaaacttcgagcagagatagagaatctccaccggacttttgggcaattccttgaagagctacgt

SEQ ID NO: 8553 - DNA, 201 bp, Homo sapiens; identical to SEQ ID NO: 8542

SEQ ID NO: 8554 - DNA, 201 bp, Homo sapiens; identical to SEQ ID NO: 8543

SEQ ID NO: 8555 - DNA, 201 bp, Homo sapiens
ggcagcaatggaattgaaagtagaagatcctttctactgggtgagccctggagtgctggttctcctcgcggtgctgcctgtgctcctcctgcagatcactsttggcctcgtcttcctctgcctgcagtacagactgagaggaaaacttcgagcagagatagagaatctccaccggacttttgggcaattccttgaagagct

SEQ ID NO: 8556 - DNA, 201 bp, Homo sapiens; identical to SEQ ID NO: 8545

SEQ ID NO: 8557 - DNA, 201 bp, Homo sapiens
gtcttccagctatgcagatcctttctactgggtgagccctggagtgctggttctcctcgcggtgctgcctgtgctcctcctgcagatcactgttggcctcrtcttcctctgcctgcagtacagactgagaggaaaacttcgagcagagatagagaatctccaccggacttttgatccccactttctgagggtgccctgctg

SEQ ID NO: 8558 - DNA, 115 bp, Homo sapiens
atggcaagcttatcragaccctctctgcccagctgcctctgctccttcctcctcctcctcctcctccaagtgtcttccagctatgcagatcctttctactgggtgagccctggag

SEQ ID NO: 8559 - DNA, 201 bp, Homo sapiens
tttgtaattgtgccggttcttggacccttggttgccttgatcatctgctacaactggctacatcgaagactagcagggcaattccttgaagagctacgaamtcccttctgagtgatgtcacatcttggcaggggtggaggagagcctggttgcccagggatttgtccttggggacatctcatccatcaagttgcacactca

SEQ ID NO: 8560 - DNA, 201 bp, Homo sapiens
cctccaagtgtcttccagctatgcagatcctttctactgggtgagccctggagtgctggttctcctcgcggtgctgcctgtgctcctcctgcagatcactsttggcctcgtcttcctctgcctgcagtacagactgagaggaaaacttcgagcagagatagagaatctccaccggacttttgatccccactttctgagggt

SEQ ID NO: 8561 - DNA, 201 bp, Homo sapiens
tgagcatagtggtgggcacctataataccagctactccggaggctgaggcaggagaatcgcttgaacccaggaggcagaggttgcagtgagctgagatcgygccactgcactctagccggagtgacagagtaagactctgtctcaaaaataaataaataaataaataaataaataaataaataaataaataaaaaataata

SEQ ID NO: 8562 - DNA, 201 bp, Homo sapiens
cctataataccagctactccggaggctgaggcaggagaatcgcttgaacccaggaggcagaggttgcagtgagctgagatcgcgccactgcactctagccrgagtgacagagtaagactctgtctcaaaaataaataaataaataaataaataaataaataaataaataaataaaaaataataatacaagttttcataagc

SEQ ID NO: 8563 - DNA, 201 bp, Homo sapiens
ggaattgaaagtagaagatcctttctactgggtgagccctggagtgctggttctcctcgcggtgctgcctgtgctcctcctgcagatcactgttggcctcrtcttcctctgcctgcagtacagactgagaggaaaacttcgagcagagatagagaatctccaccggacttttgatccccactttctgagggtgccctgctg

SEQ ID NO: 8564 - DNA, 201 bp, Homo sapiens; identical to SEQ ID NO: 8542

SEQ ID NO: 8565 - DNA, 201 bp, Homo sapiens; identical to SEQ ID NO: 8543

SEQ ID NO: 8566 - DNA, 201 bp, Homo sapiens; identical to SEQ ID NO: 8559

SEQ ID NO: 8567 - DNA, 201 bp, Homo sapiens; identical to SEQ ID NO: 8561

SEQ ID NO: 8568 - DNA, 201 bp, Homo sapiens; identical to SEQ ID NO: 8545

SEQ ID NO: 8569 - DNA, 201 bp, Homo sapiens
ggcagcaatggaattgaaagtagaagatcctttctactgggtgagccctggagtgctggttctcctcgcggtgctgcctgtgctcctcctgcagatcactsttggcctcgtcttcctctgcctgcagtacagactgagaggaaaacttcgagcagagatagagaatctccaccggacttttgatccccactttctgagggt

SEQ ID NO: 8570 - DNA, 201 bp, Homo sapiens; identical to SEQ ID NO: 8562

SEQ ID NO: 8571 - DNA, 201 bp, Homo sapiens
actgatcctaaactccataggcagcctcagcaagctccggccccagcccctcaccttctcccctagttggggtggaccaaagagcctgcctgttcccgccrcacctggggaagtggggaccacgccttctgctccaccccaacgcaatcggaggaaatctgttcaccgagtgttggcggaactggatgatgagagtgagcc

SEQ ID NO: 8572 - DNA, 201 bp, Homo sapiens
ggagcagaccctggtggccaagacagaagagatggtttcctgccaaagatattgccacctccaggaaattgccagtgagctggaagttcccactattacargccataaggccatgttgccatggacaccagaatatctgtagtcagagcacctatcagttgcaaaagccatgcctgcaaccgatggaaaatgtaagaggga

SEQ ID NO: 8573 - DNA, 201 bp, Homo sapiens
tcagcaagctccggccccagcccctcaccttctcccctagttggggtggaccaaagagcctgcctgttcccgccccacctggggaagtggggaccacgccvtctgctccaccccaacgcaatcggaggaaatctgttcaccgagtgttggcggaactggatgatgagagtgagcctcctgagaacccgccaccggtcctta

SEQ ID NO: 8574 - DNA, 201 bp, Homo sapiens
gcattcagacctaaggtccaccgccaaggcaccatcggacacacctgcccatgagtagacacagcagcgagcaaataggtctgataaataccccccttccrttccctccccaagagggaatgactacagggaagaaggatggattgatgtggactcattcagggcctggagcagaccctggtggccaagacagaagagatg

SEQ ID NO: 8575 - DNA, 201 bp, Homo sapiens
ggctgtgacgtctggttccatgtggcctgtgttggctgcagcatccaggctgccagggaggccgacttccgatgcccagggtgccgggctggcattcagayctaaggtccaccgccaaggcaccatcggacacacctgcccatgagtagacacagcagcgagcaaataggtctgataaataccccccttcccttccctccc

SEQ ID NO: 8576 - DNA, 201 bp, Homo sapiens
gcccagggtgccgggctggcattcagacctaaggtccaccgccaaggcaccatcggacacacctgcccatgagtagacacagcagcgagcaaataggtctsataaataccccccttcccttccctccccaagagggaatgactacagggaagaaggatggattgatgtggactcattcagggcctggagcagaccctggtg

SEQ ID NO: 8577 - DNA, 201 bp, Homo sapiens
ctgaagtggaagaggtggtgcagagggggcaccgcccatgctgccctgcttccaactgctgcgcatagggggcggcaggggcggtgatctctacaccttcracccccccgccggggctggctgcacctatcgcttgggccacagggccgacctgtgtgatgtggccctgcggccccagcaggagcctggcctcatctctgg

SEQ ID NO: 8578 - DNA, 201 bp, Homo sapiens
cagcctggaagaccacagcagccaaggtactttggtcaataatgtccgactcccaagaggtcacaggctggaattgagtgatggagacctcctgacctttygccctgaagggcccccaggaaccagcccctcggagttctacttcatgttccaacaagtacgagtcaagcctcaggactttgctgccattaccatcccacg

SEQ ID NO: 8579 - DNA, 201 bp, Homo sapiens; identical to SEQ ID NO: 8571

SEQ ID NO: 8580 - DNA, 201 bp, Homo sapiens; identical to SEQ ID NO: 8572

SEQ ID NO: 8581 - DNA, 201 bp, Homo sapiens; identical to SEQ ID NO: 8573

SEQ ID NO: 8582 - DNA, 201 bp, Homo sapiens; identical to SEQ ID NO: 8574

SEQ ID NO: 8583 - DNA, 201 bp, Homo sapiens; identical to SEQ ID NO: 8575

SEQ ID NO: 8584 - DNA, 201 bp, Homo sapiens; identical to SEQ ID NO: 8576

SEQ ID NO: 8585 - DNA, 201 bp, Homo sapiens; identical to SEQ ID NO: 8577

SEQ ID NO: 8586 - DNA, 201 bp, Homo sapiens; identical to SEQ ID NO: 8578

SEQ ID NO: 8587 - DNA, 201 bp, Homo sapiens
agctccggccccagcccctcaccttctcccctagttggggtggaccaaagagcctgcctgttcccgccccacctggggaagtggggaccacgccttctgcrccaccccaacgcaatcggaggaaatctgttcaccgagtgttggcggaactggatgatgagagtgagcctcctgagaacccgccaccggtccttatggagc

SEQ ID NO: 8588 - DNA, 201 bp, Homo sapiens
tggtttcctgccaaagatattgccacctccaggaaattgccagtgagctggaagttcccactattacaagccataaggccatgttgccatggacaccagartatctgtagtcagagcacctatcagttgcaaaagccatgcctgcaaccgatggaaaatgtaagagggagttcttaaggttcttggtggcatcacccaagg

SEQ ID NO: 8589 - DNA, 201 bp, Homo sapiens
tcccctagttggggtggaccaaagagcctgcctgttcccgccccacctggggaagtggggaccacgccttctgctccaccccaacgcaatcggaggaaatvtgttcaccgagtgttggcggaactggatgatgagagtgagcctcctgagaacccgccaccggtccttatggagcccaggaagaaactccgtgtagacaaa

SEQ ID NO: 8590 - DNA, 201 bp, Homo sapiens
catcggacacacctgcccatgagtagacacagcagcgagcaaataggtctgataaataccccccttcccttccctccccaagagggaatgactacagggargaaggatggattgatgtggactcattcagggcctggagcagaccctggtggccaagacagaagagatggtttcctgccaaagatattgccacctccagga

SEQ ID NO: 8591 - DNA, 201 bp, Homo sapiens
tggctgcagcatccaggctgccagggaggccgacttccgatgcccagggtgccgggctggcattcagacctaaggtccaccgccaaggcaccatcggacayacctgcccatgagtagacacagcagcgagcaaataggtctgataaataccccccttcccttccctccccaagagggaatgactacagggaagaaggatgg

SEQ ID NO: 8592 - DNA, 201 bp, Homo sapiens
ggtccaccgccaaggcaccatcggacacacctgcccatgagtagacacagcagcgagcaaataggtctgataaataccccccttcccttccctccccaagsgggaatgactacagggaagaaggatggattgatgtggactcattcagggcctggagcagaccctggtggccaagacagaagagatggtttcctgccaaag

SEQ ID NO: 8593 - DNA, 201 bp, Homo sapiens
cgcccatgctgccctgcttccaactgctgcgcatagggggcggcaggggcggtgatctctacaccttccacccccccgccggggctggctgcacctatcgrttgggccacagggccgacctgtgtgatgtggccctgcggccccagcaggagcctggcctcatctctgggatccacgccgaactgcatgccgagccccggg

SEQ ID NO: 8594 - DNA, 201 bp, Homo sapiens
tggtcaataatgtccgactcccaagaggtcacaggctggaattgagtgatggagacctcctgacctttggccctgaagggcccccaggaaccagcccctcygagttctacttcatgttccaacaagtacgagtcaagcctcaggactttgctgccattaccatcccacggtctaggggagaagcccgggttggggctggtt

SEQ ID NO: 8595 - DNA, 201 bp, Homo sapiens
ctccataggcagcctcagcaagctccggccccagcccctcaccttctcccctagttggggtggaccaaagagcctgcctgttcccgccccacctggggaartggggaccacgccttctgctccaccccaacgcaatcggaggaaatctgttcaccgagtgttggcggaactggatgatgagagtgagcctcctgagaaccc

SEQ ID NO: 8596 - DNA, 201 bp, Homo sapiens; identical to SEQ ID NO: 8573

SEQ ID NO: 8597 - DNA, 122 bp, Homo sapiens
gacacacctgcccatgagtagytggctgcacctatcgcttgggccacagggccgacctgtgtgatgtggccctgcggccccagcaggagcctggcctcatctctgggatccacgccgaactg

SEQ ID NO: 8598 - DNA, 201 bp, Homo sapiens
cctggggaagtggggaccacgccttctgctccaccccaacgcaatcggaggaaatctgttcaccgagtgttggcggaactggatgatgagagtgagcctcytgagaacccgccaccggtccttatggagcccaggaagaaactccgtgtagacaaagccccactgactcccactggaaatgcacgtggccgtcctcggaag

SEQ ID NO: 8599 - DNA, 201 bp, Homo sapiens; identical to SEQ ID NO: 8571

SEQ ID NO: 8600 - DNA, 138 bp, Homo sapiens
cgccaaggcaccatcggacacacctgcccatgagtagracccccccgccggggttggctgcacctatcgcttgggccacagggccgacctgtgtgatgtggccctgcggccccagcaggagcctggcctcatctctgg

SEQ ID NO: 8601 - DNA, 201 bp, Homo sapiens; identical to SEQ ID NO: 8578

SEQ ID NO: 8602 - DNA, 201 bp, Homo sapiens
cagggccccattttggtaccccaggctatgggagccctcacttcactgcactgtactcctcggtccctttccctgagggggaagcctttccccctgtctcygtcaccactctgggctctcccatgcattcaaactgaggtgcctgcccttctaggaatgggggacagggggaggggaggagctagggaaagaaaacctgga

SEQ ID NO: 8603 - DNA, 201 bp, Homo sapiens
aagcagaaaccctcgtgcaggcccgaaagagaaagcgaaccagtatcgagaaccgagtgagaggcaacctggagaatttgttcctgcagtgcccgaaaccsacactgcagcagatcagccacatcgcccagcagcttgggctcgagaaggatgtggtccgagtgtggttctgtaaccggcgccagaagggcaagcgatcaa

SEQ ID NO: 8604 - DNA, 174 bp, Homo sapiens
aagccctcatttcaccaggcccccggcttggggcgccttccttccccatggcgggacacctggcttcagatttygccttctcgccccctccaggtggtggaggtgatgggccaggggggccggagccgggctgggttgatcctcggacctggctaagcttccaaggccctcctg

SEQ ID NO: 8605 - DNA, 201 bp, Homo sapiens
ccccgccgtatgagttctgtggggggatggcgtactgtgggccccaggttggagtggggctagtgccccaaggcggcttggagacctctcagcctgagggygaagcaggagtcggggtggagagcaactccgatggggcctccccggagccctgcaccgtcacccctggtgccgtgaagctggagaaggagaagctggagc

SEQ ID NO: 8606 - DNA, 201 bp, Homo sapiens
tagcttcaagaacatgtgtaagctgcggcccttgctgcagaagtgggtggaggaagctgacaacaatgaaaatcttcaggagatatgcaaagcagaaaccytcgtgcaggcccgaaagagaaagcgaaccagtatcgagaaccgagtgagaggcaacctggagaatttgttcctgcagtgcccgaaacccacactgcagca

SEQ ID NO: 8607 - DNA, 168 bp, Homo sapiens
aagccctcatttcaccaggcccccggcttggggcgccttccttccccatggcgggacacctggcttcrgatttcgccttctcgccccctccaggtggtggaggtgatgggccaggggggccggagccgggctgggttgatcctcggacctggctaagcttccaaggcc

SEQ ID NO: 8608 - DNA, 201 bp, Homo sapiens
gccttccttccccatggcgggacacctggcttcagatttcgccttctcgccccctccaggtggtggaggtgatgggccaggggggccggagccgggctggrttgatcctcggacctggctaagcttccaaggccctcctggagggccaggaatcgggccgggggttgggccaggctctgaggtgtgggggattcccccatg

SEQ ID NO: 8609 - DNA, 201 bp, Homo sapiens; identical to SEQ ID NO: 8602

SEQ ID NO: 8610 - DNA, 201 bp, Homo sapiens; identical to SEQ ID NO: 8603

SEQ ID NO: 8611 - DNA, 201 bp, Homo sapiens
atttgtgggtaggttatttctagaagttaggtgggcagcttggaaggcagatgcacttctacagactattccttggggccacacgtaggttcttgaatccsgaatggaaaggggagattgataactggtgtgtttatgttcttacaagtcttctgccttttaaaatccagtcccaggacatcaaagctctgcagaaagaac

SEQ ID NO: 8612 - DNA, 201 bp, Homo sapiens; identical to SEQ ID NO: 8606

SEQ ID NO: 8613 - DNA, 201 bp, Homo sapiens; identical to SEQ ID NO: 8603

SEQ ID NO: 8614 - DNA, 201 bp, Homo sapiens; identical to SEQ ID NO: 8606

SEQ ID NO: 8615 - DNA, 201 bp, Homo sapiens
atttgtgggtaggttatttctagaagttaggtgggcagctcggaaggcagatgcacttctacagactattccttggggccacacgtaggttcttgaatccsgaatggaaaggggagattgataactggtgtgtttatgttcttacaagtcttctgccttttaaaatccagtcccaggacatcaaagctctgcagaaagaac

SEQ ID NO: 8616 - DNA, 201 bp, Homo sapiens; identical to SEQ ID NO: 8606

SEQ ID NO: 8617 - DNA, 201 bp, Homo sapiens
agtaccgcatgcaccaggctatcatgcgctgggcctcagacaccatgtaccttgggcagctcacagcccactcttccgtggcaaggcacctcctgagggamctcccaggtgtggctgccacagaagagacgggtgtgcccctgctcttggtggacaccgccggctgcgggctgtttgagctggaggaggaggacgaacagt

SEQ ID NO: 8618 - DNA, 201 bp, Homo sapiens
gaagtgctctttggcagatctgctcccagtcctgccagtgaaatacacccgctgacattcttcaacacctgcctggacacctcccagaaagaagcggtttyatttgcgctgtctcagaaagaacttgccatcatccatggacctcctggcactgggaaaaccacgactgtggttgagatcattcttcaagctgtgaaacaa

SEQ ID NO: 8619 - DNA, 201 bp, Homo sapiens
ccgtgatactgtccttcgtcagatccaacaggaaaggtgaagttggttttcttgctgaggaccggaggatcaacgtggctgtcacccgtgcccgacgccaygtggcggtcatctgtgactcccgtactgtcaacaaccatgcatttttgaagaccctggtggagtatttcacacagcatggggaagtacgcacggcctttg

SEQ ID NO: 8620 - DNA, 201 bp, Homo sapiens
gggcagcccgccagcaaggagcagcaggcctcagggcagcagaaacttccagaaaagaaaaagaaaaaagccaaaggacatccggccacagatctgcccamggaggaggactttgaggccctggtttctgccgccgttaaggctgataacacctgcggctttgccaagtgcacagccggcgtcacaaccctgggccagttc

SEQ ID NO: 8621 - DNA, 117 bp, Homo sapiens
cggcggggaacaccggyccgctgtaacaccggcccggcgcagaagcgggacgtcggcttctaggggcccaggccggcggcggcgatggcctcggcagctgtggagagcttcgtgacc

SEQ ID NO: 8622 - DNA, 201 bp, Homo sapiens
agcgcaggtcctggcaggagaacatctctctgaaagagctccagagccgaggcgtgtgtttgctgaagctgcaggtatccagccagcgcactgggctgtayggacggctgctggtcacctttgagcccaggcgatacgggtccgcggcagctcttcccagtaacagctttacttctggtgatatcgtgggcctgtacgatg

SEQ ID NO: 8623 - DNA, 201 bp, Homo sapiens
ggcacctctttctggcctgtgcacctctctctggcttataaaggtgcctggcctgtgccagcccctccttgttgcgcctcaccgtggggaccaggtgagcyggctctcccacgtggttgtcccgggaaagctgccccacagcctcagcatcttcagcacttaccgatccagagcctcccggccttctccggtgtcctgtac

SEQ ID NO: 8624 - DNA, 201 bp, Homo sapiens
gcccaggcgatacgggtccgcggcagctcttcccagtaacagctttacttctggtgatatcgtgggcctgtacgatgctgctaatgagggcagtcagctgkccactgggatcttgacccgggtcacccagaagtcggtcacggtggcctttgatgagtcccacgatttccagttgagcttggaccgagagaattcctacag

SEQ ID NO: 8625 - DNA, 201 bp, Homo sapiens
acgtggtccttgcaacaaacacaggtgcgtctgccgatggccccctgaagttgctgcccgagagctacttcgacgtggtggtcattgacgagtgtgcccargccctcgaggcgagctgctggatccccctgctgaaggccagaaagtgcatcctggcgggcgatcacaagcagctgccccccaccacagtctctcacaagg

SEQ ID NO: 8626 - DNA, 201 bp, Homo sapiens
gtgtgcccctgctcttggtggacaccgccggctgcgggctgtttgagctggaggaggaggacgaacagtcgaaagggaaccctggcgaagtccgcctcgtyagtttgcacatccaggctctggtggacgctggtgttccagcccgtgacattgctgtggtctcgccatacaacctccaggtggacctgctcagacagagcc

SEQ ID NO: 8627 - DNA, 201 bp, Homo sapiens
cccctgcgcagacagagcagcctcccagggagcagcgtggcccagaccagcctgatctgaggacgctgcacctggagagactgcagagggtcaggagcgcrcaggggcagcccgccagcaaggagcagcaggcctcagggcagcagaaacttccagaaaagaaaaagaaaaaagccaaaggacatccggccacagatctgc

SEQ ID NO: 8628 - DNA, 201 bp, Homo sapiens
atcgtgggcctgtacgatgctgctaatgagggcagtcagctggccactgggatcttgacccgggtcacccagaagtcggtcacggtggcctttgatgagtyccacgatttccagttgagcttggaccgagagaattcctacagactgttaaaacttgccaatgatgtcacttacaggcgactgaaaaaagccctgattgct

SEQ ID NO: 8629 - DNA, 201 bp, Homo sapiens
cgccccctccaacatcgccgtggacaatctggtggagcgcctggctctgtgtaagcagcggattctgcgcctgggacaccctgcccgcctcctggagtccrttcagcagcactccctggatgcggttttagcgcggagcgacagtgcccagattgttgcagatatcaggaaggacatcgaccaggtctttgtgaaaaacaa

SEQ ID NO: 8630 - DNA, 201 bp, Homo sapiens
cccgagagctacttcgacgtggtggtcattgacgagtgtgcccaggccctcgaggcgagctgctggatccccctgctgaaggccagaaagtgcatcctggygggcgatcacaagcagctgccccccaccacagtctctcacaaggctgcgctggcaggactgtcactcagcctgatggaacgcctggctgaggagtacggc

SEQ ID NO: 8631 - DNA, 201 bp, Homo sapiens
gagccgaggcgtgtgtttgctgaagctgcaggtatccagccagcgcactgggctgtacggacggctgctggtcacctttgagcccaggcgatacgggtccrcggcagctcttcccagtaacagctttacttctggtgatatcgtgggcctgtacgatgctgctaatgagggcagtcagctggccactgggatcttgacccg

SEQ ID NO: 8632 - DNA, 183 bp, Homo sapiens
cggcggggaacaccggtccgctgtaacaccggcccggcgcagaagcgggacgtcggcttctaggggcccaggccggcggcggygatggcctcggcagctgtggagagcttcgtgaccaagcaactggacctgctggagctcgagagagacgcggaggtggaggagcgcaggtcctggcaggag

SEQ ID NO: 8633 - DNA, 201 bp, Homo sapiens
cacggcctttgagtatcttgacgatattgtcccagaaaactattcccatgagaactcccagggttccagccacgctgccaccaagccccagggacctgctrcgtccaccaggaccggaagccagcggcaggagggaggccaggaggctgcagcacctgccagacagggccggaagaagccggctgggaagtctctggcctc

SEQ ID NO: 8634 - DNA, 201 bp, Homo sapiens
gctgcagaggaggctggataagaagctgagtgagctcagcaaccagaggaccagccggaggaaggagagggggacgtgaccggccgcatccttgcacgccycgcggagctctctccatggtagcccagggcgctggcagaccatgctccgcctccaccagggccacagaggagcggaggggcctatgggggaggagcggag

SEQ ID NO: 8635 - DNA, 201 bp, Homo sapiens
ccacgctgccaccaagccccagggacctgctacgtccaccaggaccggaagccagcggcaggagggaggccaggaggctgcagcacctgccagacagggcyggaagaagccggctgggaagtctctggcctctgaagctccatctcagcccagcctcaacggaggcagcccagagggagtggagagccaagatggcgtgga

SEQ ID NO: 8636 - DNA, 201 bp, Homo sapiens
accagccggaggaaggagagggggacgtgaccggccgcatccttgcacgccccgcggagctctctccatggtagcccagggcgctggcagaccatgctccrcctccaccagggccacagaggagcggaggggcctatgggggaggagcggagggccctgttggggaaggttgggtttttggaccccagggataagcttttc

SEQ ID NO: 8637 - DNA, 201 bp, Homo sapiens
gcaagaagatgcagttggagtttcctccttccctcaattcccacgacaggctgcgggtccaccaaatagccgaggagcacgggctgaggcacgacagttcyggggaagggaagaggaggttcatcactgtgagcaagagggccccgcgaccccgagcagccctgggacccccagcagggaccggtggcccagcccctctcc

SEQ ID NO: 8638 - DNA, 201 bp, Homo sapiens
ccagggataagcttttccgatgtcacaatgtggaggaaagcacctgggggacaacagtgctcgtgcaggtggggcttgggaaatgcacgtcccttcccctyactccccgccaaaacccacatcccagcctctggatcctggggaaggttccagtccctggagaatacccagggcctcaaacttgaagtcactcctccaatg

SEQ ID NO: 8639 - DNA, 201 bp, Homo sapiens
agaagcgggacgtcggcttctaggggcccaggccggcggcggcgatggcctcggcagctgtggagagcttcgtgaccaagcaactggacctgctggagctygagagagacgcggaggtggaggagcgcaggtcctggcaggagaacatctctctgaaagagctccagagccgaggcgtgtgtttgctgaagctgcaggtat

SEQ ID NO: 8640 - DNA, 201 bp, Homo sapiens
tgaggagtacggcgcgagggtggtgcggacactgacggtgcagtaccgcatgcaccaggctatcatgcgctgggcctcagacaccatgtaccttgggcagytcacagcccactcttccgtggcaaggcacctcctgagggacctcccaggtgtggctgccacagaagagacgggtgtgcccctgctcttggtggacaccgc

SEQ ID NO: 8641 - DNA, 201 bp, Homo sapiens
ctgtgcacctctctctggcttataaaggtgcctggcctgtgccagcccctccttgttgcgcctcaccgtggggaccaggtgagccggctctcccacgtggytgtcccgggaaagctgccccacagcctcagcatcttcagcacttaccgatccagagcctcccggccttctccggtgtcctgtaccaactcttctatttaa

SEQ ID NO: 8642 - DNA, 201 bp, Homo sapiens
aagtccagtttggtcccatccacagcccggagctcacccatgaaagggtgttcccgcagctcctcctatgccagcacccgatcctccagtcactcgtcccratccccaaatcccagggcttcccccaggtacacccaaagccgatccacctcttctgaaaaaaggtcctactcccgctctcccagctattcctccaagtct

SEQ ID NO: 8643 - DNA, 201 bp, Homo sapiens
tcccctgaggaagggcagaagtcccgccgaaggcactcccgccgctgctccaagaccctctgcaaggacagccctgaggcccagtccagtcgcccgcccartcaacccctccagatgcttggctacctgtcagccaggggtgtaatcactgggtcggggtctgctgctgacctctttaccaaaacagccagcccgctcacc

SEQ ID NO: 8644 - DNA, 201 bp, Homo sapiens
ccctccagatgcttggctacctgtcagccaggggtgtaatcactgggtcggggtctgctgctgacctctttaccaaaacagccagcccgctcaccacctcrcgaggacgttcccaggagtacgactcaggaaatgacacgtcctcgccaccctccacgcaaaccagctcagccaggtctcggggccaggagaaggggagcc

SEQ ID NO: 8645 - DNA, 201 bp, Homo sapiens
ccgcggccggtcccctgaggaagggcagaagtcccgccgaaggcactcccgccgctgctccaagaccctctgcaaggacagccctgaggcccagtccagtygcccgcccagtcaacccctccagatgcttggctacctgtcagccaggggtgtaatcactgggtcggggtctgctgctgacctctttaccaaaacagccag

SEQ ID NO: 8646 - DNA, 201 bp, Homo sapiens
accacctcctcaccccagaacaagggggccatgttggagaatctctcccccaccagcaggggcagagagtcaaggggatttcagtcaccgtgtctggaatrtgccgaagtgaagaagtccagtttggtcccatccacagcccggagctcacccatgaaagggtgttcccgcagctcctcctatgccagcacccgatcctcc

SEQ ID NO: 8647 - DNA, 201 bp, Homo sapiens
catggctctgaaggagcgcattggctggagatacagcctcctcttcgtgggcctactacagttaaacattgtcatcttcggagcactgctcagacccatcwttatcagaggaccagcgtcaccgaaaatagtcatccaggaaaatcggaaagaagcgcagtatatgcttgaaaatgagaaaacacgaacctcaatagactc

SEQ ID NO: 8648 - DNA, 201 bp, Homo sapiens
ctgctcagacccatctttatcagaggaccagcgtcaccgaaaatagtcatccaggaaaatcggaaagaagcgcagtatatgcttgaaaatgagaaaacacraacctcaatagactccattgactcaggagtagaactaactacctcacctaaaaatgtgcctactcacactaacctggaactggagccgaaggccgacatg

SEQ ID NO: 8649 - DNA, 201 bp, Homo sapiens
ccacaggagaatgtttcgctgtgtttgctttcgcaccagcaatcatggctctgaaggagcgcattggctggagatacagcctcctcttcgtgggcctactrcagttaaacattgtcatcttcggagcactgctcagacccatctttatcagaggaccagcgtcaccgaaaatagtcatccaggaaaatcggaaagaagcgc

SEQ ID NO: 8650 - DNA, 201 bp, Homo sapiens
gacttgattggtctaagttgccagaggtatcgggtaactggtcattgttttgttttgtttgttttattcttcctttttttttggagtcacactacatgtayagtattgctcacgttagcagttttctgtaaggagggcaagtgtcaggataataggtggactttttactcacctattttaccacaatctcaccctgcaggt

SEQ ID NO: 8651 - DNA, 201 bp, Homo sapiens
tcttcgtgggcctactacagttaaacattgtcatcttcggagcactgctcagacccatctttatcagaggaccagcgtcaccgaaaatagtcatccaggamaatcggaaagaagcgcagtatatgcttgaaaatgagaaaacacgaacctcaatagactccattgactcaggagtagaactaactacctcacctaaaaatg

SEQ ID NO: 8652 - DNA, 201 bp, Homo sapiens
ctgaataaactactctcctgaataaaacaacatccaacccaggtcattgaaatgaaattggccagtcaaaaaaaaaaagacttcaatcatttttaaaattyctaattttcagaaatatgaataaatagtttttgttaaaccctttgtaaaataccaaggttcccgttaacaaattacggcctctgcttgctggaaatgaaa

SEQ ID NO: 8653 - DNA, 199 bp, Homo sapiens
tgatttctgagggatctgctccatgtctattctgttatctgcatgaaaacaaaatgtatgccaatttcagtatgtcaataatcaaggttttaaatgtttgraagaaaatacaaacaagattgctgatctgttctgtattagtgacattctggtacttctagatttgcaataaatttatggattttttatttaaagagac

SEQ ID NO: 8654 - DNA, 201 bp, Homo sapiens
gttcccgttaacaaattacggcctctgcttgctggaaatgaaatatagtttaagaccaaacattttactaataaacaaattttaagtatatatatatatawaacttgaacttcataaatgtgaagattaccacttctttttatggccagtccttatcagaagtgtttcagtacagaatatacaaaatggcatttaaaaatg

SEQ ID NO: 8655 - DNA, 201 bp, Homo sapiens
ttcggacaccgtctggtagtgatgttgggggggctacttgtcagcaccgggatggtggccgcctccttctcacaagaggtttctcatatgtacgtcgccaycggcatcatctctggtctgggatactgctttagttttctcccaactgtaaccatcctatcacaatattttggcaaaagacgttccatagtcactgcagtt

SEQ ID NO: 8656 - DNA, 201 bp, Homo sapiens
tacatcttctataacacatgacttgattggtctaagttgccagaggtatcgggtaactggtcattgttttgttttgtttgttttattcttcctttttttttggagtcacactacatgtacagtattgctcacgttagcagttttctgtaaggagggcaagtgtcaggataataggtggactttttactcacctattttacc

SEQ ID NO: 8657 - DNA, 201 bp, Homo sapiens
aagatctacagcagggccttctactcctgcgcagctggcatggccctggctgctgtgtgcctcgccctggtgagaccgtgtaagatgggactgtgccagcrtcatcactcaggtgaaacaaaggtagtgagccatcgtgggaagactttacaggacatacctgaagactttctggaaatggatcttgcaaaaaatgagcac

SEQ ID NO: 8658 - DNA, 201 bp, Homo sapiens
cttgctggaaatgaaatatagtttaagaccaaacattttactaataaacaaattttaagtatatatatatatataacttgaacttcataaatgtgaagatwaccacttctttttatggccagtccttatcagaagtgtttcagtacagaatatacaaaatggcatttaaaaatgtgtttcctgttgcttttagttatacag

SEQ ID NO: 8659 - DNA, 201 bp, Homo sapiens; identical to SEQ ID NO: 8647

SEQ ID NO: 8660 - DNA, 201 bp, Homo sapiens; identical to SEQ ID NO: 8648

SEQ ID NO: 8661 - DNA, 201 bp, Homo sapiens; identical to SEQ ID NO: 8649

SEQ ID NO: 8662 - DNA, 201 bp, Homo sapiens; identical to SEQ ID NO: 8651

SEQ ID NO: 8663 - DNA, 201 bp, Homo sapiens; identical to SEQ ID NO: 8652

SEQ ID NO: 8664 - DNA, 201 bp, Homo sapiens; identical to SEQ ID NO: 8655

SEQ ID NO: 8665 - DNA, 201 bp, Homo sapiens; identical to SEQ ID NO: 8654

SEQ ID NO: 8666 - DNA, 201 bp, Homo sapiens; identical to SEQ ID NO: 8657

SEQ ID NO: 8667 - DNA, 201 bp, Homo sapiens; identical to SEQ ID NO: 8658

SEQ ID NO: 8668 - DNA, 201 bp, Homo sapiens; identical to SEQ ID NO: 8655

SEQ ID NO: 8669 - DNA, 201 bp, Homo sapiens
tcttcgtgggcctactacagttaaacattgtcatcttcggagcactgctcagacccatcattatcagaggaccagcgtcaccgaaaatagtcatccaggamaatcggaaagaagcgcagtatatgcttgaaaatgagaaaacacgaacctcaatagactccattgactcaggagtagaactaactacctcacctaaaaatg

SEQ ID NO: 8670 - DNA, 201 bp, Homo sapiens; identical to SEQ ID NO: 8647

SEQ ID NO: 8671 - DNA, 201 bp, Homo sapiens
ccacaggagaatgtttcgctgtgtttgctttcgcaccagcaatcatggctctgaaggagcgcattggctggagatacagcctcctcttcgtgggcctactrcagttaaacattgtcatcttcggagcactgctcagacccatcattatcagaggaccagcgtcaccgaaaatagtcatccaggaaaatcggaaagaagcgc

SEQ ID NO: 8672 - DNA, 201 bp, Homo sapiens
ctgctcagacccatcattatcagaggaccagcgtcaccgaaaatagtcatccaggaaaatcggaaagaagcgcagtatatgcttgaaaatgagaaaacacraacctcaatagactccattgactcaggagtagaactaactacctcacctaaaaatgtgcctactcacactaacctggaactggagccgaaggccgacatg

SEQ ID NO: 8673 - DNA, 201 bp, Homo sapiens; identical to SEQ ID NO: 8657

SEQ ID NO: 8674 - DNA, 201 bp, Homo sapiens
tcctgaactgcttgttccagaatcgagaagaaattagacaagaatatctgaagttggaaatgttacttaaagaaaatgaacttaaatcattctaccaacarcagtgccataaacaaatagaaatgatgtgttctgaagacaaagtagaaaaggccactggaaaacgagatcatagacttgcaatgttgaaaactcgtcgct

SEQ ID NO: 8675 - DNA, 201 bp, Homo sapiens
aaagaatcagcatatcccttacagaaatagtaagcttactcgcttgttaaaggattctcttggaggaaactgtcaaactataatgatagctgctgttagtycttcctctgtattctacgatgacacatataacactcttaagtatgctaaccgggcaaaggacattaaatcttctttgaagagcaatgttcttaatgtcaa

SEQ ID NO: 8676 - DNA, 201 bp, Homo sapiens
ctgtaccaagcatggtgccatcctacatggcaatgactactgctgccaaaaggaaacggaaattaacaagttctacatcaaacagttcgttaactgcagaygtaaattctggatttgccaaacgtgttcgacaagataattcaagtgagaagcacttacaagaaaacaaaccaacaatggaacataaaagaaacatctgta

SEQ ID NO: 8677 - DNA, 201 bp, Homo sapiens
gcctattgtatatacaccagaagactgtagaaaagcttttcaaaatccgtctacagtaaccttaatgaaaccatcatcatttactacaagttttcaggctrtcagctcaaacataaacagtgataattgtctgaaaatgttgtgtgaagtagctatccctcataatagaagaaaagaatgtggacaggaggacttggactc

SEQ ID NO: 8678 - DNA, 201 bp, Homo sapiens
aaatccgtctacagtaaccttaatgaaaccatcatcatttactacaagttttcaggctatcagctcaaacataaacagtgataattgtctgaaaatgttgygtgaagtagctatccctcataatagaagaaaagaatgtggacaggaggacttggactctacatttactatatgtgaagacatcaagagctcgaagtgtaa

SEQ ID NO: 8679 - DNA, 201 bp, Homo sapiens
agacaaaacagcaagtatcaatcaaaatgtccgtattgccaagatgtcactcattgacctggcaggatctgagcgagcaagtacttccggtgctaaggggrcccgatttgtagaaggcacaaatattaatagatcacttttagctcttgggaatgtcatcaatgccttagcagattcaaagagaaagaatcagcatatccc

SEQ ID NO: 8680 - DNA, 201 bp, Homo sapiens
ccacctattgggccaacctgtggaaggcgtgcgttaccgactccacgggcgtctccaactgcaaggacttcccctccatgctggcgctggacggttatatmcaggcatgtagaggacttatgatcgctgctgtcagcctgggcttctttggttccatatttgcgctctttggaatgaagtgtaccaaagtcggaggctccg

SEQ ID NO: 8681 - DNA, 201 bp, Homo sapiens; identical to SEQ ID NO: 6799

SEQ ID NO: 8682 - DNA, 201 bp, Homo sapiens; identical to SEQ ID NO: 6803

SEQ ID NO: 8683 - DNA, 201 bp, Homo sapiens
  misc_feature (1)...(201): n = A,T,C or G, or insertion/deletion polymorphism (see Tables 1-2)
gctgtgacatcatactcgtgatggaaatcaaggacagcaacaacaggatctgccccatactgatggagaagctgaacagaaattcaaggagaggcataacntacaactatgtgattagctctcggcttggaagaaacacatataaagaacaatatgcctttctctacaaggaaaagctggtgtctgtgaagaggagttatc

SEQ ID NO: 8684 - DNA, 201 bp, Homo sapiens
acttcgtgattatccccctgcacaccaccccagagacatccgttaaggagatcgatgagttggttgaggtctacacggacgtgaaacaccgctggaaggcrgagaatttcattttcatgggtgacttcaatgccggctgcagctacgtccccaagaaggcctggaagaacatccgcttgaggactgaccccaggtttgttt

SEQ ID NO: 8685 - DNA, 201 bp, Homo sapiens
gtcagcaggcgctttataagtcagtggagcctgcggaagtggccagaatccagcactccaagcactgctgtcttctcacagagtcttgaagccagagcagygccaggatgtcacgggagctggccccactgctgcttctcctcctctccatccacagcgccctggccatgaggatctgctccttcaacgtcaggtcctttg

SEQ ID NO: 8686 - DNA, 201 bp, Homo sapiens
ccaagcactgctgtcttctcacagagtcttgaagccagagcagcgccaggatgtcacgggagctggccccactgctgcttctcctcctctccatccacagygccctggccatgaggatctgctccttcaacgtcaggtcctttggggaaagcaagcaggaagacaagaatgccatggatgtcattgtgaaggtcatcaaac

SEQ ID NO: 8687 - DNA, 201 bp, Homo sapiens
tctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatga

SEQ ID NO: 8688 - DNA, 201 bp, Homo sapiens
cacggacgtgaaacaccgctggaaggcggagaatttcattttcatgggtgacttcaatgccggctgcagctacgtccccaagaaggcctggaagaacatcygcttgaggactgaccccaggtttgtttggctgatcggggaccaagaggacaccacggtgaagaagagcaccaactgtgcatatgacaggattgtgcttag

SEQ ID NO: 8689 - DNA, 201 bp, Homo sapiens
gctgtcaaagacttcgtgattatccccctgcacaccaccccagagacatccgttaaggagatcgatgagttggttgaggtctacacggacgtgaaacaccrctggaaggcggagaatttcattttcatgggtgacttcaatgccggctgcagctacgtccccaagaaggcctggaagaacatccgcttgaggactgacccc

SEQ ID NO: 8690 - DNA, 201 bp, Homo sapiens
tcagcaggcgctttataagtcagtggagcctgcggaagtggccagaatccagcactccaagcactgctgtcttctcacagagtcttgaagccagagcagcrccaggatgtcacgggagctggccccactgctgcttctcctcctctccatccacagcgccctggccatgaggatctgctccttcaacgtcaggtcctttgg

SEQ ID NO: 8691 - DNA, 201 bp, Homo sapiens
aaatcaaggacagcaacaacaggatctgccccatactgatggagaagctgaacagaaattcaaggagaggcataacgtacaactatgtgattagctctcgscttggaagaaacacatataaagaacaatatgcctttctctacaaggaaaagctggtgtctgtgaagaggagttatcactaccatgactatcaggatggag

SEQ ID NO: 8692 - DNA, 201 bp, Homo sapiens; identical to SEQ ID NO: 8683
  misc_feature (1)...(201): n = A,T,C or G, or insertion/deletion polymorphism (see Tables 1-2)

SEQ ID NO: 8693 - DNA, 201 bp, Homo sapiens; identical to SEQ ID NO: 8684

SEQ ID NO: 8694 - DNA, 191 bp, Homo sapiens
gctttataagtcagtggagcctgcggaagtggccagaatccagcactccaagcactgctgtcttctcacagagtcttgaagccagagcagygccaggatgtcacgggagctggccccactgctgcttctcctcctctccatccacagcgccctggccatgaggatctgctccttcaacgtcaggtcctttg

SEQ ID NO: 8695 - DNA, 201 bp, Homo sapiens; identical to SEQ ID NO: 8686

SEQ ID NO: 8696 - DNA, 201 bp, Homo sapiens; identical to SEQ ID NO: 8687

SEQ ID NO: 8697 - DNA, 201 bp, Homo sapiens; identical to SEQ ID NO: 8688

SEQ ID NO: 8698 - DNA, 201 bp, Homo sapiens; identical to SEQ ID NO: 8689

SEQ ID NO: 8699 - DNA, 192 bp, Homo sapiens
gctttataagtcagtggagcctgcggaagtggccagaatccagcactccaagcactgctgtcttctcacagagtcttgaagccagagcagcrccaggatgtcacgggagctggccccactgctgcttctcctcctctccatccacagcgccctggccatgaggatctgctccttcaacgtcaggtcctttgg

SEQ ID NO: 8700 - DNA, 201 bp, Homo sapiens; identical to SEQ ID NO: 8691

SEQ ID NO: 8701 - DNA, 201 bp, Homo sapiens; identical to SEQ ID NO: 8688

SEQ ID NO: 8702 - DNA, 201 bp, Homo sapiens; identical to SEQ ID NO: 8689

SEQ ID NO: 8703 - DNA, 201 bp, Homo sapiens; identical to SEQ ID NO: 8687

SEQ ID NO: 8704 - DNA, 180 bp, Homo sapiens
  misc_feature (1)...(180): n = A,T,C or G, or insertion/deletion polymorphism (see Tables 1-2)
ctagatgtcagagctggctcccggttgggatatgagtgactttgtggaggatggcgcctaaatgaggcatgccaatttcngcaccagggtgacgaacataagggctccttaaaggctagcccaatgtatctgtatttccttggggattaaaacccatgatcttcagttcctcagagaact

SEQ ID NO: 8705 - DNA, 201 bp, Homo sapiens
agagctggctcccggttgggatatgagtgactttgtggaggatggcgcctaaatgaggcatgccaatttctgcaccagggtgacgaacataagggctcctwaaaggctagcccaatgtatctgtatttccttggggattaaaacccatgatcttcagttcctcagagaactgaaagttgcaaggagaaatccagtaattcc

SEQ ID NO: 8706 - DNA, 201 bp, Homo sapiens; identical to SEQ ID NO: 8683
  misc_feature (1)...(201): n = A,T,C or G, or insertion/deletion polymorphism (see Tables 1-2)

SEQ ID NO: 8707 - DNA, 201 bp, Homo sapiens; identical to SEQ ID NO: 8684

SEQ ID NO: 8708 - DNA, 201 bp, Homo sapiens
tatctgcaggctttataagtcagtggagcctgcggaagtggccagaatccagcactccaagcactgctgtcttctcacagagtcttgaagccagagcagcrccaggatgtcacgggagctggccccactgctgcttctcctcctctccatccacagcgccctggccatgaggatctgctccttcaacgtcaggtcctttgg

SEQ ID NO: 8709 - DNA, 201 bp, Homo sapiens; identical to SEQ ID NO: 8691

SEQ ID NO: 8710 - DNA, 201 bp, Homo sapiens
ttatctgcaggctttataagtcagtggagcctgcggaagtggccagaatccagcactccaagcactgctgtcttctcacagagtcttgaagccagagcagygccaggatgtcacgggagctggccccactgctgcttctcctcctctccatccacagcgccctggccatgaggatctgctccttcaacgtcaggtcctttg

SEQ ID NO: 8711 - DNA, 201 bp, Homo sapiens; identical to SEQ ID NO: 8686

SEQ ID NO: 8712 - DNA, 201 bp, Homo sapiens; identical to SEQ ID NO: 8683
  misc_feature (1)...(201): n = A,T,C or G, or insertion/deletion polymorphism (see Tables 1-2)

SEQ ID NO: 8713 - DNA, 201 bp, Homo sapiens; identical to SEQ ID NO: 8684

SEQ ID NO: 8714 - DNA, 201 bp, Homo sapiens
caggcgttaggctttataagtcagtggagcctgcggaagtggccagaatccagcactccaagcactgctgtcttctcacagagtcttgaagccagagcagygccaggatgtcacgggagctggccccactgctgcttctcctcctctccatccacagcgccctggccatgaggatctgctccttcaacgtcaggtcctttg

SEQ ID NO: 8715 - DNA, 201 bp, Homo sapiens; identical to SEQ ID NO: 8686

SEQ ID NO: 8716 - DNA, 201 bp, Homo sapiens; identical to SEQ ID NO: 8687

SEQ ID NO: 8717 - DNA, 201 bp, Homo sapiens; identical to SEQ ID NO: 8688

SEQ ID NO: 8718 - DNA, 201 bp, Homo sapiens; identical to SEQ ID NO: 8689

SEQ ID NO: 8719 - DNA, 145 bp, Homo sapiens
  misc_feature (1)...(145): n = A,T,C or G, or insertion/deletion polymorphism (see Tables 1-2)
cagcctatgacacttttgctcctcctgaaatctccatatcttgcntttctcaaattccaaggtagcctttgcgcaacatatcactctccactgactcttgtcccatcagggcccatagtggatggctgtatgggggccatgtgac

SEQ ID NO: 8720 - DNA, 201 bp, Homo sapiens
aggcgttaggctttataagtcagtggagcctgcggaagtggccagaatccagcactccaagcactgctgtcttctcacagagtcttgaagccagagcagcrccaggatgtcacgggagctggccccactgctgcttctcctcctctccatccacagcgccctggccatgaggatctgctccttcaacgtcaggtcctttgg

SEQ ID NO: 8721 - DNA, 201 bp, Homo sapiens; identical to SEQ ID NO: 8691

SEQ ID NO: 8722 - DNA, 201 bp, Homo sapiens
gagcggatccccagccgtccctgggcgttctcccgggttctagcaaagccccccggggtgcccatcagtttccttgggtgactacagcgtgtgttttttcyttcctctttcccctgcctgtgtgcccttctccaggatggcagaggcggaattgcacaaggaaaggctgcaagccatagcagaaaaaagaaagaggcagac

SEQ ID NO: 8723 - DNA, 201 bp, Homo sapiens
cagaaaagcctcagagcatgtttgagccacctcaggtgtcttctcctgttcaagagaaaagggatgtattaccaaagattctgcctgctgaagacagggcrctcagggaaagggggcccccccagccactgccagctgtgcagcccagtggcccgattaacatggaggagaccaggcccgaaggaagctatttcagcaagt

SEQ ID NO: 8724 - DNA, 201 bp, Homo sapiens
ggtggataaagctgtgtccaaaaccagcagggatggagcagagcaacagggacctgaagcgactgtagaggaagctgaagctgcggctttcggctcagaaragcctcagagcatgtttgagccacctcaggtgtcttctcctgttcaagagaaaagggatgtattaccaaagattctgcctgctgaagacagggcgctcag

SEQ ID NO: 8725 - DNA, 201 bp, Homo sapiens
acatcctccccagagcctggtgcagtggttctggtgggcggcctaagcccccctgtccacgaggcgacccagccagaacccactgaaagaacagctagccrgcaggcacctcctcacatcgagctcagtaatagcagccctgaccccatggcagaggcagaaagaacaaatggccattcccccagccagcctagagatgcg

SEQ ID NO: 8726 - DNA, 201 bp, Homo sapiens
tcagaaaagcctcagagcatgtttgagccacctcaggtgtcttctcctgttcaagagaaaagggatgtattaccaaagattctgcctgctgaagacagggygctcagggaaagggggcccccccagccactgccagctgtgcagcccagtggcccgattaacatggaggagaccaggcccgaaggaagctatttcagcaag

SEQ ID NO: 8727 - DNA, 201 bp, Homo sapiens
agaatgccattcaacaagccatagccgagcaggtggataaagctgtgtccaaaaccagcagggatggagcagagcaacagggacctgaagcgactgtagargaagctgaagctgcggctttcggctcagaaaagcctcagagcatgtttgagccacctcaggtgtcttctcctgttcaagagaaaagggatgtattaccaa

SEQ ID NO: 8728 - DNA, 201 bp, Homo sapiens
tcacccccgcataatggcctccttactgatcaccacgaatccctggataatgatgttgccagagagatccgctatctagatgaggtgctagaggccaactrctgtgattctgctgtggatggaacgtacaatggaacatcctccccagagcctggtgcagtggttctggtgggcggcctaagcccccctgtccacgaggcg

SEQ ID NO: 8729 - DNA, 201 bp, Homo sapiens
gatgaaaccatcaaggctgaattggtcctcattgatgaagatgatgagaagtcattgagggagaagacagtgacggacgtgtccactattgacgggaacgyggctgagcttgtgtccgggaggccggtctcagacaccacagagccctcatccccagaagggaaggaagagagcctagctacagagccagccccaggagtc

SEQ ID NO: 8730 - DNA, 201 bp, Homo sapiens
aaccatcgaggagcagctggacgaggaacatctggagtcgcacaaaaagtacaaggagcgcaaagagagaagggcacagcaggaacagttgctgctgcagmagcagttacagcagcagcagcagcagcccccatcgcagctctgcacagcccctgcctcttctcatgaacgcgcaagcatgattgacaaagcaaaggagga

SEQ ID NO: 8731 - DNA, 201 bp, Homo sapiens
agaacagaggaggcagcagcattgcacagccccaggcacagtggcagttaggatggctggagagtaggatagttctatgggttgcccaaaaaatgtgatgygcttcatgttttctctgactcatggatctggtagagaccatagacatgatatagactaacttccccatttttcacaagaggaaaccatccttatgactta

SEQ ID NO: 8732 - DNA, 201 bp, Homo sapiens
gagctgatgcagtatttgtaatattaagttgacctaacaaggtatttgcatgagtcacaattacaaagttttgagcggttttgtaatttgacatttaggaragtctcctatttattctcatactttacattcatgcttagtatactatagaggatgccagctttaatctttctgtcatttaaagcaatatgataagggtat

SEQ ID NO: 8733 - DNA, 201 bp, Homo sapiens
aggaggcagcagcattgcacagccccaggcacagtggcagttaggatggctggagagtaggatagttctatgggttgcccaaaaaatgtgatgcgcttcaygttttctctgactcatggatctggtagagaccatagacatgatatagactaacttccccatttttcacaagaggaaaccatccttatgacttaccttaaa

SEQ ID NO: 8734 - DNA, 201 bp, Homo sapiens
tttcacagttatgtttcttcataggaaaactatatttagtgggcaacaactatttttatgatgggatgggggagtatatacacgtatagaatctgtacgcrttgaacaacttggttcaagatggtgggggcatttttagagcggcaataattgaaaaaaaaggcgaactctgccttggagaggtagatgataagaaataaa

SEQ ID NO: 8735 - DNA, 201 bp, Homo sapiens
gaagacaacgaataaacttccttcaacccaggaagcgtctttggtgcttgggagaccaagaaaccaagaaattaacaactgaaagcattttaatggactayttattaaagtgcaaacaaactcagcaatccttatgtagaccagaagctgcaatatacaatgatgaaaatgaaacgaaaaggaagtccccccatcagactc

SEQ ID NO: 8736 - DNA, 201 bp, Homo sapiens
caaactgacaacccctcagagggccgaggagaaggcgtctccaagtcatttagtgatcatggtttctattccccttcctccacgctgggggactctccgtyggttgatgaccccttggagtatcaggctggcctcctggtgcagaatgccattcaacaagccatagccgagcaggtggataaagctgtgtccaaaaccagc

SEQ ID NO: 8737 - DNA, 201 bp, Homo sapiens
aggaagagatccgagcagctcaggaaagggaagaggagctgaagaggcagagacaagtcttgcagagtacgcagagccccaggacaaagaatgccccatcrctgccctccagaacatgctacaaaactgctccagggaaaatagagaaagtcaaacctcctccatcccccaccactgaaggccccagcttgcagcctgact

SEQ ID NO: 8738 - DNA, 201 bp, Homo sapiens; identical to SEQ ID NO: 8723

SEQ ID NO: 8739 - DNA, 201 bp, Homo sapiens; identical to SEQ ID NO: 8724

SEQ ID NO: 8740 - DNA, 201 bp, Homo sapiens; identical to SEQ ID NO: 8725

SEQ ID NO: 8741 - DNA, 201 bp, Homo sapiens; identical to SEQ ID NO: 8726

SEQ ID NO: 8742 - DNA, 201 bp, Homo sapiens; identical to SEQ ID NO: 8727

SEQ ID NO: 8743 - DNA, 201 bp, Homo sapiens; identical to SEQ ID NO: 8728

SEQ ID NO: 8744 - DNA, 201 bp, Homo sapiens; identical to SEQ ID NO: 8729

SEQ ID NO: 8745 - DNA, 201 bp, Homo sapiens; identical to SEQ ID NO: 8730

SEQ ID NO: 8746 - DNA, 201 bp, Homo sapiens; identical to SEQ ID NO: 8731

SEQ ID NO: 8747 - DNA, 201 bp, Homo sapiens; identical to SEQ ID NO: 8732

SEQ ID NO: 8748 - DNA, 201 bp, Homo sapiens; identical to SEQ ID NO: 8733

SEQ ID NO: 8749 - DNA, 201 bp, Homo sapiens; identical to SEQ ID NO: 8734

SEQ ID NO: 8750 - DNA, 201 bp, Homo sapiens; identical to SEQ ID NO: 8735

SEQ ID NO: 8751 - DNA, 201 bp, Homo sapiens; identical to SEQ ID NO: 8736

SEQ ID NO: 8752 - DNA, 201 bp, Homo sapiens; identical to SEQ ID NO: 8737

SEQ ID NO: 8753 - DNA, 201 bp, Homo sapiens; identical to SEQ ID NO: 8723

SEQ ID NO: 8754 - DNA, 201 bp, Homo sapiens; identical to SEQ ID NO: 8724

SEQ ID NO: 8755 - DNA, 201 bp, Homo sapiens; identical to SEQ ID NO: 8725

SEQ ID NO: 8756 - DNA, 201 bp, Homo sapiens; identical to SEQ ID NO: 8726

SEQ ID NO: 8757 - DNA, 201 bp, Homo sapiens; identical to SEQ ID NO: 8727

SEQ ID NO: 8758 - DNA, 201 bp, Homo sapiens; identical to SEQ ID NO: 8728

SEQ ID NO: 8759 - DNA, 201 bp, Homo sapiens; identical to SEQ ID NO: 8730

SEQ ID NO: 8760 - DNA, 201 bp, Homo sapiens; identical to SEQ ID NO: 8731

SEQ ID NO: 8761 - DNA, 201 bp, Homo sapiens; identical to SEQ ID NO: 8732

SEQ ID NO: 8762 - DNA, 201 bp, Homo sapiens; identical to SEQ ID NO: 8733

SEQ ID NO: 8763 - DNA, 201 bp, Homo sapiens; identical to SEQ ID NO: 8734

SEQ ID NO: 8764 - DNA, 201 bp, Homo sapiens; identical to SEQ ID NO: 8735

SEQ ID NO: 8765 - DNA, 201 bp, Homo sapiens; identical to SEQ ID NO: 8736

SEQ ID NO: 8766 - DNA, 201 bp, Homo sapiens; identical to SEQ ID NO: 8737

SEQ ID NO: 8767 - DNA, 201 bp, Homo sapiens; identical to SEQ ID NO: 8722

SEQ ID NO: 8768 - DNA, 201 bp, Homo sapiens; identical to SEQ ID NO: 8723

SEQ ID NO: 8769 - DNA, 201 bp, Homo sapiens; identical to SEQ ID NO: 8724

SEQ ID NO: 8770 - DNA, 201 bp, Homo sapiens; identical to SEQ ID NO: 8725

SEQ ID NO: 8771 - DNA, 201 bp, Homo sapiens; identical to SEQ ID NO: 8726

SEQ ID NO: 8772 - DNA, 201 bp, Homo sapiens; identical to SEQ ID NO: 8727

SEQ ID NO: 8773 - DNA, 201 bp, Homo sapiens; identical to SEQ ID NO: 8728

SEQ ID NO: 8774 - DNA, 201 bp, Homo sapiens; identical to SEQ ID NO: 8730

SEQ ID NO: 8775 - DNA, 201 bp, Homo sapiens; identical to SEQ ID NO: 8731

SEQ ID NO: 8776 - DNA, 201 bp, Homo sapiens; identical to SEQ ID NO: 8732

SEQ ID NO: 8777 - DNA, 201 bp, Homo sapiens; identical to SEQ ID NO: 8733

SEQ ID NO: 8778 - DNA, 201 bp, Homo sapiens; identical to SEQ ID NO: 8734

SEQ ID NO: 8779 - DNA, 201 bp, Homo sapiens; identical to SEQ ID NO: 8735

SEQ ID NO: 8780 - DNA, 201 bp, Homo sapiens; identical to SEQ ID NO: 8736

SEQ ID NO: 8781 - DNA, 201 bp, Homo sapiens; identical to SEQ ID NO: 8737

SEQ ID NO: 8782 - DNA, 201 bp, Homo sapiens; identical to SEQ ID NO: 8722

SEQ ID NO: 8783 - DNA, 172 bp, Homo sapiens
tccgggaggccggtctcagacaccacagagccctcatccccagaagggaaggaagagagcctagctacagagccagccccaggtacccaaaagaaaaagcrctgtcaatgctgtgttgtcatgtgaccacttctttcttctcctttcttctgggcagcctgtactctccacc

SEQ ID NO: 8784 - DNA, 201 bp, Homo sapiens
gatgaaaccatcaaggctgaattggtcctcattgatgaagatgatgagaagtcattgagggagaagacagtgacggacgtgtccactattgacgggaacgyggctgagcttgtgtccgggaggccggtctcagacaccacagagccctcatccccagaagggaaggaagagagcctagctacagagccagccccaggtacc

SEQ ID NO: 8785 - DNA, 201 bp, Homo sapiens; identical to SEQ ID NO: 8723

SEQ ID NO: 8786 - DNA, 201 bp, Homo sapiens; identical to SEQ ID NO: 8724

SEQ ID NO: 8787 - DNA, 201 bp, Homo sapiens; identical to SEQ ID NO: 8725

SEQ ID NO: 8788 - DNA, 201 bp, Homo sapiens; identical to SEQ ID NO: 8726

SEQ ID NO: 8789 - DNA, 201 bp, Homo sapiens; identical to SEQ ID NO: 8727

SEQ ID NO: 8790 - DNA, 201 bp, Homo sapiens; identical to SEQ ID NO: 8728

SEQ ID NO: 8791 - DNA, 201 bp, Homo sapiens; identical to SEQ ID NO: 8729

SEQ ID NO: 8792 - DNA, 201 bp, Homo sapiens; identical to SEQ ID NO: 8730

SEQ ID NO: 8793 - DNA, 201 bp, Homo sapiens; identical to SEQ ID NO: 8731

SEQ ID NO: 8794 - DNA, 201 bp, Homo sapiens; identical to SEQ ID NO: 8732

SEQ ID NO: 8795 - DNA, 201 bp, Homo sapiens; identical to SEQ ID NO: 8733

SEQ ID NO: 8796 - DNA, 201 bp, Homo sapiens; identical to SEQ ID NO: 8734

SEQ ID NO: 8797 - DNA, 201 bp, Homo sapiens; identical to SEQ ID NO: 8735

SEQ ID NO: 8798 - DNA, 201 bp, Homo sapiens; identical to SEQ ID NO: 8736

SEQ ID NO: 8799 - DNA, 201 bp, Homo sapiens; identical to SEQ ID NO: 8737

SEQ ID NO: 8800 - DNA, 201 bp, Homo sapiens; identical to SEQ ID NO: 8723

SEQ ID NO: 8801 - DNA, 201 bp, Homo sapiens; identical to SEQ ID NO: 8724

SEQ ID NO: 8802 - DNA, 201 bp, Homo sapiens; identical to SEQ ID NO: 8725

SEQ ID NO: 8803 - DNA, 201 bp, Homo sapiens; identical to SEQ ID NO: 8726

SEQ ID NO: 8804 - DNA, 201 bp, Homo sapiens; identical to SEQ ID NO: 8727

SEQ ID NO: 8805 - DNA, 201 bp, Homo sapiens; identical to SEQ ID NO: 8728

SEQ ID NO: 8806 - DNA, 201 bp, Homo sapiens; identical to SEQ ID NO: 8730

SEQ ID NO: 8807 - DNA, 201 bp, Homo sapiens
tgggcacctgttactacaagaaaatgaacatttaagggattattagaaaatatctattcaaaagaatttgtcactgtggtttccattttccttcctcttarttatgagtcagtttgtcagcattcacatccataagagatgcagtatttaaccctgacttttgtttactctttattccagaagcctccccagctttctgag

SEQ ID NO: 8808 - DNA, 201 bp, Homo sapiens; identical to SEQ ID NO: 8731

SEQ ID NO: 8809 - DNA, 201 bp, Homo sapiens; identical to SEQ ID NO: 8732

SEQ ID NO: 8810 - DNA, 201 bp, Homo sapiens; identical to SEQ ID NO: 8733

SEQ ID NO: 8811 - DNA, 201 bp, Homo sapiens; identical to SEQ ID NO: 8734

SEQ ID NO: 8812 - DNA, 201 bp, Homo sapiens; identical to SEQ ID NO: 8735

SEQ ID NO: 8813 - DNA, 201 bp, Homo sapiens; identical to SEQ ID NO: 8736

SEQ ID NO: 8814 - DNA, 201 bp, Homo sapiens; identical to SEQ ID NO: 8737

SEQ ID NO: 8815 - DNA, 201 bp, Homo sapiens; identical to SEQ ID NO: 8723

SEQ ID NO: 8816 - DNA, 201 bp, Homo sapiens; identical to SEQ ID NO: 8724

SEQ ID NO: 8817 - DNA, 201 bp, Homo sapiens; identical to SEQ ID NO: 8725

SEQ ID NO: 8818 - DNA, 201 bp, Homo sapiens; identical to SEQ ID NO: 8726

SEQ ID NO: 8819 - DNA, 201 bp, Homo sapiens; identical to SEQ ID NO: 8727

SEQ ID NO: 8820 - DNA, 201 bp, Homo sapiens; identical to SEQ ID NO: 8728

SEQ ID NO: 8821 - DNA, 201 bp, Homo sapiens; identical to SEQ ID NO: 8730

SEQ ID NO: 8822 - DNA, 201 bp, Homo sapiens; identical to SEQ ID NO: 8807

SEQ ID NO: 8823 - DNA, 201 bp, Homo sapiens; identical to SEQ ID NO: 8731

SEQ ID NO: 8824 - DNA, 201 bp, Homo sapiens; identical to SEQ ID NO: 8732

SEQ ID NO: 8825 - DNA, 201 bp, Homo sapiens; identical to SEQ ID NO: 8733

SEQ ID NO: 8826 - DNA, 201 bp, Homo sapiens; identical to SEQ ID NO: 8734

SEQ ID NO: 8827 - DNA, 201 bp, Homo sapiens; identical to SEQ ID NO: 8735

SEQ ID NO: 8828 - DNA, 201 bp, Homo sapiens; identical to SEQ ID NO: 8736

SEQ ID NO: 8829 - DNA, 201 bp, Homo sapiens; identical to SEQ ID NO: 8737

SEQ ID NO: 8830 - DNA, 172 bp, Homo sapiens; identical to SEQ ID NO: 8783

SEQ ID NO: 8831 - DNA, 201 bp, Homo sapiens; identical to SEQ ID NO: 8784

SEQ ID NO: 8832 - DNA, 201 bp, Homo sapiens
acagttctgacaatgatgttgcctttctgtgggaataatgtcattgatcatattacctgtgaaattttggcccttctaaaacttgtttgttcagatatcaycatcaatgtgcttatcatgacagtgacaaatattgtttcactggtgattcttctactgttaattttcatctcctatgtgtttattctctcttccatcctg

SEQ ID NO: 8833 - DNA, 201 bp, Homo sapiens
ctgttaattttcatctcctatgtgtttattctctcttccatcctgagaattaattgtgctgagggaagaaagaaagccttctctacctgttcagcgcactygattgtggtcatcttattctacggttcagccctttttatgtacatgaaacccaagtcaaagaacactaatacatctgatgagattattgggctgtcttat

SEQ ID NO: 8834 - DNA, 201 bp, Homo sapiens
tctgcaacccactgaggtactccatcatcatgaacggagtgctgtatgtgcaaatggctgcatggtcctggatcataggctgtctgacctccctattgcamacagttctgacaatgatgttgcctttctgtgggaataatgtcattgatcatattacctgtgaaattttggcccttctaaaacttgtttgttcagatatca

SEQ ID NO: 8835 - DNA, 101 bp, Homo sapiens
tgtcttatggagtggtaagcccaatgttaaatcccatcatctatagcctcaggaataaagaggtcaaagaggctgtaaagaaagtcctgagcagacatctr

SEQ ID NO: 8836 - DNA, 201 bp, Homo sapiens
tctttctggtggggctttcccaatatccagagctccagctttttctgttcctgctctgcctcatcatgtacatgataatcctcctgggaaatagcctcctyattatcatcaccatcttggattctcgcctccatactcccatgtatttctttcttggaaacctctcattcttggacatctgttacacatcctcatccattc

SEQ ID NO: 8837 - DNA, 201 bp, Homo sapiens
aaagtcaacatctaatagaaattactctgccatgactgaattctttctggtggggctttcccaatatccagagctccagctttttctgttcctgctctgcstcatcatgtacatgataatcctcctgggaaatagcctcctcattatcatcaccatcttggattctcgcctccatactcccatgtatttctttcttggaaa

SEQ ID NO: 8838 - DNA, 201 bp, Homo sapiens
ctgcatggtcctggatcataggctgtctgacctccctattgcaaacagttctgacaatgatgttgcctttctgtgggaataatgtcattgatcatattacytgtgaaattttggcccttctaaaacttgtttgttcagatatcaccatcaatgtgcttatcatgacagtgacaaatattgtttcactggtgattcttctac

SEQ ID NO: 8839 - DNA, 140 bp, Homo sapiens
agtcaaagaacactaatacatctgatgagattattgggctgtcttatggagtggtaagcccaatgttaaatcccatcatctatagcctcaggaataaagakgtcaaagaggctgtaaagaaagtcctgagcagacatctg

SEQ ID NO: 8840 - DNA, 201 bp, Homo sapiens
cagagtaccttgtcgtgtacacgcccacccacgagggtggtctggaaatgcagttccgtgtgcctggggaccagacgtccaccatcatccgggagctggarcctggtgtggagtactttatccgtgtatttgccatcctggagaacaagaagagcattcctgtcagcgccagggtggccacgtacttacctgcacctgaag

SEQ ID NO: 8841 - DNA, 201 bp, Homo sapiens
gatcccagacagtcagtgctatagcaacaacagccatgggctccccaaaggaagtcattttctcagacatcactgaaaattcggctactgtcagctggagrgcacccacagcccaagtggagagcttccggattacctatgtgcccattacaggaggtacaccctccatggtaactgtggacggaaccaagactcagacca

SEQ ID NO: 8842 - DNA, 201 bp, Homo sapiens
cagccatgggctccccaaaggaagtcattttctcagacatcactgaaaattcggctactgtcagctggagggcacccacagcccaagtggagagcttccgrattacctatgtgcccattacaggaggtacaccctccatggtaactgtggacggaaccaagactcagaccaggctggtgaaactcatacctggcgtggagt

SEQ ID NO: 8843 - DNA, 201 bp, Homo sapiens
cctgtcagcgccagggtggccacgtacttacctgcacctgaaggcctgaaattcaagtccatcaaggagacatctgtggaagtggagtgggatcctctagrcattgcttttgaaacctgggagatcatcttccggaatatgaataaagaagatgagggagagatcaccaaaagcctgaggaggccagagacctcttaccgg

SEQ ID NO: 8844 - DNA, 201 bp, Homo sapiens
cagtgggatcccagtgttcggtggatctggagtcagccagtggggagaaagacctggcaccgccttcagagcccagcgaaagctttcaggagcacacagtrgatggggaaaaccagattgtcttcacacatcgcatcaacatcccccgccgggcctgtggctgtgccgcagcccctgatgttaaggagctgctgagcagac

SEQ ID NO: 8845 - DNA, 201 bp, Homo sapiens
gccagagacctcttaccggcaaactggtctagctcctgggcaagagtatgagatatctctgcacatagtgaaaaacaatacccggggccctggcctgaagmgggtgaccaccacacgcttggatgcccccagccagatcgaggtgaaagatgtcacagacaccactgccttgatcacctggttcaagcccctggctgagat

SEQ ID NO: 8846 - DNA, 201 bp, Homo sapiens
agttcacaacagacctcgattctccaagagacttgactgctactgaggttcagtcggaaactgccctccttacctggcgacccccccgggcatcagtcacmggttacctgctggtctatgaatcagtggatggcacagtcaaggaagtcattgtgggtccagataccacctcctacagcctggcagacctgagcccatcca

SEQ ID NO: 8847 - DNA, 201 bp, Homo sapiens
tttatctgaatggtgataaggctcaggcgctggaagtcttctgtgacatgacctctgatgggggtggatggattgtgttcctgagacgcaaaaacggacgygagaacttctaccaaaactggaaggcatatgctgctggatttggggaccgcagagaagaattctggcttgggctggacaacctgaacaaaatcacagccc

SEQ ID NO: 8848 - DNA, 201 bp, Homo sapiens
tcacctggttcaagcccctggctgagatcgatggcattgagctgacctacggcatcaaagacgtgccaggagaccgtaccaccatcgatctcacagaggaygagaaccagtactccatcgggaacctgaagcctgacactgagtacgaggtgtccctcatctcccgcagaggtgacatgtcaagcaacccagccaaagaga

SEQ ID NO: 8849 - DNA, 201 bp, Homo sapiens
agacgtgccaggagaccgtaccaccatcgatctcacagaggacgagaaccagtactccatcgggaacctgaagcctgacactgagtacgaggtgtccctcrtctcccgcagaggtgacatgtcaagcaacccagccaaagagaccttcacaacaggcctcgatgctcccaggaatcttcgacgtgtttcccagacagataa

SEQ ID NO: 8850 - DNA, 201 bp, Homo sapiens
ttggacacgcccaaggaccttcaggtttctgaaactgcagagaccagcctgaccctgctctggaagacaccgttggccaaatttgaccgctaccgcctcarttacagtctccccacaggccagtgggtgggagtgcagcttccaagaaacaccacttcctatgtcctgagaggcctggaaccaggacaggagtacaatgtc

SEQ ID NO: 8851 - DNA, 201 bp, Homo sapiens
tggactcctgtaccccttccccaaggactgctcccaagcaatgctgaatggagacacgacctctggcctctacaccatttatctgaatggtgataaggctsaggcgctggaagtcttctgtgacatgacctctgatgggggtggatggattgtgttcctgagacgcaaaaacggacgcgagaacttctaccaaaactggaa

SEQ ID NO: 8852 - DNA, 201 bp, Homo sapiens
agggccgctgcgtggacggccagtgcatctgccacgagggcttcacaggcctggactgtggccagcactcctgccccagtgactgcaacaacttaggacartgcgtctcgggccgctgcatctgcaacgagggctacagcggagaagactgctcagaggtgtctcctcccaaagacctcgttgtgacagaagtgacggaag

SEQ ID NO: 8853 - DNA, 201 bp, Homo sapiens
gttggctgggatggcctcagactcaactggaccgcagctgaccaggcctatgagcactttatcattcaggtgcaggaggccaacaaggtggaggcagctcrgaacctcaccgtgcctggcagccttcgggctgtggacataccgggcctcaaggctgctacgccttatacagtctccatctatggggtgatccagggctat

SEQ ID NO: 8854 - DNA, 201 bp, Homo sapiens
ggtgcattgatgggcagtgcatctgtgacgacggcttcacgggcgaggactgcagccagctggcttgccccagcgactgcaatgaccagggcaagtgcgtraatggagtctgcatctgtttcgaaggctacgccggggctgactgcagccgtgaaatctgcccagtgccctgcagtgaggagcacggcacatgtgtagatg

SEQ ID NO: 8855 - DNA, 201 bp, Homo sapiens
caccatcgatctcacagaggacgagaaccagtactccatcgggaacctgaagcctgacactgagtacgaggtgtccctcatctcccgcagaggtgacatgkcaagcaacccagccaaagagaccttcacaacaggcctcgatgctcccaggaatcttcgacgtgtttcccagacagataacagcatcaccctggaatggag

SEQ ID NO: 8856 - DNA, 201 bp, Homo sapiens
agcacccagccaaacccacctccaccatgggggccatgactcagctgttggcaggtgtctttcttgctttccttgccctcgctaccgaaggtggggtcctsaagaaagtcatccggcacaagcgacagagtggggtgaacgccaccctgccagaagagaaccagccagtggtgtttaaccacgtttacaacatcaagctgc

SEQ ID NO: 8857 - DNA, 201 bp, Homo sapiens
atggcctcagactcaactggaccgcagctgacaatgcctatgagcactttgtcattcaggtgcaggaggtcaacaaagtggaggcagcccagaacctcacrttgcctggcagcctcagggctgtggacatcccgggcctcgaggctgccacgccttatagagtctccatctatggggtgatccggggctatagaacaccag

SEQ ID NO: 8858 - DNA, 201 bp, Homo sapiens
taatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgg

SEQ ID NO: 8859 - DNA, 201 bp, Homo sapiens
ctgcccatatctcagggctaccccctagtactgattttattgtctacctctctggacttgctcccagcatccggaccaaaaccatcagtgccacagccacracagaggccctgccccttctggaaaacctaaccatttccgacattaatccctacgggttcacagtttcctggatggcatcggagaatgcctttgacagct

SEQ ID NO: 8860 - DNA, 201 bp, Homo sapiens
tcaactggaccgcagctgaccaggcctatgagcactttatcattcaggtgcaggaggccaacaaggtggaggcagctcggaacctcaccgtgcctggcagmcttcgggctgtggacataccgggcctcaaggctgctacgccttatacagtctccatctatggggtgatccagggctatagaacaccagtgctctctgctg

SEQ ID NO: 8861 - DNA, 201 bp, Homo sapiens
agaaacaccacttcctatgtcctgagaggcctggaaccaggacaggagtacaatgtcctcctgacagccgagaaaggcagacacaagagcaagcccgcacrtgtgaaggcatccactgaacaagcccctgagctggaaaacctcaccgtgactgaggttggctgggatggcctcagactcaactggaccgcagctgaccag

SEQ ID NO: 8862 - DNA, 201 bp, Homo sapiens
agcaacaggggcctctgtgtggacggacagtgcgtctgtgaggacggcttcaccggccctgactgtgcagaactctcctgtccaaatgactgccatggccrgggtcgctgtgtgaatgggcagtgcgtgtgccatgaaggatttatgggcaaagactgcaaggagcaaagatgtcccagtgactgtcatggccagggccgc

SEQ ID NO: 8863 - DNA, 201 bp, Homo sapiens
ccgctgcgtggacggccagtgcatctgccacgagggcttcacaggcctggactgtggccagcactcctgccccagtgactgcaacaacttaggacaatgcrtctcgggccgctgcatctgcaacgagggctacagcggagaagactgctcagaggtgtctcctcccaaagacctcgttgtgacagaagtgacggaagagac

SEQ ID NO: 8864 - DNA, 201 bp, Homo sapiens
ccatcttcaccacaattggactcctgtaccccttccccaaggactgctcccaagcaatgctgaatggagacacgacctctggcctctacaccatttatctraatggtgataaggctcaggcgctggaagtcttctgtgacatgacctctgatgggggtggatggattgtgttcctgagacgcaaaaacggacgcgagaact

SEQ ID NO: 8865 - DNA, 201 bp, Homo sapiens
ccagggcaagtgcgtaaatggagtctgcatctgtttcgaaggctacgccggggctgactgcagccgtgaaatctgcccagtgccctgcagtgaggagcacrgcacatgtgtagatggcttgtgtgtgtgccacgatggctttgcaggcgatgactgcaacaagcctctgtgtctcaacaattgctacaaccgtggacgatg

SEQ ID NO: 8866 - DNA, 201 bp, Homo sapiens
agcgacagagtggggtgaacgccaccctgccagaagagaaccagccagtggtgtttaaccacgtttacaacatcaagctgccagtgggatcccagtgttcrgtggatctggagtcagccagtggggagaaagacctggcaccgccttcagagcccagcgaaagctttcaggagcacacagtggatggggaaaaccagattg

SEQ ID NO: 8867 - DNA, 201 bp, Homo sapiens
cagtcagtgctatagcaacaacagccatgggctccccaaaggaagtcattttctcagacatcactgaaaattcggctactgtcagctggagggcacccacrgcccaagtggagagcttccggattacctatgtgcccattacaggaggtacaccctccatggtaactgtggacggaaccaagactcagaccaggctggtga

SEQ ID NO: 8868 - DNA, 201 bp, Homo sapiens
gaaataaccctacttgcccccgaacgtaccagggacttaacaggtctcagagaggctactgaatacgaaattgaactctatggaataagcaaaggaaggcratcccagacagtcagtgctatagcaacaacagccatgggctccccaaaggaagtcattttctcagacatcactgaaaattcggctactgtcagctggagg

SEQ ID NO: 8869 - DNA, 201 bp, Homo sapiens
agcctgccacggaatacacactgagaatctttgcagagaaagggccccagaagagctcaaccatcactgccaagttcacaacagacctcgattctccaagrgacttgactgctactgaggttcagtcggaaactgccctccttacctggcgacccccccgggcatcagtcaccggttacctgctggtctatgaatcagtgg

SEQ ID NO: 8870 - DNA, 201 bp, Homo sapiens
atgcgggtcacagagtaccttgtcgtgtacacgcccacccacgagggtggtctggaaatgcagttccgtgtgcctggggaccagacgtccaccatcatccrggagctggagcctggtgtggagtactttatccgtgtatttgccatcctggagaacaagaagagcattcctgtcagcgccagggtggccacgtacttacct

SEQ ID NO: 8871 - DNA, 201 bp, Homo sapiens
tgaaggggtcttcgacaattttgttctcaaaatcagagataccaaaaagcagtctgagccactggaaataaccctacttgcccccgaacgtaccagggacwtaacaggtctcagagaggctactgaatacgaaattgaactctatggaataagcaaaggaaggcgatcccagacagtcagtgctatagcaacaacagccat

SEQ ID NO: 8872 - DNA, 201 bp, Homo sapiens
acagtgcgtctgtgaggacggcttcaccggccctgactgtgcagaactctcctgtccaaatgactgccatggccggggtcgctgtgtgaatgggcagtgcrtgtgccatgaaggatttatgggcaaagactgcaaggagcaaagatgtcccagtgactgtcatggccagggccgctgcgtggacggccagtgcatctgcca

SEQ ID NO: 8873 - DNA, 201 bp, Homo sapiens
tacaggaggtacaccctccatggtaactgtggacggaaccaagactcagaccaggctggtgaaactcatacctggcgtggagtaccttgtcagcatcatcrccatgaagggctttgaggaaagtgaacctgtctcagggtcattcaccacagctctggatggcccatctggcctggtgacagccaacatcactgactcaga

SEQ ID NO: 8874 - DNA, 201 bp, Homo sapiens
ttagaggcctcataactggcattggctatgaggttatggtctctggcttcacccaagggcatcaaaccaagcccttgagggctgagattgttacagaagcmgaaccggaagttgacaaccttctggtttcagatgccaccccagacggtttccgtctgtcctggacagctgatgaaggggtcttcgacaattttgttctca

SEQ ID NO: 8875 - DNA, 201 bp, Homo sapiens
catttccgacattaatccctacgggttcacagtttcctggatggcatcggagaatgcctttgacagctttctagtaacggtggtggattctgggaagctgytggacccccaggaattcacactttcaggaacccagaggaagctggagcttagaggcctcataactggcattggctatgaggttatggtctctggcttcac

SEQ ID NO: 8876 - DNA, 201 bp, Homo sapiens; identical to SEQ ID NO: 8840

SEQ ID NO: 8877 - DNA, 201 bp, Homo sapiens; identical to SEQ ID NO: 8841

SEQ ID NO: 8878 - DNA, 201 bp, Homo sapiens; identical to SEQ ID NO: 8842

SEQ ID NO: 8879 - DNA, 201 bp, Homo sapiens; identical to SEQ ID NO: 8843

SEQ ID NO: 8880 - DNA, 201 bp, Homo sapiens; identical to SEQ ID NO: 8844

SEQ ID NO: 8881 - DNA, 201 bp, Homo sapiens; identical to SEQ ID NO: 8845

SEQ ID NO: 8882 - DNA, 201 bp, Homo sapiens; identical to SEQ ID NO: 8846

SEQ ID NO: 8883 - DNA, 201 bp, Homo sapiens; identical to SEQ ID NO: 8847

SEQ ID NO: 8884 - DNA, 201 bp, Homo sapiens; identical to SEQ ID NO: 8848

SEQ ID NO: 8885 - DNA, 201 bp, Homo sapiens; identical to SEQ ID NO: 8849

SEQ ID NO: 8886 - DNA, 201 bp, Homo sapiens; identical to SEQ ID NO: 8850

SEQ ID NO: 8887 - DNA, 201 bp, Homo sapiens; identical to SEQ ID NO: 8851

SEQ ID NO: 8888 - DNA, 201 bp, Homo sapiens; identical to SEQ ID NO: 8852

SEQ ID NO: 8889 - DNA, 201 bp, Homo sapiens; identical to SEQ ID NO: 8853

SEQ ID NO: 8890 - DNA, 201 bp, Homo sapiens; identical to SEQ ID NO: 8854

SEQ ID NO: 8891 - DNA, 201 bp, Homo sapiens; identical to SEQ ID NO: 8855

SEQ ID NO: 8892 - DNA, 201 bp, Homo sapiens; identical to SEQ ID NO: 8856

SEQ ID NO: 8893 - DNA, 201 bp, Homo sapiens; identical to SEQ ID NO: 8857

SEQ ID NO: 8894 - DNA, 201 bp, Homo sapiens; identical to SEQ ID NO: 8858

SEQ ID NO: 8895 - DNA, 201 bp, Homo sapiens; identical to SEQ ID NO: 8859

SEQ ID NO: 8896 - DNA, 201 bp, Homo sapiens; identical to SEQ ID NO: 8860

SEQ ID NO: 8897 - DNA, 201 bp, Homo sapiens; identical to SEQ ID NO: 8861

SEQ ID NO: 8898 - DNA, 201 bp, Homo sapiens; identical to SEQ ID NO: 8862

SEQ ID NO: 8899 - DNA, 201 bp, Homo sapiens; identical to SEQ ID NO: 8863

SEQ ID NO: 8900 - DNA, 201 bp, Homo sapiens; identical to SEQ ID NO: 8864

SEQ ID NO: 8901 - DNA, 201 bp, Homo sapiens; identical to SEQ ID NO: 8865

SEQ ID NO: 8902 - DNA, 201 bp, Homo sapiens; identical to SEQ ID NO: 8866

SEQ ID NO: 8903 - DNA, 201 bp, Homo sapiens; identical to SEQ ID NO: 8867

SEQ ID NO: 8904 - DNA, 201 bp, Homo sapiens; identical to SEQ ID NO: 8868

SEQ ID NO: 8905 - DNA, 201 bp, Homo sapiens; identical to SEQ ID NO: 8869

SEQ ID NO: 8906 - DNA, 201 bp, Homo sapiens; identical to SEQ ID NO: 8870

SEQ ID NO: 8907 - DNA, 201 bp, Homo sapiens; identical to SEQ ID NO: 8871

SEQ ID NO: 8908 - DNA, 201 bp, Homo sapiens; identical to SEQ ID NO: 8872

SEQ ID NO: 8909 - DNA, 201 bp, Homo sapiens; identical to SEQ ID NO: 8873

SEQ ID NO: 8910 - DNA, 201 bp, Homo sapiens; identical to SEQ ID NO: 8874

SEQ ID NO: 8911 - DNA, 201 bp, Homo sapiens; identical to SEQ ID NO: 8875

SEQ ID NO: 8912 - DNA, 201 bp, Homo sapiens; identical to SEQ ID NO: 8840

SEQ ID NO: 8913 - DNA, 201 bp, Homo sapiens; identical to SEQ ID NO: 8841

SEQ ID NO: 8914 - DNA, 201 bp, Homo sapiens; identical to SEQ ID NO: 8842

SEQ ID NO: 8915 - DNA, 201 bp, Homo sapiens; identical to SEQ ID NO: 8843

SEQ ID NO: 8916 - DNA, 201 bp, Homo sapiens; identical to SEQ ID NO: 8844

SEQ ID NO: 8917 - DNA, 201 bp, Homo sapiens; identical to SEQ ID NO: 8845

SEQ ID NO: 8918 - DNA, 201 bp, Homo sapiens; identical to SEQ ID NO: 8846

SEQ ID NO: 8919 - DNA, 201 bp, Homo sapiens; identical to SEQ ID NO: 8847

SEQ ID NO: 8920 - DNA, 201 bp, Homo sapiens; identical to SEQ ID NO: 8848

SEQ ID NO: 8921 - DNA, 201 bp, Homo sapiens; identical to SEQ ID NO: 8849

SEQ ID NO: 8922 - DNA, 201 bp, Homo sapiens; identical to SEQ ID NO: 8850

SEQ ID NO: 8923 - DNA, 201 bp, Homo sapiens; identical to SEQ ID NO: 8851

SEQ ID NO: 8924 - DNA, 201 bp, Homo sapiens; identical to SEQ ID NO: 8852

SEQ ID NO: 8925 - DNA, 201 bp, Homo sapiens; identical to SEQ ID NO: 8853

SEQ ID NO: 8926 - DNA, 201 bp, Homo sapiens; identical to SEQ ID NO: 8854

SEQ ID NO: 8927 - DNA, 201 bp, Homo sapiens; identical to SEQ ID NO: 8855

SEQ ID NO: 8928 - DNA, 201 bp, Homo sapiens; identical to SEQ ID NO: 8856

SEQ ID NO: 8929 - DNA, 201 bp, Homo sapiens; identical to SEQ ID NO: 8857

SEQ ID NO: 8930 - DNA, 201 bp, Homo sapiens; identical to SEQ ID NO: 8859

SEQ ID NO: 8931 - DNA, 201 bp, Homo sapiens; identical to SEQ ID NO: 8860

SEQ ID NO: 8932 - DNA, 201 bp, Homo sapiens; identical to SEQ ID NO: 8861

SEQ ID NO: 8933 - DNA, 201 bp, Homo sapiens; identical to SEQ ID NO: 8862

SEQ ID NO: 8934 - DNA, 201 bp, Homo sapiens; identical to SEQ ID NO: 8863

SEQ ID NO: 8935 - DNA, 201 bp, Homo sapiens; identical to SEQ ID NO: 8864

SEQ ID NO: 8936 - DNA, 201 bp, Homo sapiens; identical to SEQ ID NO: 8865

SEQ ID NO: 8937 - DNA, 201 bp, Homo sapiens; identical to SEQ ID NO: 8866

SEQ ID NO: 8938 - DNA, 201 bp, Homo sapiens; identical to SEQ ID NO: 8867

SEQ ID NO: 8939 - DNA, 201 bp, Homo sapiens; identical to SEQ ID NO: 8868

SEQ ID NO: 8940 - DNA, 201 bp, Homo sapiens; identical to SEQ ID NO: 8869

SEQ ID NO: 8941 - DNA, 201 bp, Homo sapiens; identical to SEQ ID NO: 8870

SEQ ID NO: 8942 - DNA, 201 bp, Homo sapiens; identical to SEQ ID NO: 8872

SEQ ID NO: 8943 - DNA, 201 bp, Homo sapiens; identical to SEQ ID NO: 8871

SEQ ID NO: 8944 - DNA, 201 bp, Homo sapiens; identical to SEQ ID NO: 8873

SEQ ID NO: 8945 - DNA, 201 bp, Homo sapiens; identical to SEQ ID NO: 8874

SEQ ID NO: 8946 - DNA, 201 bp, Homo sapiens; identical to SEQ ID NO: 8875

SEQ ID NO: 8947 - DNA, 201 bp, Homo sapiens
gtcctgagctatcgagtaaagcagcttgtcttccccaacaaggagacgatgaagaaggatggtgcttcatcctgtttaggaaagtctttgggttcggaggrttccagaaacatgaaggagaagttggaggacatggagagtgtcctcaaggacctgacagaggagaagagaaaagatgtgctaaactccctcgctaagtgc

SEQ ID NO: 8948 - DNA, 201 bp, Homo sapiens
gaaggagaagttggaggacatggagagtgtcctcaaggacctgacagaggagaagagaaaagatgtgctaaactccctcgctaagtgcctcggcaaggagratattcggcaggatctagagcaaagagtatctgaggtcctgatttccggggagctacacatggaggacccagacaagcctctcctaagcagcctttttaa

SEQ ID NO: 8949 - DNA, 201 bp, Homo sapiens
gaccctgaggcacgaattctctgtgcgctgtatgttgttgtctctatcctgctggagctggctgaggggcctacctctgtctcttcctaactacaaaagcyctttctccccacaagcctctgggttttccctttaccagtctgtcctcactgccatcgccactaccatcctgtcaccagtgggacctctttaaaacaagca

SEQ ID NO: 8950 - DNA, 201 bp, Homo sapiens
gacccagacaagcctctcctaagcagcctttttaatgctgctggggtcttggtagaagcgcgtgcaaaagccattctggacttcctggatgccctgctagsgctgtctgaagagcagcagtttgtggctgaggccctggagaaggggacccttcctctgttgaaggaccaggtgaaatctgtcatggagcagaactgggat

SEQ ID NO: 8951 - DNA, 201 bp, Homo sapiens
aaactccctcgctaagtgcctcggcaaggaggatattcggcaggatctagagcaaagagtatctgaggtcctgatttccggggagctacacatggaggacycagacaagcctctcctaagcagcctttttaatgctgctggggtcttggtagaagcgcgtgcaaaagccattctggacttcctggatgccctgctagagct

SEQ ID NO: 8952 - DNA, 201 bp, Homo sapiens
ggagaagagaaaagatgtgctaaactccctcgctaagtgcctcggcaaggaggatattcggcaggatctagagcaaagagtatctgaggtcctgatttccrgggagctacacatggaggacccagacaagcctctcctaagcagcctttttaatgctgctggggtcttggtagaagcgcgtgcaaaagccattctggactt

SEQ ID NO: 8953 - DNA, 201 bp, Homo sapiens
agtatctgaggtcctgatttccggggagctacacatggaggacccagacaagcctctcctaagcagcctttttaatgctgctggggtcttggtagaagcgygtgcaaaagccattctggacttcctggatgccctgctagagctgtctgaagagcagcagtttgtggctgaggccctggagaaggggacccttcctctgtt

SEQ ID NO: 8954 - DNA, 201 bp, Homo sapiens
agggaagtgaccatccccccaaatcgggtcctgagctatcgagtaaagcagcttgtcttccccaacaaggagacgatgagaaagtctttgggttcggaggrttccagaaacatgaaggagaagttggaggacatggagagtgtcctcaaggacctgacagaggagaagagaaaagatgtgctaaactccctcgctaagtgc

SEQ ID NO: 8955 - DNA, 201 bp, Homo sapiens; identical to SEQ ID NO: 8948

SEQ ID NO: 8956 - DNA, 201 bp, Homo sapiens; identical to SEQ ID NO: 8949

SEQ ID NO: 8957 - DNA, 201 bp, Homo sapiens; identical to SEQ ID NO: 8950

SEQ ID NO: 8958 - DNA, 201 bp, Homo sapiens; identical to SEQ ID NO: 8951

SEQ ID NO: 8959 - DNA, 201 bp, Homo sapiens; identical to SEQ ID NO: 8952

SEQ ID NO: 8960 - DNA, 201 bp, Homo sapiens; identical to SEQ ID NO: 8953

SEQ ID NO: 8961 - DNA, 201 bp, Homo sapiens
cgagtaaagcagcttgtcttccccaacaaggagacgatgaatattcatttcaggggcaaaacaaaatcctttccagaaggaaagtctttgggttcggaggrttccagaaacatgaaggagaagttggaggacatggagagtgtcctcaaggacctgacagaggagaagagaaaagatgtgctaaactccctcgctaagtgc

SEQ ID NO: 8962 - DNA, 201 bp, Homo sapiens; identical to SEQ ID NO: 8948

SEQ ID NO: 8963 - DNA, 201 bp, Homo sapiens; identical to SEQ ID NO: 8949

SEQ ID NO: 8964 - DNA, 201 bp, Homo sapiens
agctataaacacaagggccaaagggaagtgaccatccccccaaatcgggtcctgagctatcgagtaaagcagcttgtcttccccaacaaggagacgatgartattcatttcaggggcaaaacaaaatcctttccagaaggaaagtctttgggttcggaggattccagaaacatgaaggagaagttggaggacatggagagt

SEQ ID NO: 8965 - DNA, 201 bp, Homo sapiens; identical to SEQ ID NO: 8950

SEQ ID NO: 8966 - DNA, 201 bp, Homo sapiens; identical to SEQ ID NO: 8951

SEQ ID NO: 8967 - DNA, 201 bp, Homo sapiens; identical to SEQ ID NO: 8952

SEQ ID NO: 8968 - DNA, 201 bp, Homo sapiens; identical to SEQ ID NO: 8953

SEQ ID NO: 8969 - DNA, 201 bp, Homo sapiens
ggggagctcaggcaaaagaggtttccaggatgcagattaggtcatgcaggcctttaccggcattgatgtggctcatgtttcaggcagacttggggtccttmaggtggcaagtcctttatggagagaaaacttgacattcagatgattgtttttaaatgttttacttttggtacagttgatagacatcataaacgatatcaa

SEQ ID NO: 8970 - DNA, 159 bp, Homo sapiens
gcgcggcggcgcagtgaacagtctccttccacaaaaccatggcgtcgctcaaatgtagyaccgtcgtctgcgtgatctgcttggagaagcccaaataccgctgtccagcctgccgcgtgccctactgctcggtagtctgcttccggaagcacaaagaac

SEQ ID NO: 8971 - DNA, 201 bp, Homo sapiens
ttgacattcagatgattgtttttaaatgttttacttttggtacagttgatagacatcataaacgatatcaagcttacacttcatatggagttaaacttggkcagtgttaataaaatcaaaacgtgattctactgtacattgcattattcataatttaattgtttgaaattacattaaataaatcaactaattaaatactaa

SEQ ID NO: 8972 - DNA, 116 bp, Homo sapiens
gcgcggcggcgcagtraacagtctccttccacaaaaccatggcgtcgctcaaatgtagcaccgtcgtctgcgtgatctgcttggagaagcccaaataccgctgtccagcctgccgc

SEQ ID NO: 8973 - DNA, 201 bp, Homo sapiens
  misc_feature (1)...(201): n = A,T,C or G, or insertion/deletion polymorphism (see Tables 1-2)
ttttccagaaagctggttgtgggaagttcatcttgttcccagaagaaaacagttgcagtttgccctacctgattctctaaccacctgggaaattcaaggcnttggcatttcaaacactggtatatgtgttgctgatactgtcaaggcaaaggtgttcaaagatgtcttcctggaaatgaatataccatattctgttgtacg

SEQ ID NO: 8974 - DNA, 201 bp, Homo sapiens
acaaactgaatttggttgctactcctcttttcctgaagcctgggattccatatcccatcaaggtgcaggttaaagattcgcttgaccagttggtaggaggrgtcccagtaacactgaatgcacaaacaattgatgtaaaccaagagacatctgacttggatccaagcaaaagtgtaacacgtgttgatgatggagtagctt

SEQ ID NO: 8975 - DNA, 201 bp, Homo sapiens
gagcagaggtatggaggtggcttttattcaacccaggacacaatcaatgccattgagggcctgacggaatattcactcctggttaaacaactccgcttgartatggacatcgatgtttcttacaagcataaaggtgccttacataattataaaatgacagacaagaatttccttgggaggccagtagaggtgcttctcaat

SEQ ID NO: 8976 - DNA, 201 bp, Homo sapiens
  misc_feature (1)...(201): n = A,T,C or G, or insertion/deletion polymorphism (see Tables 1-2)
actttggcacgagggagaaattttcagatgcatcttatcaaagtataaacattccagtaacacagaacatggttccttcatcccgacttctggtctattanatcgtcacaggagaacagacagcagaattagtgtctgattcagtctggttaaatattgaagaaaaatgtggcaaccagctccaggttcatctgtctcctg

SEQ ID NO: 8977 - DNA, 201 bp, Homo sapiens
tgggagaacatctgaatattattgttacccccaaaagcccatatattgacaaaataactcactataattacttgattttatccaagggcaaaattatccaytttggcacgagggagaaattttcagatgcatcttatcaaagtataaacattccagtaacacagaacatggttccttcatcccgacttctggtctattaca

SEQ ID NO: 8978 - DNA, 143 bp, Homo sapiens
ttatatccgtggtttcctgctacctccaaccatgggccttttkggaatactttgttttttaatcttcctggggaaaacctggggacaggagcaaacatatgtcatttcagcaccaaaaatattccgtgttggagcatctgaaa

SEQ ID NO: 8979 - DNA, 201 bp, Homo sapiens
ttgagtgtaaaaggactgcttgtaggtgagatcttgtctgcagttctaagtcaggaaggcatcaatatcctaacccacctccccaaagggagtgcagaggyggagctgatgagcgttgtcccagtattctatgtttttcactacctggaaacaggaaatcattggaacatttttcattctgacccattaattgaaaagcag

SEQ ID NO: 8980 - DNA, 201 bp, Homo sapiens
cccactacagaggctacggaaactctgattacaaacgcatagtagcatgtgccagctacaagcccagcagggaagaatcatcatctggatcctctcatgcrgtgatggacatctccttgcctactggaatcagtgcaaatgaagaagacttaaaagcccttgtggaaggggtggatcaactattcactgattaccaaatca

SEQ ID NO: 8981 - DNA, 201 bp, Homo sapiens
tggagtagcttcctttgtgcttaatctcccatctggagtgacggtgctggagtttaatgtcaaaactgatgctccagatcttccagaagaaaatcaggccrgggaaggttaccgagcaatagcatactcatctctcagccaaagttacctttatattgattggactgataaccataaggctttgctagtgggagaacatct

SEQ ID NO: 8982 - DNA, 201 bp, Homo sapiens
acttaaaagatgatcaaaaagaaatgatgcaaacagcaatgcaaaacacaatgttgataaatggaattgctcaagtcacatttgattctgaaacagcagtsaaagaactgtcatactacagtttagaagatttaaacaacaagtacctttatattgctgtaacagtcatagagtctacaggtggattttctgaagaggcag

SEQ ID NO: 8983 - DNA, 201 bp, Homo sapiens
gccaaagttacctttatattgattggactgataaccataaggctttgctagtgggagaacatctgaatattattgttacccccaaaagcccatatattgayaaaataactcactataattacttgattttatccaagggcaaaattatccactttggcacgagggagaaattttcagatgcatcttatcaaagtataaaca

SEQ ID NO: 8984 - DNA, 201 bp, Homo sapiens
caagtacctttatattgctgtaacagtcatagagtctacaggtggattttctgaagaggcagaaatacctggcatcaaatatgtcctctctccctacaaamtgaatttggttgctactcctcttttcctgaagcctgggattccatatcccatcaaggtgcaggttaaagattcgcttgaccagttggtaggaggagtccc

SEQ ID NO: 8985 - DNA, 201 bp, Homo sapiens
acactgaagcatttgatgcaacaatctctattaaaagttatcctgataaaaaatttagttactcctcaggccatgttcatttatcctcagagaataaattycaaaactctgcaatcttaacaatacaaccaaaacaattgcctggaggacaaaacccagtttcttatgtgtatttggaagttgtatcaaagcatttttcaa

SEQ ID NO: 8986 - DNA, 201 bp, Homo sapiens
caatagcatactcatctctcagccaaagttacctttatattgattggactgataaccataaggctttgctagtgggagaacatctgaatattattgttacycccaaaagcccatatattgacaaaataactcactataattacttgattttatccaagggcaaaattatccactttggcacgagggagaaattttcagatg

SEQ ID NO: 8987 - DNA, 201 bp, Homo sapiens
gaatttccttgggaggccagtagaggtgcttctcaatgatgacctcattgtcagtacaggatttggcagtggcttggctacagtacatgtaacaactgtakttcacaaaaccagtacctctgaggaagtttgcagcttttatttgaaaatcgatactcaggatattgaagcatcccactacagaggctacggaaactctga

SEQ ID NO: 8988 - DNA, 201 bp, Homo sapiens
  misc_feature (1)...(201): n = A,T,C or G, or insertion/deletion polymorphism (see Tables 1-2)
tctattacatcgtcacaggagaacagacagcagaattagtgtctgattcagtctggttaaatattgaagaaaaatgtggcaaccagctccaggttcatctntctcctgatgcagatgcatattctccaggccaaactgtgtctcttaatatggcaactggaatggattcctgggtggcattagcagcagtggacagtgctg

SEQ ID NO: 8989 - DNA, 201 bp, Homo sapiens
ccctgtggaagcgtccactaataaagagtcaagaaaaagcttggcttcattcccaacctacgttgaagttccgggaccctgcgaccccgaagacttgatcratggaatcatttttgccgccaattaccttggctccactcagctgctctcagacaaaactccttccaaaaacgtgcgcatgatgcaggcccaggaagccgt

SEQ ID NO: 8990 - DNA, 201 bp, Homo sapiens
gcacttccactcgctggagcacgaggaagccatgaatgcggcctactcaggctacgtctacacgcaccggctcttccaccgcggtgaggacgagccctackccgagccctatgccgactacggcggcctccaggagcacgtgtacgaggagataggggacgcgcccgagctggacgcacgcgacggcctgcggctctacga

SEQ ID NO: 8991 - DNA, 201 bp, Homo sapiens
catttggttttacacaggaagagaagaatccacaaggacctctttactctctccgatttgcttttttttttttttttttttcaataccagggaagtttcgyatgcactcccttgaggatggagagcagccagcacccacctggtactgacccaggaccatcctggagggctttctgggtgtgtccagggggtgggctgtca

SEQ ID NO: 8992 - DNA, 201 bp, Homo sapiens
agcatttggttttacacaggaagagaagaatccacaaggacctctttactctctccgatttgcttttttttttttttttttttcaataccagggaagtttygtatgcactcccttgaggatggagagcagccagcacccacctggtactgacccaggaccatcctggagggctttctgggtgtgtccagggggtgggctgt

SEQ ID NO: 8993 - DNA, 201 bp, Homo sapiens
ctcagacaaaactccttccaaaaacgtgcgcatgatgcaggcccaggaagccgtaagcaggatcaagatggcccagaaattagccaaaagcaggaagaagrctcctgaaggcgaatctcagccaatgactgaagtggatctcttcatttctacccagagaatcaaagtgctgaacgccgacacacaggagacaatgatgga

SEQ ID NO: 8994 - DNA, 201 bp, Homo sapiens
ctttcccctctcgcgcccagcatttggttttacacaggaagagaagaatccacaaggacctctttactctctccgatttgcttttttttttttttttttttcaataccagggaagtttcgtatgcactcccttgaggatggagagcagccagcacccacctggtactgacccaggaccatcctggagggctttctgggtgt

SEQ ID NO: 8995 - DNA, 201 bp, Homo sapiens; identical to SEQ ID NO: 8990

SEQ ID NO: 8996 - DNA, 201 bp, Homo sapiens
tgaatttttttctcttatctcagtcagttcaagaaaaagcttggcttcattcccaacctacgttgaagttccgggaccctgcgaccccgaagacttgatcratggaatcatttttgccgccaattaccttggctccactcagctgctctcagacaaaactccttccaaaaacgtgcgcatgatgcaggcccaggaagccgt

SEQ ID NO: 8997 - DNA, 201 bp, Homo sapiens; identical to SEQ ID NO: 8991

SEQ ID NO: 8998 - DNA, 201 bp, Homo sapiens; identical to SEQ ID NO: 8992

SEQ ID NO: 8999 - DNA, 101 bp, Homo sapiens
acctgccctctctgcgctgaggcccagcccctccagcaccactttggcttaaagcatcctcctcctggactcccctccctgccgaacacacatcccaggar

SEQ ID NO: 9000 - DNA, 201 bp, Homo sapiens; identical to SEQ ID NO: 8994

SEQ ID NO: 9001 - DNA, 201 bp, Homo sapiens
cacccatccgctccgtgacctacaccctggcccagctcccctgcgcctccatggctctgcagatcctctgggaagcggcccgccacctgtgaccagcagckgatgcctccttggccaccagaccatgggccaagagccgccgtggctatacctggggacttgatgttccttccagattgtggtgggccctgagtcctggtt

SEQ ID NO: 9002 - DNA, 201 bp, Homo sapiens
aagctggccgtggcctcccgggtgacgtcactgcggtcattgcctgatgagctcaggcagaggcgcctggggacggggctgctcctctgtcgagctgatcrcacccacagttgagctgcgctggccagagatgcctgcccacagcctggtgatgagcagcccggccctcccggccttcctgctctgcagcacgctgctggt

SEQ ID NO: 9003 - DNA, 201 bp, Homo sapiens
agctcaggcagaggcgcctggggacggggctgctcctctgtcgagctgatcacacccacagttgagctgcgctggccagagatgcctgcccacagcctggwgatgagcagcccggccctcccggccttcctgctctgcagcacgctgctggtcatcaagatgtacgtggtggccatcatcacgggccaagtgaggctgcgg

SEQ ID NO: 9004 - DNA, 201 bp, Homo sapiens
atggctctgcagatcctctgggaagcggcccgccacctgtgaccagcagctgatgcctccttggccaccagaccatgggccaagagccgccgtggctatayctggggacttgatgttccttccagattgtggtgggccctgagtcctggtttcctggcagcctgctgcgcgtgtgggtctctgggcacagtgggcctgtgt

SEQ ID NO: 9005 - DNA, 201 bp, Homo sapiens
ggaagctgcgggcacccatccgctccgtgacctacaccctggcccagctcccctgcgcctccatggctctgcagatcctctgggaagcggcccgccacctktgaccagcagctgatgcctccttggccaccagaccatgggccaagagccgccgtggctatacctggggacttgatgttccttccagattgtggtgggccc

SEQ ID NO: 9006 - DNA, 201 bp, Homo sapiens
ggggctgctcctctgtcgagctgatcacacccacagttgagctgcgctggccagagatgcctgcccacagcctggtgatgagcagcccggccctcccggcyttcctgctctgcagcacgctgctggtcatcaagatgtacgtggtggccatcatcacgggccaagtgaggctgcggaagaaggcctttgccaaccccgagg

SEQ ID NO: 9007 - DNA, 201 bp, Homo sapiens
acgtggtggccatcatcacgggccaagtgaggctgcggaagaaggcctttgccaaccccgaggatgccctgagacacggaggcccccagtattgcaggagygaccccgacgtggaacgctgcctcagggcccaccggaacgacatggagaccatctaccccttccttttcctgggcttcgtctactcctttctgggtccta

SEQ ID NO: 9008 - DNA, 133 bp, Homo sapiens
gattgtggtgggccctgagtcctggtttcctggcagcctgctgcgcgtgtgggtctctgggcacagtgggcctgtgtgtgtgcccgtgtgtgtgtatgtgwgtgttgttttctcctagacccgtgacctgaga

SEQ ID NO: 9009 - DNA, 201 bp, Homo sapiens; identical to SEQ ID NO: 9001

SEQ ID NO: 9010 - DNA, 201 bp, Homo sapiens; identical to SEQ ID NO: 9002

SEQ ID NO: 9011 - DNA, 201 bp, Homo sapiens; identical to SEQ ID NO: 9003

SEQ ID NO: 9012 - DNA, 201 bp, Homo sapiens; identical to SEQ ID NO: 9004

SEQ ID NO: 9013 - DNA, 201 bp, Homo sapiens; identical to SEQ ID NO: 9006

SEQ ID NO: 9014 - DNA, 201 bp, Homo sapiens; identical to SEQ ID NO: 9007

SEQ ID NO: 9015 - DNA, 201 bp, Homo sapiens
ggaagctgcgggcacccatccgctccgtgacctacaccctggcccagctcccctgcgcctccatggctctgcagatcctctgggaagcggcccgccacctwtgaccagcagctgatgcctccttggccaccagaccatgggccaagagccgccgtggctatacctggggacttgatgttccttccagattgtggtgggccc

SEQ ID NO: 9016 - DNA, 201 bp, Homo sapiens
atgtctttgctgcagtcttctctctggctcaggtgtgggtgggaggggcccacaggaagctcagccttctcctcccaaggtttgagtccctccaaagggcwgtgggtggaggaccgggagctttgggtgaccagccactcaaaggaactttctggtcccttcagtatcttcaaggtttggaaactgcaaatgtccccttga

SEQ ID NO: 9017 - DNA, 201 bp, Homo sapiens
acagagcatcaaaaacatcactccctctccctccctaacagtgaaaagagagaagggagactctatttaagattcccaaacctaatgatcatctgaatccygggctaagaatgcagacttttcagactgaccccagaaattctggcccagccaatctagaggcaagcctggccatctgtatttttttttttccaagacaga

SEQ ID NO: 9018 - DNA, 201 bp, Homo sapiens
ggtgggccctgagtcctggtttcctggcagcctgctgcgcgtgtgggtctctgggcacagtgggcctgtgtgtgtgcccgtgtgtgtgtatgtgtgtgtgkatgtttcttagccccttggattcctgcacgaagtggctgatgggaaccatttcaagacagattgtgaagattgatagaaaatccttcagctaaagtaaca

SEQ ID NO: 9019 - DNA, 201 bp, Homo sapiens
gattgtggtgggccctgagtcctggtttcctggcagcctgctgcgcgtgtgggtctctgggcacagtgggcctgtgtgtgtgcccgtgtgtgtgtatgtgwgtgtgtatgtttcttagccccttggattcctgcacgaagtggctgatgggaaccatttcaagacagattgtgaagattgatagaaaatccttcagctaaa

SEQ ID NO: 9020 - DNA, 201 bp, Homo sapiens; identical to SEQ ID NO: 9001

SEQ ID NO: 9021 - DNA, 201 bp, Homo sapiens; identical to SEQ ID NO: 9002

SEQ ID NO: 9022 - DNA, 201 bp, Homo sapiens
gtgctgggatgacaggcatgaatcactgtgctcagccaccatctggagttttaaaaggctcccatgtgagtccctgtgatggccaggccaggggacccctrccagttctctgtggaagcaaggctggggtcttgggttcctgtatggtggaagctgggtgagccaaggacagggctggctcctctgcccccgctgacgctt

SEQ ID NO: 9023 - DNA, 201 bp, Homo sapiens
gccaaggacagggctggctcctctgcccccgctgacgcttcccttgccgttggctttggatgtctttgctgcagtcttctctctggctcaggtgtgggtgkgaggggcccacaggaagctcagccttctcctcccaaggtttgagtccctccaaagggcagtgggtggaggaccgggagctttgggtgaccagccactcaa

SEQ ID NO: 9024 - DNA, 201 bp, Homo sapiens; identical to SEQ ID NO: 9003

SEQ ID NO: 9025 - DNA, 201 bp, Homo sapiens; identical to SEQ ID NO: 9004

SEQ ID NO: 9026 - DNA, 201 bp, Homo sapiens
acgtggtggccatcatcacgggccaagtgaggctgcggaagaaggcctttgccaaccccgaggatgccctgagacacggaggcccccagtattgcaggagygaccccgacgtggaacgctgcctcaggcaggcccaccggaacgacatggagaccatctaccccttccttttcctgggcttcgtctactcctttctgggtc

SEQ ID NO: 9027 - DNA, 201 bp, Homo sapiens; identical to SEQ ID NO: 9006

SEQ ID NO: 9028 - DNA, 201 bp, Homo sapiens; identical to SEQ ID NO: 9016

SEQ ID NO: 9029 - DNA, 201 bp, Homo sapiens; identical to SEQ ID NO: 9017

SEQ ID NO: 9030 - DNA, 201 bp, Homo sapiens; identical to SEQ ID NO: 9018

SEQ ID NO: 9031 - DNA, 201 bp, Homo sapiens; identical to SEQ ID NO: 9019

SEQ ID NO: 9032 - DNA, 201 bp, Homo sapiens; identical to SEQ ID NO: 9001

SEQ ID NO: 9033 - DNA, 124 bp, Homo sapiens
gctgctcctctgtcgagctgatcrcacccacagttgagctgcgctggccagagatgcctgcccacagcctggtgatgagcagcccggccctcccggccttcctgctctgcagcacgctgctggt

SEQ ID NO: 9034 - DNA, 201 bp, Homo sapiens; identical to SEQ ID NO: 9022

SEQ ID NO: 9035 - DNA, 173 bp, Homo sapiens
gctgctcctctgtcgagctgatcacacccacagttgagctgcgctggccagagatgcctgcccacagcctggwgatgagcagcccggccctcccggccttcctgctctgcagcacgctgctggtcatcaagatgtacgtggtggccatcatcacgggccaagtgaggctgcgg

SEQ ID NO: 9036 - DNA, 201 bp, Homo sapiens; identical to SEQ ID NO: 9023

SEQ ID NO: 9037 - DNA, 201 bp, Homo sapiens; identical to SEQ ID NO: 9004

SEQ ID NO: 9038 - DNA, 198 bp, Homo sapiens
gctgctcctctgtcgagctgatcacacccacagttgagctgcgctggccagagatgcctgcccacagcctggtgatgagcagcccggccctcccggcyttcctgctctgcagcacgctgctggtcatcaagatgtacgtggtggccatcatcacgggccaagtgaggctgcggaagaaggcctttgccaaccccgagg

SEQ ID NO: 9039 - DNA, 201 bp, Homo sapiens; identical to SEQ ID NO: 9007

SEQ ID NO: 9040 - DNA, 201 bp, Homo sapiens; identical to SEQ ID NO: 9016

SEQ ID NO: 9041 - DNA, 201 bp, Homo sapiens; identical to SEQ ID NO: 9017

SEQ ID NO: 9042 - DNA, 201 bp, Homo sapiens; identical to SEQ ID NO: 9018

SEQ ID NO: 9043 - DNA, 201 bp, Homo sapiens; identical to SEQ ID NO: 9019

SEQ ID NO: 9044 - DNA, 201 bp, Homo sapiens; identical to SEQ ID NO: 9001

SEQ ID NO: 9045 - DNA, 201 bp, Homo sapiens; identical to SEQ ID NO: 9002

SEQ ID NO: 9046 - DNA, 201 bp, Homo sapiens; identical to SEQ ID NO: 9022

SEQ ID NO: 9047 - DNA, 201 bp, Homo sapiens; identical to SEQ ID NO: 9003

SEQ ID NO: 9048 - DNA, 201 bp, Homo sapiens; identical to SEQ ID NO: 9023

SEQ ID NO: 9049 - DNA, 201 bp, Homo sapiens; identical to SEQ ID NO: 9004

SEQ ID NO: 9050 - DNA, 201 bp, Homo sapiens; identical to SEQ ID NO: 9006

SEQ ID NO: 9051 - DNA, 201 bp, Homo sapiens; identical to SEQ ID NO: 9007

SEQ ID NO: 9052 - DNA, 201 bp, Homo sapiens; identical to SEQ ID NO: 9005

SEQ ID NO: 9053 - DNA, 201 bp, Homo sapiens; identical to SEQ ID NO: 9016

SEQ ID NO: 9054 - DNA, 129 bp, Homo sapiens
ccagcacctaaaaaaaaaaaaaaaaaaawgatgagcagcccggccctcccggccttcctgctctgcagcacgctgctggtcatcaagatgtacgtggtggccatcatcacgggccaagtgaggctgcgg

SEQ ID NO: 9055 - DNA, 201 bp, Homo sapiens; identical to SEQ ID NO: 9007

SEQ ID NO: 9056 - DNA, 201 bp, Homo sapiens; identical to SEQ ID NO: 9004

SEQ ID NO: 9057 - DNA, 201 bp, Homo sapiens; identical to SEQ ID NO: 9001

SEQ ID NO: 9058 - DNA, 201 bp, Homo sapiens; identical to SEQ ID NO: 9017

SEQ ID NO: 9059 - DNA, 201 bp, Homo sapiens; identical to SEQ ID NO: 9022

SEQ ID NO: 9060 - DNA, 201 bp, Homo sapiens; identical to SEQ ID NO: 9023

SEQ ID NO: 9061 - DNA, 104 bp, Homo sapiens
aaayttcctgctctgcagcacgctgctggtcatcaagatgtacgtggtggccatcatcacgggccaagtgaggctgcggaagaaggcctttgccaaccccgagg

SEQ ID NO: 9062 - DNA, 201 bp, Homo sapiens; identical to SEQ ID NO: 9001

SEQ ID NO: 9063 - DNA, 201 bp, Homo sapiens
ttgatgttccttccagattgtggtgggccctgagtcctggtttcctggcagcctgctgcgcgtgtgggtctctgggcacagtgggcctgtgtgtgtgcccttgtgtgtgtatgtgtgtgtgtatgtttcttagccccttggattcctgcacgaagtggctgatgggaaccatttcaagacagattgtgaagattgatagaa

SEQ ID NO: 9064 - DNA, 201 bp, Homo sapiens
gttccttccagattgtggtgggccctgagtcctggtttcctggcagcctgctgcgcgtgtgggtctctgggcacagtgggcctgtgtgtgtgcccgtgtgagtgtatgtgtgtgtgtatgtttcttagccccttggattcctgcacgaagtggctgatgggaaccatttcaagacagattgtgaagattgatagaaaatcc

SEQ ID NO: 9065 - DNA, 201 bp, Homo sapiens
gctttgctgaaagccttgccacagaaaccatgacagcagctgtcacaaatgttgggcatgctgttagcagttcaaaagaaatagaagactttcagtcaacygagtctgtcagtagccagcagatgaacctcagtattggtgatgacagcactggtagctggtccaatttaagttttgaagatgaacaccaagatgaaagca

SEQ ID NO: 9066 - DNA, 201 bp, Homo sapiens
taccaatgctttgtaccacttagccatcaaattgacatcatctgttttgcagatggcatttgatgagctgagaaggcagcgtgcattttcactaaaagaaygtgccattagtggcctggctaactttttggtgagtgaagctttatcaaatgccttaaaagatttacagtatgtaaagaagcagatattcacaaacacagt

SEQ ID NO: 9067 - DNA, 201 bp, Homo sapiens
taaagaactccacaattgcactggaaattcatctcagcactttttcagacagggttctctcgccagtagtaagccagcttctaatccaaaatttagcagcygctatcagaaatctaggatttttcatctcagtgtccctcagattcatgttaatcttgataagaaggcagtgcttgctgagaagatagttgctgaagccat

SEQ ID NO: 9068 - DNA, 201 bp, Homo sapiens
tgtgaccttaaagaactccacaattgcactggaaattcatctcagcactttttcagacagggttctctcgccagtagtaagccagcttctaatccaaaatktagcagccgctatcagaaatctaggatttttcatctcagtgtccctcagattcatgttaatcttgataagaaggcagtgcttgctgagaagatagttgct

SEQ ID NO: 9069 - DNA, 201 bp, Homo sapiens
cagtcacaacatcaatttcagagccttggacccaaaggagtttctataggtcatctaatgcttcagataaagatagtgatttacagaaaacatttttttcrtcttctcctgcctactcatctgaatcagaatgttcaagtccaagtcctgttattttcttggatgaagagggatatcaaaaaagcttaaaagcaaaacttg

SEQ ID NO: 9070 - DNA, 201 bp, Homo sapiens
aaagaaatgaaggttacttttgtaaaaatcaaacttgtgaaaggaccctggatccatatagaaatgaggtctcccaactgtatagtttttcaacctctctsgttcacagcataacaaaagatgctaaggaagagttgacagcctctctagttggcctaccaaaatccttaacagattcttgcttgtttgaaaaatctggat

SEQ ID NO: 9071 - DNA, 201 bp, Homo sapiens
cctgcaattattagcaacttttctgcagcagtggtgcatacgatagtaaatgaaactttagagtcaatgacatcattggaagttacaaaaatggttgatgracgtacagattatttaactaaatctttaaaggagaaaacccctccattttcccactgtgatcaggcagtgctgcaatgcagtgaagctagtagcaataag

SEQ ID NO: 9072 - DNA, 201 bp, Homo sapiens
agatacagaaatacagcaagccttaatataaagtttcctaaagtttcttcaagtattttttaaggtggagaaatgcaggaattgtataaccagaattgttyctgcctttagcttttcagaacttgagatgtggcagcactggactgggtttttttaaatgttaggactaggaatgtttgctcttgttaattatgaattaat

SEQ ID NO: 9073 - DNA, 201 bp, Homo sapiens
gcagcagttttcatcatctaagtgaaagtaatggtaacagcagtagctggagcagtcttggtttagaaggagatttgtatgaggacaatttatcctttccracatcagacagtgatggaccagatgataaagatgaagagcatgaggacgaagtagaaggtttggggcaagatggaaagacactgctaattacgaatattg

SEQ ID NO: 9074 - DNA, 201 bp, Homo sapiens
aatctaaaaataaatccttaatgattaaagatagcattcaaaaatttgcagcagatcttgtggaaaaaagttttggcagtgcatttaaagacttacagaamggagtctcttcatgtaccaatgctttgtaccacttagccatcaaattgacatcatctgttttgcagatggcatttgatgagctgagaaggcagcgtgcat

SEQ ID NO: 9075 - DNA, 201 bp, Homo sapiens
tgaagaatataaataaaccattagatataagcagtgatcctctaaatcagagtcatccttctggaatgctttgtgtcatgagagtgtcacctacatcaccragacttaggattgattttatctttagtctcctaagtaaatatgctactggtataaggtacaccttggacacattcttgcatcagaagcaccaacttgaga

SEQ ID NO: 9076 - DNA, 201 bp, Homo sapiens
ctggaatgctttgtgtcatgagagtgtcacctacatcaccaagacttaggattgattttatctttagtctcctaagtaaatatgctactggtataaggtayaccttggacacattcttgcatcagaagcaccaacttgagaccactgatgaagatgatgatgatactaaccagtctgtgtcatccatagaggatgactttg

SEQ ID NO: 9077 - DNA, 201 bp, Homo sapiens
acatgttgaaattttaaaaattaatgttaatatggaaatgcatttagagaagcccagtagtttttattgttggatttttgaaaaaacctctaccaagaatrtggtgttttttttgtttgtttgtttgtttgttttagaaaaattgggatttccccccaccccgccccacccagataaactatatctacactgtctcgtcaa

SEQ ID NO: 9078 - DNA, 201 bp, Homo sapiens
gtaagccagcttctaatccaaaatttagcagccgctatcagaaatctaggatttttcatctcagtgtccctcagattcatgttaatcttgataagaaggcrgtgcttgctgagaagatagttgctgaagccattgaaaaagctgagcgagagctgagcagtaccagcctggcagccgacagtgggatcggacaggagggtg

SEQ ID NO: 9079 - DNA, 201 bp, Homo sapiens
aatcaggattacaggaagcagctaagacaaccaaagtgcagtgcaactcaagaatgttccctgtgccaagttcacaagtgaaaacaaacaaggaactgttmatgttttcaaacaaagagcaccaccaagaagcagacaaaaagagacaaagtaaaagaaatgaaggttacttttgtaaaaatcaaacttgtgaaaggaccc

SEQ ID NO: 9080 - DNA, 201 bp, Homo sapiens
caactcctctagtaccatcccgggctagttctgaatgggatatcaagaagttaactaaaaagctcaagggagaattagccaaagagtttgcacctgctacmccaccttctactccacacaactcatctgttggtagtttgtctgagaatgaacaaaatactatagaaaaagaagagttcatgttgaaactcatgcgatctc

SEQ ID NO: 9081 - DNA, 201 bp, Homo sapiens
gcaattattagcaacttttctgcagcagtggtgcatacgatagtaaatgaaactttagagtcaatgacatcattggaagttacaaaaatggttgatgaacrtacagattatttaactaaatctttaaaggagaaaacccctccattttcccactgtgatcaggcagtgctgcaatgcagtgaagctagtagcaataaggac

SEQ ID NO: 9082 - DNA, 201 bp, Homo sapiens
aatataaaaaggaatacacagtgcagcaggccttgttttgtacttctggaattgttacttctataccggtgcccttggcaggaagtgcccttctcccataycatatttcatctactgcatgtcaggccaaggctcatctgtcatctgatgatagtaattcaaatggtgattctgcccaagtgcatattgccacaaaaaaca

SEQ ID NO: 9083 - DNA, 149 bp, Homo sapiens
aactaaaaagctcaagggagaattagccaaagagtttgcacctgctacmccaccttctactccacacaactcatctgttggtagtttgtctgagaatgaacaaaatactatagaaaaagaagagttcatgttgaaactcatgcgatctc

SEQ ID NO: 9084 - DNA, 201 bp, Homo sapiens
aatcaggattacaggaagcagctaagacaaccaaagtgcagtgcaactcaagaatgttccctgtgccaagttcacaagtgaaaacaaacaaggaactgttmatgttttcaaacaaagagcaccaccaagaagcagacaaaaagagacaaagtaaaagaaatgaaggttacttttgtaaaaatcaaacttcatattgctggt

SEQ ID NO: 9085 - DNA, 184 bp, Homo sapiens
gtgatccgcctggcagccattgcagagtcaggggtagagcggcaagtacttttgggagaccagatacccaaattcgccgttgccactttaccacccgcctkaatcctgggattctagtatgcaataagagatgccctgtactgatgcaaaatttaataaagtttgtcacagagaatctttgtac

SEQ ID NO: 9086 - DNA, 171 bp, Homo sapiens
cagccattgcagagtcaggggtagagcggcaagtacttttgggagaccagatacccaaattcgccgttgccactttaccacccgcctgaatcctgggattytagtatgcaataagagatgccctgtactgatgcaaaatttaataaagtttgtcacagagaatctttgtac

SEQ ID NO: 9087 - DNA, 201 bp, Homo sapiens
ttacgacagttgctttgaggcagtaccggaggagaaagatggcggctaccttactagctgctcggggagccgggccagcaccggcttgggggccggaggcrttcactccagactgggaaagccgagaagtttccactgggaccactatcatggccgtgcagtttgacgggggcgtggttctgggggcggactccagaacaa

SEQ ID NO: 9088 - DNA, 201 bp, Homo sapiens
ctccagactgggaaagccgagaagtttccactgggaccactatcatggccgtgcagtttgacgggggcgtggttctgggggcggactccagaacaaccacygggtcctacatcgccaatcgagtgactgacaagctgacacctattcacgaccgcattttctgctgtcgctcaggctcagctgctgatacccaggcagtag

SEQ ID NO: 9089 - DNA, 201 bp, Homo sapiens
cagctgctgatacccaggcagtagctgatgctgtcacctaccagctcggtttccacagcattgaactgaatgagcctccactggtccacacagcagccagyctctttaaggagatgtgttaccgataccgggaagacctgatggcgggaatcatcatcgcaggctgggaccctcaagaaggagggcaggtgtactcagtgc

SEQ ID NO: 9090 - DNA, 201 bp, Homo sapiens
  misc_feature (1)...(201): n = A,T,C or G, or insertion/deletion polymorphism (see Tables 1-2)
aggtgtactcagtgcctatggggggtatgatggtaaggcagtcctttgccattggaggctccgggagctcctacatctatggctatgttgatgctacctancgggaaggcatgaccaaggaagagtgtctgcaattcactgccaatgctctcgctttggccatggagcgggatggctccagtggaggagtgatccgcctgg

SEQ ID NO: 9091 - DNA, 201 bp, Homo sapiens
ccgcattttctgctgtcgctcaggctcagctgctgatacccaggcagtagctgatgctgtcacctaccagctcggtttccacagcattgaactgaatgagsctccactggtccacacagcagccagcctctttaaggagatgtgttaccgataccgggaagacctgatggcgggaatcatcatcgcaggctgggaccctca

SEQ ID NO: 9092 - DNA, 201 bp, Homo sapiens
aggatctcacagatggccactttgagaacattttagctgacaacagtgtgaacgaccagaccaaaatccttgtggttaatgctgcctactttgttggcaartggatgaagaaattttctgaatcagaaacaaaagaatgtcctttcagagtcaacaagacagacaccaaaccagtgcagatgatgaacatggaggccacgt

SEQ ID NO: 9093 - DNA, 185 bp, Homo sapiens
gataagctatccgtgttgcaggttcatggattacttctctataaaaaatatgtatttaccaaaaattttgtgacattccttctcccatctcttccttgacmtgcattgtaaataggttcttcttgttctgagattcaatattgaatttttcctatgctattgacaataaaatattattgaactac

SEQ ID NO: 9094 - DNA, 201 bp, Homo sapiens
tgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttat

SEQ ID NO: 9095 - DNA, 201 bp, Homo sapiens
ttgacacatagtttttcagtctatgggtttagttactttagatggcaagcatgtaacttatattaatagtaatttgtaaagttggttggataagctatccrtgttgcaggttcatggattacttctctataaaaaatatgtatttaccaaaaattttgtgacattccttctcccatctcttccttgacctgcattgtaaat

SEQ ID NO: 9096 - DNA, 201 bp, Homo sapiens
gcatgtaacttatattaatagtaatttgtaaagttggttggataagctatccgtgttgcaggttcatggattacttctctataaaaaatatgtatttaccaaaaattttgtgacattccttctcccatctcttccttgacctgcattgtaaataggttcttcttgttctgagattcaatattgaatttttcctatgctatt

SEQ ID NO: 9097 - DNA, 201 bp, Homo sapiens
ttatttgtcaaattgtccggggtagttggcagaaatacagtcttccacaaagaaaattcctataaggaagatttggaagctcttcttcccagcactatgcyttccttctttgggatagagaatgttccagacattctcgcttccctgaaagactgaagaaagtgtagtgcatgggacccacgaaactgccctggctccagt

SEQ ID NO: 9098 - DNA, 201 bp, Homo sapiens
ccaatgccaaggtcaaactctccattccaaaatttaaggtggaaaagatgattgatcccaaggcttgtctggaaaatctagggctgaaacatatcttcagygaagacacatctgatttctctggaatgtcagagaccaagggagtggccctatcaaatgttatccacaaagtgtgcttagaaataactgaagatggtgggg

SEQ ID NO: 9099 - DNA, 201 bp, Homo sapiens
aaaattctgaattttggggattttcaaaagataatattttacatacactgtatgttatagaacttcatggatcagatctggggcagcaccctataaatcamcaccttaatatgctgcaacaaaatgtagaatattcagacaaaatggatacataaagactaagtagcccataaggggtcaaaatttgctgccaaatgcgta

SEQ ID NO: 9100 - DNA, 201 bp, Homo sapiens
ctcctcgcttgcctgttccttttccacgcattttccaggataacttccttgcttccaggcccgcaatggatgccctgcaactagcaaattcggcttttgcygttgatctgttcaaacaactatgtgaaaaggagccactgggcaatgtcctcttctctccaatctgtctctccacctctctgtcacttgctcaagtgggtg

SEQ ID NO: 9101 - DNA, 201 bp, Homo sapiens
gtttattaaaattctgaattttggggattttcaaaagataatattttacatacactgtatgttatagaacttcatggatcagatctggggcagcaccctahaaatcaacaccttaatatgctgcaacaaaatgtagaatattcagacaaaatggatacataaagactaagtagcccataaggggtcaaaatttgctgccaa

SEQ ID NO: 9102 - DNA, 197 bp, Homo sapiens
cagacacggtcgcctccacatccaggtctttgtgctcctcgcttgcctgttccttttccacgcattttccaggataacttccttgcttccaggccckcaatggatgccctgcaactagcaaattcggcttttgccgttgatctgttcaaacaactatgtgaaaaggagccactgggcaatgtcctcttctctccaat

SEQ ID NO: 9103 - DNA, 201 bp, Homo sapiens
aggttcttcattttgaaaatgtcaaagatgtaccctttggatttcaaacagtaacatcggatgtaaacaaacttagttccttttactcactgaaactaatmaagcggctctacgtagacaaatctctgaatctttctacagagttcatcagctctacgaagagaccgtatgcaaaggaattggaaactgttgacttcaaag

SEQ ID NO: 9104 - DNA, 201 bp, Homo sapiens
aatctgtctctccacctctctgtcacttgctcaagtgggtgctaaaggtgacactgcaaatgaaattggacaggttcttcattttgaaaatgtcaaagatrtaccctttggatttcaaacagtaacatcggatgtaaacaaacttagttccttttactcactgaaactaatcaagcggctctacgtagacaaatctctgaa

SEQ ID NO: 9105 - DNA, 170 bp, Homo sapiens
ttgcaggttcatggattacttctctataaaaaatatgtatttaccaaaaattttgtgacattccttctcccatctcttccttgacctgcattgtaaatagsttcttcttgttctgagattcaatattgaatttttcctatgctattgacaataaaatattattgaactac

SEQ ID NO: 9106 - DNA, 201 bp, Homo sapiens
  misc_feature (1)...(201): n = A,T,C or G, or insertion/deletion polymorphism (see Tables 1-2)
ggcttgtctggaaaatctagggctgaaacatatcttcagtgaagacacatctgatttctctggaatgtcagagaccaagggagtggccctatcaaatgttntccacaaagtgtgcttagaaataactgaagatggtggggattccatagaggtgccaggagcacggatcctgcagcacaaggatgaattgaatgctgacca

SEQ ID NO: 9107 - DNA, 201 bp, Homo sapiens
acaaacttagttccttttactcactgaaactaatcaagcggctctacgtagacaaatctctgaatctttctacagagttcatcagctctacgaagagaccstatgcaaaggaattggaaactgttgacttcaaagataaattggaagaaacgaaaggtcagatcaacaactcaattaaggatctcacagatggccactttg

SEQ ID NO: 9108 - DNA, 201 bp, Homo sapiens
ccactttgagaacattttagctgacaacagtgtgaacgaccagaccaaaatccttgtggttaatgctgcctactttgttggcaagtggatgaagaaatttyctgaatcagaaacaaaagaatgtcctttcagagtcaacaagacagacaccaaaccagtgcagatgatgaacatggaggccacgttctgtatgggaaacat

SEQ ID NO: 9109 - DNA, 201 bp, Homo sapiens
gaacgaccagaccaaaatccttgtggttaatgctgcctactttgttggcaagtggatgaagaaattttctgaatcagaaacaaaagaatgtcctttcagastcaacaagacagacaccaaaccagtgcagatgatgaacatggaggccacgttctgtatgggaaacattgacagtatcaattgtaagatcatagagcttcc

SEQ ID NO: 9110 - DNA, 201 bp, Homo sapiens
tctcacagatggcaagccactttgagaacattttagctgacaacagtgtgaacgaccagaccaaaatccttgtggttaatgctgcctactttgttggcaartggatgaagaaattttctgaatcagaaacaaaagaatgtcctttcagagtcaacaagacagacaccaaaccagtgcagatgatgaacatggaggccacgt

SEQ ID NO: 9111 - DNA, 185 bp, Homo sapiens; identical to SEQ ID NO: 9093

SEQ ID NO: 9112 - DNA, 201 bp, Homo sapiens; identical to SEQ ID NO: 9094

SEQ ID NO: 9113 - DNA, 201 bp, Homo sapiens; identical to SEQ ID NO: 9095

SEQ ID NO: 9114 - DNA, 201 bp, Homo sapiens; identical to SEQ ID NO: 9096

SEQ ID NO: 9115 - DNA, 201 bp, Homo sapiens; identical to SEQ ID NO: 9097

SEQ ID NO: 9116 - DNA, 201 bp, Homo sapiens; identical to SEQ ID NO: 9098

SEQ ID NO: 9117 - DNA, 201 bp, Homo sapiens; identical to SEQ ID NO: 9099

SEQ ID NO: 9118 - DNA, 201 bp, Homo sapiens; identical to SEQ ID NO: 9100

SEQ ID NO: 9119 - DNA, 201 bp, Homo sapiens; identical to SEQ ID NO: 9101

SEQ ID NO: 9120 - DNA, 197 bp, Homo sapiens; identical to SEQ ID NO: 9102

SEQ ID NO: 9121 - DNA, 201 bp, Homo sapiens; identical to SEQ ID NO: 9103

SEQ ID NO: 9122 - DNA, 201 bp, Homo sapiens; identical to SEQ ID NO: 9104

SEQ ID NO: 9123 - DNA, 170 bp, Homo sapiens; identical to SEQ ID NO: 9105

SEQ ID NO: 9124 - DNA, 201 bp, Homo sapiens; identical to SEQ ID NO: 9106
  misc_feature (1)...(201): n = A,T,C or G, or insertion/deletion polymorphism (see Tables 1-2)

SEQ ID NO: 9125 - DNA, 201 bp, Homo sapiens
acaaacttagttccttttactcactgaaactaatcaagcggctctacgtagacaaatctctgaatctttctacagagttcatcagctctacgaagagaccstatgcaaaggaattggaaactgttgacttcaaagataaattggaagaaacgaaaggtcagatcaacaactcaattaaggatctcacagatggcaagccac

SEQ ID NO: 9126 - DNA, 201 bp, Homo sapiens; identical to SEQ ID NO: 9108

SEQ ID NO: 9127 - DNA, 201 bp, Homo sapiens; identical to SEQ ID NO: 9109

SEQ ID NO: 9128 - DNA, 201 bp, Homo sapiens; identical to SEQ ID NO: 9092

SEQ ID NO: 9129 - DNA, 185 bp, Homo sapiens; identical to SEQ ID NO: 9093

SEQ ID NO: 9130 - DNA, 201 bp, Homo sapiens; identical to SEQ ID NO: 9094

SEQ ID NO: 9131 - DNA, 201 bp, Homo sapiens; identical to SEQ ID NO: 9095

SEQ ID NO: 9132 - DNA, 201 bp, Homo sapiens; identical to SEQ ID NO: 9096

SEQ ID NO: 9133 - DNA, 201 bp, Homo sapiens; identical to SEQ ID NO: 9097

SEQ ID NO: 9134 - DNA, 201 bp, Homo sapiens; identical to SEQ ID NO: 9098

SEQ ID NO: 9135 - DNA, 201 bp, Homo sapiens; identical to SEQ ID NO: 9099

SEQ ID NO: 9136 - DNA, 201 bp, Homo sapiens
gtgctcctcgcttgcctgttccttttccacgcattttccaggataactgtgactccaggcccgcaatggatgccctgcaactagcaaattcggcttttgcygttgatctgttcaaacaactatgtgaaaaggagccactgggcaatgtcctcttctctccaatctgtctctccacctctctgtcacttgctcaagtgggtg

SEQ ID NO: 9137 - DNA, 201 bp, Homo sapiens; identical to SEQ ID NO: 9101

SEQ ID NO: 9138 - DNA, 201 bp, Homo sapiens
ttctgcccagacacggtcgcctccacatccaggtctttgtgctcctcgcttgcctgttccttttccacgcattttccaggataactgtgactccaggccckcaatggatgccctgcaactagcaaattcggcttttgccgttgatctgttcaaacaactatgtgaaaaggagccactgggcaatgtcctcttctctccaat

SEQ ID NO: 9139 - DNA, 201 bp, Homo sapiens; identical to SEQ ID NO: 9103

SEQ ID NO: 9140 - DNA, 201 bp, Homo sapiens; identical to SEQ ID NO: 9104

SEQ ID NO: 9141 - DNA, 170 bp, Homo sapiens; identical to SEQ ID NO: 9105

SEQ ID NO: 9142 - DNA, 201 bp, Homo sapiens; identical to SEQ ID NO: 9106
  misc_feature (1)...(201): n = A,T,C or G, or insertion/deletion polymorphism (see Tables 1-2)

SEQ ID NO: 9143 - DNA, 201 bp, Homo sapiens; identical to SEQ ID NO: 9107

SEQ ID NO: 9144 - DNA, 201 bp, Homo sapiens; identical to SEQ ID NO: 9108

SEQ ID NO: 9145 - DNA, 201 bp, Homo sapiens; identical to SEQ ID NO: 9109

SEQ ID NO: 9146 - DNA, 201 bp, Homo sapiens
tctcacagatggcaagccactttgagaacattttagctgacaacagtgtgaacgaccagaccaaaatccttgtggttaatgctgcctactttgttggcaartggatgaagaaattttctgaatcagaaacaaaagaatgtcctttcagagtcaacaaggtatgtggggcagcatgtagcagtaaaaggagcccaattatag

SEQ ID NO: 9147 - DNA, 201 bp, Homo sapiens; identical to SEQ ID NO: 9125

SEQ ID NO: 9148 - DNA, 201 bp, Homo sapiens
tggttaatgctgcctactttgttggcaagtggatgaagaaattttctgaatcagaaacaaaagaatgtcctttcagagtcaacaaggtatgtggggcagcrtgtagcagtaaaaggagcccaattatagatgtgaaaaatgatagggacagagtggggcataaatccattccaatgaggaacctgagggcacggccggcaa

SEQ ID NO: 9149 - DNA, 201 bp, Homo sapiens
ccactttgagaacattttagctgacaacagtgtgaacgaccagaccaaaatccttgtggttaatgctgcctactttgttggcaagtggatgaagaaatttyctgaatcagaaacaaaagaatgtcctttcagagtcaacaaggtatgtggggcagcatgtagcagtaaaaggagcccaattatagatgtgaaaaatgatag

SEQ ID NO: 9150 - DNA, 170 bp, Homo sapiens
tttctgaatcagaaacaaaagaatgtcctttcagagtcaacaaggtatgtggggcagcatgtagcagtaaaaggagcccaattatagatgtgaaaaatgayagggacagagtggggcataaatccattccaatgaggaacctgagggcacggccggcaaagtgcctttcc

SEQ ID NO: 9151 - DNA, 201 bp, Homo sapiens
gaacgaccagaccaaaatccttgtggttaatgctgcctactttgttggcaagtggatgaagaaattttctgaatcagaaacaaaagaatgtcctttcagastcaacaaggtatgtggggcagcatgtagcagtaaaaggagcccaattatagatgtgaaaaatgatagggacagagtggggcataaatccattccaatgag

SEQ ID NO: 9152 - DNA, 201 bp, Homo sapiens; identical to SEQ ID NO: 9100

SEQ ID NO: 9153 - DNA, 197 bp, Homo sapiens; identical to SEQ ID NO: 9102

SEQ ID NO: 9154 - DNA, 201 bp, Homo sapiens; identical to SEQ ID NO: 9103

SEQ ID NO: 9155 - DNA, 201 bp, Homo sapiens; identical to SEQ ID NO: 9104

SEQ ID NO: 9156 - DNA, 201 bp, Homo sapiens
attcattttctagatacaataaattgctaatgttgctggatcaggaagccgccagtacttgtcatatgtagccttcacacagatagaccttttttttttttcaattctatcttttgtttccttttttcccataagacaatgacatacgcttttaatgaaaaggaatcacgttagaggaaaaatatttattcattatttgtc

SEQ ID NO: 9157 - DNA, 201 bp, Homo sapiens
aaaattctgaattttggggattttcaaaagataatattttacatacactgtatgttatagaacttcatggatcagatctggggcagcaacctataaatcamcaccttaatatgctgcaacaaaatgtagaatattcagacaaaatggatacataaagactaagtagcccataaggggtcaaaatttgctgccaaatgcgta

SEQ ID NO: 9158 - DNA, 201 bp, Homo sapiens
gtttattaaaattctgaattttggggattttcaaaagataatattttacatacactgtatgttatagaacttcatggatcagatctggggcagcaacctahaaatcaacaccttaatatgctgcaacaaaatgtagaatattcagacaaaatggatacataaagactaagtagcccataaggggtcaaaatttgctgccaa

SEQ ID NO: 9159 - DNA, 201 bp, Homo sapiens
aggttcttcattttgaaaatgtcaaagatataccctttggatttcaaacagtaacatcggatgtaaacaaacttagttccttttactcactgaaactaatmaagcggctctacgtagacaaatctctgaatctttctacagagttcatcagctctacgaagagaccctatgcaaaggaattggaaactgttgacttcaaag

SEQ ID NO: 9160 - DNA, 201 bp, Homo sapiens
ccactttgagaacattttagctgacaacagtgtgaacgaccagaccaaaatccttgtggttaatgctgcctactttgttggcaagtggatgaagaaatttyctgaatcagaaacaaaagaatgtcctttcagactcaacaagacagacaccaaaccagtgcagatgatgaacatggaggccacgttctgtatgggaaacat

SEQ ID NO: 9161 - DNA, 201 bp, Homo sapiens
gaacgaccagaccaaaatccttgtggttaatgctgcctactttgttggcaagtggatgaagaaatttcctgaatcagaaacaaaagaatgtcctttcagastcaacaagacagacaccaaaccagtgcagatgatgaacatggaggccacgttctgtatgggaaacattgacagtatcaattgtaagatcatagagcttcc

SEQ ID NO: 9162 - DNA, 201 bp, Homo sapiens; identical to SEQ ID NO: 9104

SEQ ID NO: 9163 - DNA, 201 bp, Homo sapiens; identical to SEQ ID NO: 9161

SEQ ID NO: 9164 - DNA, 201 bp, Homo sapiens; identical to SEQ ID NO: 9160

SEQ ID NO: 9165 - DNA, 201 bp, Homo sapiens
ttgacacatagtttttcagtctatgggtttagttactttagatggcaagcatgtaacttatattaatagtaatttgtaaagttgggtggataagctatccrtgttgccggttcatggattacttctctataaaaaatatatatttaccaaaaaattttgtgacattccttctcccatctcttccttgacatgcattgtaaa

SEQ ID NO: 9166 - DNA, 201 bp, Homo sapiens; identical to SEQ ID NO: 9097

SEQ ID NO: 9167 - DNA, 201 bp, Homo sapiens; identical to SEQ ID NO: 9098

SEQ ID NO: 9168 - DNA, 201 bp, Homo sapiens
aggatctcacagatggccactttgagaacattttagctgacaacagtgtgaacgaccagaccaaaatccttgtggttaatgctgcctactttgttggcaartggatgaagaaatttcctgaatcagaaacaaaagaatgtcctttcagactcaacaagacagacaccaaaccagtgcagatgatgaacatggaggccacgt

SEQ ID NO: 9169 - DNA, 201 bp, Homo sapiens; identical to SEQ ID NO: 9107

SEQ ID NO: 9170 - DNA, 201 bp, Homo sapiens; identical to SEQ ID NO: 9106
  misc_feature (1)...(201): n = A,T,C or G, or insertion/deletion polymorphism (see Tables 1-2)

SEQ ID NO: 9171 - DNA, 201 bp, Homo sapiens
tgcatccagagattcattttctagatacaataaattgctaatgttgctggatcaggaagccgccagtacttgtcatatgtagccttcacacagatagacctttttttttttccaattctatcttttgtttccttttttcccataagacaatgacatacgcttttaatgaaaaggaatcacgttagaggaaaaatatttatt

SEQ ID NO: 9172 - DNA, 201 bp, Homo sapiens
gaagaggaagagattcaaatgaacgacagttcaaacctgagttgtgaacaggagaaaccaatgcacttggaaatagaagattctggtcctcttattgatayaccttctgagacagaaggttctgtttttatggaaactcaaatgctgccttagaaatcactcctagatgaaatgtttctcataataacttgtcaagaactt

SEQ ID NO: 9173 - DNA, 109 bp, Homo sapiens
gaagcaatytgcgcggcgaggagcggagcggcaggaacccaataagctgcttcgcctcggagctgaagcccgtactcaagatggcggctccgggcgggcgtggccagtg

SEQ ID NO: 9174 - DNA, 201 bp, Homo sapiens
  misc_feature (1)...(201): n = A,T,C or G, or insertion/deletion polymorphism (see Tables 1-2)
gacaaccaactacagcccattcagtttcaataccaggataacataaaaaatctagaattagaagtcatcaatctgcaaaaggaaaaggaagaattggttcntgaacttcagacagcaaagaagaatgtcaaccaagccaagctgagtgagcaccgccacaaacttctccaggagctggagggtcaaatagctgatctgaag

SEQ ID NO: 9175 - DNA, 201 bp, Homo sapiens
ctcctccaggtagccagcagacagaaacatcttcctaatgatacccttctatctccagactcttcttttgaatatatcccacctaagccaaaaccttctcrtgttaaagaaaagtttctggagcaaagcatggacatcgaggatctaaaatattgttcagagcattctgtgaatgagcatgaagatggtgatggtgatggc

SEQ ID NO: 9176 - DNA, 201 bp, Homo sapiens
atgcgtcaaatgaaagaggatgctgagaagtttagacaatggaagcagaaaaaagacaaagaagtaatacagttgaaagaacgagaccgtaagaggcaatrtgagctgctcaaacttgaaagaaacttccagaaacaatccagtgtgctcagacgtaaaacggaagaggcagcagctgccaacaagcgactcaaggatgct

SEQ ID NO: 9177 - DNA, 201 bp, Homo sapiens
cgggtacagttaatgcgtcaaatgaaagaggatgctgagaagtttagacaatggaagcagaaaaaagacaaagaagtaatacagttgaaagaacgagaccrtaagaggcaatatgagctgctcaaacttgaaagaaacttccagaaacaatccagtgtgctcagacgtaaaacggaagaggcagcagctgccaacaagcga

SEQ ID NO: 9178 - DNA, 201 bp, Homo sapiens
gaagaaaaagaaacgagctctggctagcaacaccagcttcttctctggctgctcccctatcgaagaagaggcccactgaagttggagtcatcatctctacscccaatctggcttgggagatgctttccagttgcagccagaaggggttttttaaatgacttctctggatttcaggtttcttgccgttgaaaaaaaggaaca

SEQ ID NO: 9179 - DNA, 201 bp, Homo sapiens
atctaaagcaacaggtacaacagctacaagtcttgttgctacaagcccatggaggtaccctgcctggatctataaatgcagaaccatcagagaatctacartccctgatggagaagaatcagtccctggtagaggagaatgaaaaattaagtcgttgtctgagcaaggcagctggtcagacagcccagatgttggagagga

SEQ ID NO: 9180 - DNA, 201 bp, Homo sapiens
agaaaatgtagagataatttgtaacctgcagcaactgattacccagttatcagatgaaactgttgcttgcacggctgcagccattgatactgcggtagaasaagaagctcaagtggaaaccagtccagagacaagcaggtcttctgacgcttttaccactcagcatgctctccatcaagctcagatgtctaaggaggtggt

SEQ ID NO: 9181 - DNA, 201 bp, Homo sapiens
aaaacagattgaaagcctagagactgaaatggaactcaggagtgctcagattgctgacctacagcagaagctgctggatgcagaaagtgaagataggccaraacaatgctgggagaatattgccaccattctggaagccaagtgtgccctgaaatatttgattggagagctggtctcctccaaaatacatgtcaccaaact

SEQ ID NO: 9182 - DNA, 201 bp, Homo sapiens
tgtgctgacatgcagaagatgctatttgaggaacaaaatcatttttctgagatagagacagagttacaagctgagctggtcagaatggagcaacagcaccmagagaaggtgctataccttgtcagccagctgcaggaaagccaaatggcagagaagcagttagagaaatcagccagtgaaaaggaacaacagctggtgagc

SEQ ID NO: 9183 - DNA, 201 bp, Homo sapiens
acgagaggtcacagataagcggaaagagactcagagccatggaaaggaaggtattgcagctcgagtgaggaattggcttggaaatgaaattgaggttatgrtcagtactgaggaagccaaacgccatctgaatgacctccttgaagacagaaagatcctggctcaggatgtggttcaactcaaagaaaaaaaggaatctcg

SEQ ID NO: 9184 - DNA, 201 bp, Homo sapiens
  misc_feature (1)...(201): n = A,T,C or G, or insertion/deletion polymorphism (see Tables 1-2)
atataccatcacctgttttggaatcattttcaaataaaactccccctcacaccacccaactggaagtcattcctgatgtgctgtgagcagaatgggcctgngattttgcaagaatgcaaaaccacatgaaaatttcaagaattcactgatctgatgcaaaataaaaatttatcattacatcttgaacccaggaagcttaca

SEQ ID NO: 9185 - DNA, 201 bp, Homo sapiens
cttcaatccttttcctggaggatatgactatttggttgactttttagatttatccttcccaaaagaaagaccacaacgagaacatccctatgaggaaatcyatagccgggtggatgtcatcagacacgtggtgaagaatggtctactctgggatgagttgtatataggattccaaacacggctccagcgggatcctgacat

SEQ ID NO: 9186 - DNA, 201 bp, Homo sapiens
  misc_feature (1)...(201): n = A,T,C or G, or insertion/deletion polymorphism (see Tables 1-2)
atctgaatcagagcggtgtccagttgactaatatcaatgtcgtgccatttggaatatggcagcaggtggacaaaaatcttcgattcatgatcttgatgganggtgttcatcctgagatggacacttgcattattgtggagtacaaaggtcataaaatactcaatatagtagactgcaccagacccaatgggggaaggctgc

SEQ ID NO: 9187 - DNA, 201 bp, Homo sapiens
gcatgcaagaatatgtgcaagcaccaaggaggcctgttcataaaagatatcgaggatttagccggaagttgttgaaatggatgaaaacaacggacttttgmttttagaactgaatcctcctaacccttgggacttacagcccagatctcctgaagagttggcttttggagaagtacagataacatatctcactcatgcctg

SEQ ID NO: 9188 - DNA, 201 bp, Homo sapiens
tacaagaataagagccgactgagggcatgcaagaatatgtgcaagcaccaaggaggcctgttcataaaagatatcgaggatttagccggaagttgttgaartggatgaaaacaacggacttttgcttttagaactgaatcctcctaacccttgggacttacagcccagatctcctgaagagttggcttttggagaagtaca

SEQ ID NO: 9189 - DNA, 201 bp, Homo sapiens
gtttgacccttggttaatcggtcctgcttttgcccgtggatggtggttgctccatgagcctccatctgattggctggagaggctgtgccaggcagacctcrtttacatcagtcatctgcactcagaccacctgagttaccccacactgaaaaagcttgctgggagaagaccagatattcccatttatgttggaaacacaga

SEQ ID NO: 9190 - DNA, 201 bp, Homo sapiens
ttttgctggaggagcatcaggctttccaatgactttcagtggtggaaaatttacggaggaatggaaagcccaattcattaaaacagaaaggaagaagctcytgaactacaaggctcggctggtgaagaacctgcaaccccgaatttattgtccctttgctgggtattttgtggaatctcacccatcagacaagtacatcaa

SEQ ID NO: 9191 - DNA, 201 bp, Homo sapiens
atatttcttcactcatcctggataaaagaatacttcacttgggctggatttaaagattacaaccttgtggtcaggatgattgagacagatgaggacttcartccttttcctggaggatatgactatttggttgactttttagatttatccttcccaaaagaaagaccacaacgagaacatccctatgaggaaatccatagc

SEQ ID NO: 9192 - DNA, 201 bp, Homo sapiens
  misc_feature (1)...(201): n = A,T,C or G, or insertion/deletion polymorphism (see Tables 1-2)
tctgaagatacaagaattcaatggtggaatttgtctcctgaaatttctagattcataattagaagtgtttattaccaacttctcacttagattaacatcantgatgtttgattattctggttaaccgctcacatgcataacaataatgctagaaattcaggaattataattttgtgatttatactgtgtggtaaattattc

SEQ ID NO: 9193 - DNA, 201 bp, Homo sapiens
cggtcctgcttttgcccgtggatggtggttgctccatgagcctccatctgattggctggagaggctgtgccaggcagacctcatttacatcagtcatctgmactcagaccacctgagttaccccacactgaaaaagcttgctgggagaagaccagatattcccatttatgttggaaacacagaaaggcctgtattttggaa

SEQ ID NO: 9194 - DNA, 201 bp, Homo sapiens
ttggcttttggagaagtacagataacatatctcactcatgcctgcatggacctcaagttaggagacaagagaatggtgtttgacccttggttaatcggtcytgcttttgcccgtggatggtggttgctccatgagcctccatctgattggctggagaggctgtgccaggcagacctcatttacatcagtcatctgcactca

SEQ ID NO: 9195 - DNA, 147 bp, Homo sapiens
gtctacaccagcggtgtcgctgcccgaaagtgagagaaggctgataytgctagctggaatccaggcctgggtgctgcatggtggcgcccctccccgtgaccaccgctgcgttttctcgggctttctctggggagctgctcttgtgct

SEQ ID NO: 9196 - DNA, 201 bp, Homo sapiens
ccaaatgaactcaacaatcttatcaagaaaaactctgatgtgataacatggacccctcgaccgggagccacccttgatctgggaagaatgctgaaggatcsaacagacagcaagggcatcatagagcctccagaggggacaaaaatttacaaggattcctgggattttgaaccttatttggaaatcttgaatgctgctcta

SEQ ID NO: 9197 - DNA, 201 bp, Homo sapiens
  misc_feature (1)...(201): n = A,T,C or G, or insertion/deletion polymorphism (see Tables 1-2)
atcaggctttccaatgactttcagtggtggaaaatttacggaggaatggaaagcccaattcattaaaacagaaaggaagaagctcctgaactacaaggctnggctggtgaagaacctgcaaccccgaatttattgtccctttgctgggtattttgtggaatctcacccatcagacaagtacatcaaggaaacaaacaccaa

SEQ ID NO: 9198 - DNA, 201 bp, Homo sapiens
atgacgtcagcaatagataattccacgttgcctttgtgatttgtatatatagcttacatttgtggatcactacatagccagattcaaaaatattttacttsttccatccacagttctctacagaaagaaccaatgaacccaataggaacaaattctctgtggaaaacaaagcatagctgtagtagatacgaatccaatcac

SEQ ID NO: 9199 - DNA, 201 bp, Homo sapiens
gtggacaaaaatcttcgattcatgatcttgatggacggtgttcatcctgagatggacacttgcattattgtggagtacaaaggtcataaaatactcaatayagtagactgcaccagacccaatgggggaaggctgcctatgaaggttgctctaatgatgagtgattttgctggaggagcatcaggctttccaatgactttc

SEQ ID NO: 9200 - DNA, 201 bp, Homo sapiens
  misc_feature (1)...(201): n = A,T,C or G, or insertion/deletion polymorphism (see Tables 1-2)
tgttttggaatcattttcaaataaaactccccctcacaccacccaactggaagtcattcctgatgtgctgtgagcagaatgggcctgcgattttgcaagantgcaaaaccacatgaaaatttcaagaattcactgatctgatgcaaaataaaaatttatcattacatcttgaacccaggaagcttacagcaaagagactat

SEQ ID NO: 9201 - DNA, 201 bp, Homo sapiens
acccaggaagcttacagcaaagagactatgctttatgacgtcagcaatagataattccacgttgcctttgtgatttgtatatatagcttacatttgtggaycactacatagccagattcaaaaatattttacttgttccatccacagttctctacagaaagaaccaatgaacccaataggaacaaattctctgtggaaaac

SEQ ID NO: 9202 - DNA, 201 bp, Homo sapiens; identical to SEQ ID NO: 9184
  misc_feature (1)...(201): n = A,T,C or G, or insertion/deletion polymorphism (see Tables 1-2)

SEQ ID NO: 9203 - DNA, 201 bp, Homo sapiens; identical to SEQ ID NO: 9185

SEQ ID NO: 9204 - DNA, 201 bp, Homo sapiens; identical to SEQ ID NO: 9186
  misc_feature (1)...(201): n = A,T,C or G, or insertion/deletion polymorphism (see Tables 1-2)

SEQ ID NO: 9205 - DNA, 201 bp, Homo sapiens; identical to SEQ ID NO: 9187

SEQ ID NO: 9206 - DNA, 201 bp, Homo sapiens; identical to SEQ ID NO: 9188

SEQ ID NO: 9207 - DNA, 201 bp, Homo sapiens; identical to SEQ ID NO: 9189

SEQ ID NO: 9208 - DNA, 201 bp, Homo sapiens; identical to SEQ ID NO: 9190

SEQ ID NO: 9209 - DNA, 201 bp, Homo sapiens; identical to SEQ ID NO: 9191

SEQ ID NO: 9210 - DNA, 201 bp, Homo sapiens; identical to SEQ ID NO: 9192
  misc_feature (1)...(201): n = A,T,C or G, or insertion/deletion polymorphism (see Tables 1-2)

SEQ ID NO: 9211 - DNA, 201 bp, Homo sapiens; identical to SEQ ID NO: 9193

SEQ ID NO: 9212 - DNA, 201 bp, Homo sapiens; identical to SEQ ID NO: 9194

SEQ ID NO: 9213 - DNA, 201 bp, Homo sapiens; identical to SEQ ID NO: 9196

SEQ ID NO: 9214 - DNA, 201 bp, Homo sapiens; identical to SEQ ID NO: 9197
  misc_feature (1)...(201): n = A,T,C or G, or insertion/deletion polymorphism (see Tables 1-2)

SEQ ID NO: 9215 - DNA, 201 bp, Homo sapiens; identical to SEQ ID NO: 9198

SEQ ID NO: 9216 - DNA, 201 bp, Homo sapiens; identical to SEQ ID NO: 9199

SEQ ID NO: 9217 - DNA, 201 bp, Homo sapiens; identical to SEQ ID NO: 9200
  misc_feature (1)...(201): n = A,T,C or G, or insertion/deletion polymorphism (see Tables 1-2)

SEQ ID NO: 9218 - DNA, 201 bp, Homo sapiens; identical to SEQ ID NO: 9201

SEQ ID NO: 9219 - DNA, 201 bp, Homo sapiens; identical to SEQ ID NO: 9184
  misc_feature (1)...(201): n = A,T,C or G, or insertion/deletion polymorphism (see Tables 1-2)

SEQ ID NO: 9220 - DNA, 201 bp, Homo sapiens; identical to SEQ ID NO: 9185

SEQ ID NO: 9221 - DNA, 201 bp, Homo sapiens; identical to SEQ ID NO: 9186
  misc_feature (1)...(201): n = A,T,C or G, or insertion/deletion polymorphism (see Tables 1-2)

SEQ ID NO: 9222 - DNA, 201 bp, Homo sapiens; identical to SEQ ID NO: 9187

SEQ ID NO: 9223 - DNA, 201 bp, Homo sapiens; identical to SEQ ID NO: 9188

SEQ ID NO: 9224 - DNA, 201 bp, Homo sapiens; identical to SEQ ID NO: 9189

SEQ ID NO: 9225 - DNA, 201 bp, Homo sapiens; identical to SEQ ID NO: 9190

SEQ ID NO: 9226 - DNA, 201 bp, Homo sapiens; identical to SEQ ID NO: 9191

SEQ ID NO: 9227 - DNA, 201 bp, Homo sapiens; identical to SEQ ID NO: 9192
  misc_feature (1)...(201): n = A,T,C or G, or insertion/deletion polymorphism (see Tables 1-2)

SEQ ID NO: 9228 - DNA, 201 bp, Homo sapiens; identical to SEQ ID NO: 9193

SEQ ID NO: 9229 - DNA, 201 bp, Homo sapiens; identical to SEQ ID NO: 9194

SEQ ID NO: 9230 - DNA, 201 bp, Homo sapiens; identical to SEQ ID NO: 9196

SEQ ID NO: 9231 - DNA, 201 bp, Homo sapiens; identical to SEQ ID NO: 9197
  misc_feature (1)...(201): n = A,T,C or G, or insertion/deletion polymorphism (see Tables 1-2)

SEQ ID NO: 9232 - DNA, 201 bp, Homo sapiens; identical to SEQ ID NO: 9198

SEQ ID NO: 9233 - DNA, 201 bp, Homo sapiens; identical to SEQ ID NO: 9199

SEQ ID NO: 9234 - DNA, 201 bp, Homo sapiens; identical to SEQ ID NO: 9200
  misc_feature (1)...(201): n = A,T,C or G, or insertion/deletion polymorphism (see Tables 1-2)

SEQ ID NO: 9235 - DNA, 201 bp, Homo sapiens; identical to SEQ ID NO: 9201

SEQ ID NO: 9236 - DNA, 201 bp, Homo sapiens
  misc_feature (1)...(201): n = A,T,C or G, or insertion/deletion polymorphism (see Tables 1-2)
ttggtgtctcatcatcctcttctgggccttctcagactttaacaagcactggaaattttaaatttggagatcagggaggattcaaaataggtgtgtcatcngattctgggtctataaaccccatgagtgaaggctttaaattttctaaaccaataggagattttaaatttggagtttcatctgaatctaagcccgaagaag

SEQ ID NO: 9237 - DNA, 201 bp, Homo sapiens
aaccaattataagtagttcagctcatcatgtcactacagtgaacagtacaaattgtaagaagacaccacctgaagattgtgagggtccttttagacctgcmgaaatcctgaaagaaggaagtgttctagatattctgaaaagccctggtttcgcatcgccgaagatagattctgttgctgctcagcccaccgcaacaagcc

SEQ ID NO: 9238 - DNA, 201 bp, Homo sapiens
atgatgataacatctcaactaccagtggtttttcttcaagagcttctgataaagatataactgtttcaaagaacacttcattgccacctctgtggtccccrgaagctgaacgttctcactcactctcacagcacactgccaccagctcaaaaaaaccagcattcaacttgtctgcctttggaacactttccccttcacttg

SEQ ID NO: 9239 - DNA, 201 bp, Homo sapiens
ttagacctgcagaaatcctgaaagaaggaagtgttctagatattctgaaaagccctggtttcgcatcgccgaagatagattctgttgctgctcagcccacygcaacaagcccagtagtttatacaagaccagcaataagtagcttttcttctagtggaattgggtttggggagagtttaaaagctgggtcatcatggcagt

SEQ ID NO: 9240 - DNA, 201 bp, Homo sapiens
ccccaaagccagtttccatagcaacaaatcgaagtgtttattttaaaccatctctgactccttctggtgaattcaggaagactaatcaaagaatagataasaagtgcagtactggatatgaaaaaaatatgacacccggacaaaatagagaacaacgagaaagtggcttttcatatccaaatttcagtttgcctgcagcca

SEQ ID NO: 9241 - DNA, 201 bp, Homo sapiens
aagatacttcaacaagaatgaagatgtatgcagctgttcaacagacacaagcgaggttccacgctggccagaaaataaagaggaccatctggtatatgccratgaggagagctctaatattactgatgggagaatcacacctgagccagcagtcagtaatacagaagaaccttcaacaactagtactgcttcaaattatcc

SEQ ID NO: 9242 - DNA, 201 bp, Homo sapiens
ttctcactcactctcacagcacactgccaccagctcaaaaaaaccagcattcaacttgtctgcctttggaacactttccccttcacttgggaattcttcartccttaaaaccagtcagcttggagattctcctttttatcctggaaaaacaacatacggtggggcagcagctgctgtaagacagtctaaactacgaaatac

SEQ ID NO: 9243 - DNA, 201 bp, Homo sapiens
atgtcactacagtgaacagtacaaattgtaagaagacaccacctgaagattgtgagggtccttttagacctgcagaaatcctgaaagaaggaagtgttctwgatattctgaaaagccctggtttcgcatcgccgaagatagattctgttgctgctcagcccaccgcaacaagcccagtagtttatacaagaccagcaataa

SEQ ID NO: 9244 - DNA, 201 bp, Homo sapiens
cattggatcttgggagtgttcagtatgctgtgtttctaataatgcagaagacaataagtgtgtgtcctgtatgtctgagaaaccaggaagttcagtacctrcttcaagtagcagcactgtacctgtctctctgccttctggaggctctctaggattggaaaagttcaagaaacccgagggaagctgggactgtgaattgtg

SEQ ID NO: 9245 - DNA, 201 bp, Homo sapiens
tccgccatggcctcgggagccggaggagtcggagggggcggtggcggcaagatccggacgcggcgttgccaccaggggccaattaagccttaccagcaggrgcgacaacagcatcagggcattcttagcagggttacagaatctgttaagaatattgtgccagggtggctacaaagatacttcaacaagaatgaagatgta

SEQ ID NO: 9246 - DNA, 201 bp, Homo sapiens
gaggattctcttttggcaacgtggagcctgcctctctgccatctgcctcagtgtttgttttgggaaggacagaagagaaacagcaagagcctgtcacttcyacttccctagtttttgggaagaaagctgacaatgaagagccaaagtgtcaaccagtgttttcctttgggaattcagagcaaaccaaagatgagaattctt

SEQ ID NO: 9247 - DNA, 201 bp, Homo sapiens
ccaccaggggccaattaagccttaccagcaggggcgacaacagcatcagggcattcttagcagggttacagaatctgttaagaatattgtgccagggtggytacaaagatacttcaacaagaatgaagatgtatgcagctgttcaacagacacaagcgaggttccacgctggccagaaaataaagaggaccatctggtata

SEQ ID NO: 9248 - DNA, 201 bp, Homo sapiens
acggtggggcagcagctgctgtaagacagtctaaactacgaaatacaccttatcaggcaccagttagaagacaaatgaaagctaagcaactcagtgcacartcttacggtgtgaccagttcaacagctcggcgaatattgcagtctttagagaagatgtcaagccctttagcggatgcaaaaagaattccatccattgttt

SEQ ID NO: 9249 - DNA, 201 bp, Homo sapiens
tgtgtttctaataatgcagaagacaataagtgtgtgtcctgtatgtctgagaaaccaggaagttcagtacctacttcaagtagcagcactgtacctgtctstctgccttctggaggctctctaggattggaaaagttcaagaaacccgagggaagctgggactgtgaattgtgcctagtgcagaataaggcagactctacc

SEQ ID NO: 9250 - DNA, 201 bp, Homo sapiens
ccaattaagccttaccagcaggggcgacaacagcatcagggcattcttagcagggttacagaatctgttaagaatattgtgccagggtggctacaaagatmcttcaacaagaatgaagatgtatgcagctgttcaacagacacaagcgaggttccacgctggccagaaaataaagaggaccatctggtatatgccgatgag

SEQ ID NO: 9251 - DNA, 201 bp, Homo sapiens
tgacatagtctggctgtacccaggaatggagcctgcacggtgaatggctttgtatagaacctctttgtctacaccattatgtgcgctgataagcgttcatrgaacgcgttgaaattgtaattatatctgaggaattctgtatagattagaattctgtatagattagagagtgttgaaacggatgatttctatgctgagttt

SEQ ID NO: 9252 - DNA, 201 bp, Homo sapiens
tagaaaccaagagtgcttcagtggctcctttcacatgtaagacatcagaagctaaaaaagaagaaatgcctgccaccaaaggaggattctcttttggcaaygtggagcctgcctctctgccatctgcctcagtgtttgttttgggaaggacagaagagaaacagcaagagcctgtcacttctacttccctagtttttggga

SEQ ID NO: 9253 - DNA, 201 bp, Homo sapiens; identical to SEQ ID NO: 9236
  misc_feature (1)...(201): n = A,T,C or G, or insertion/deletion polymorphism (see Tables 1-2)

SEQ ID NO: 9254 - DNA, 201 bp, Homo sapiens; identical to SEQ ID NO: 9237

SEQ ID NO: 9255 - DNA, 201 bp, Homo sapiens; identical to SEQ ID NO: 9238

SEQ ID NO: 9256 - DNA, 201 bp, Homo sapiens; identical to SEQ ID NO: 9239

SEQ ID NO: 9257 - DNA, 201 bp, Homo sapiens; identical to SEQ ID NO: 9240

SEQ ID NO: 9258 - DNA, 201 bp, Homo sapiens; identical to SEQ ID NO: 9241

SEQ ID NO: 9259 - DNA, 201 bp, Homo sapiens; identical to SEQ ID NO: 9242

SEQ ID NO: 9260 - DNA, 201 bp, Homo sapiens; identical to SEQ ID NO: 9243

SEQ ID NO: 9261 - DNA, 201 bp, Homo sapiens; identical to SEQ ID NO: 9244

SEQ ID NO: 9262 - DNA, 201 bp, Homo sapiens; identical to SEQ ID NO: 9245

SEQ ID NO: 9263 - DNA, 201 bp, Homo sapiens; identical to SEQ ID NO: 9246

SEQ ID NO: 9264 - DNA, 201 bp, Homo sapiens; identical to SEQ ID NO: 9247

SEQ ID NO: 9265 - DNA, 201 bp, Homo sapiens; identical to SEQ ID NO: 9248

SEQ ID NO: 9266 - DNA, 201 bp, Homo sapiens; identical to SEQ ID NO: 9249

SEQ ID NO: 9267 - DNA, 201 bp, Homo sapiens; identical to SEQ ID NO: 9250

SEQ ID NO: 9268 - DNA, 201 bp, Homo sapiens; identical to SEQ ID NO: 9251

SEQ ID NO: 9269 - DNA, 201 bp, Homo sapiens; identical to SEQ ID NO: 9252

SEQ ID NO: 9270 - DNA, 201 bp, Homo sapiens; identical to SEQ ID NO: 9236
  misc_feature (1)...(201): n = A,T,C or G, or insertion/deletion polymorphism (see Tables 1-2)

SEQ ID NO: 9271 - DNA, 201 bp, Homo sapiens; identical to SEQ ID NO: 9237

SEQ ID NO: 9272 - DNA, 201 bp, Homo sapiens; identical to SEQ ID NO: 9238

SEQ ID NO: 9273 - DNA, 201 bp, Homo sapiens; identical to SEQ ID NO: 9239

SEQ ID NO: 9274 - DNA, 201 bp, Homo sapiens; identical to SEQ ID NO: 9240

SEQ ID NO: 9275 - DNA, 201 bp, Homo sapiens; identical to SEQ ID NO: 9241

SEQ ID NO: 9276 - DNA, 201 bp, Homo sapiens; identical to SEQ ID NO: 9242

SEQ ID NO: 9277 - DNA, 201 bp, Homo sapiens; identical to SEQ ID NO: 9243

SEQ ID NO: 9278 - DNA, 201 bp, Homo sapiens; identical to SEQ ID NO: 9244

SEQ ID NO: 9279 - DNA, 201 bp, Homo sapiens; identical to SEQ ID NO: 9245

SEQ ID NO: 9280 - DNA, 201 bp, Homo sapiens; identical to SEQ ID NO: 9246

SEQ ID NO: 9281 - DNA, 201 bp, Homo sapiens; identical to SEQ ID NO: 9247

SEQ ID NO: 9282 - DNA, 201 bp, Homo sapiens; identical to SEQ ID NO: 9248

SEQ ID NO: 9283 - DNA, 201 bp, Homo sapiens; identical to SEQ ID NO: 9249

SEQ ID NO: 9284 - DNA, 201 bp, Homo sapiens; identical to SEQ ID NO: 9250

SEQ ID NO: 9285 - DNA, 201 bp, Homo sapiens; identical to SEQ ID NO: 9251

SEQ ID NO: 9286 - DNA, 201 bp, Homo sapiens; identical to SEQ ID NO: 9252

SEQ ID NO: 9287 - DNA, 201 bp, Homo sapiens
gaataataatctgtagttaaaaaaaaagtgtctttttacctacgcagtgaaatgtcagactgtaaaaccttgtgtggaaatgtttaacttttattttttcrtttaaatttgctgttctggtattaccaaaccacacatttgtaccgaattggcagtaaatgttagccatttacagcaatgccaaatatggagaaacatcat

SEQ ID NO: 9288 - DNA, 201 bp, Homo sapiens
tacattgatctgtcaaacttccagaaccatggtagccttcagtgagatttccatcttggctggtcactccctgactgtagctgtaggtgaatgtgtttttktgtgtgtgtgtctggttttagtgtcagaagggaaataaaagtgtaaggaggacactttaaaccctttgggtggagtttcgtaatttcccagactattttc

SEQ ID NO: 9289 - DNA, 119 bp, Homo sapiens
aaatttgctgttctggtattaccaaaccacacatttgtaccgaattggcagtaaatgttagccatttacagcaatgccaaatatggagaaacatcataatwaaaaaatctgctttttca

SEQ ID NO: 9290 - DNA, 201 bp, Homo sapiens
aatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcaccta

SEQ ID NO: 9291 - DNA, 201 bp, Homo sapiens
cgcgactccccccgggcccaaattgatattcactgatggactccaaagaatcattaactcctggtagagaagaaaaccccagcagtgtgcttgctcaggaraggggagatgtgatggacttctataaaaccctaagaggaggagctactgtgaaggtttctgcgtcttcaccctcactggctgtcgcttctcaatcagact

SEQ ID NO: 9292 - DNA, 201 bp, Homo sapiens
caacttggaggatcatgactacgctcaacatgttaggagggcggcaagtgattgcagcagtgaaatgggcaaaggcaataccaggtttcaggaacttacayctggatgaccaaatgaccctactgcagtactcctggatgtttcttatggcatttgctctggggtggagatcatatagacaatcaagtgcaaacctgctgt

SEQ ID NO: 9293 - DNA, 201 bp, Homo sapiens
aaccctaagaggaggagctactgtgaaggtttctgcgtcttcaccctcactggctgtcgcttctcaatcagactccaagcagcgaagacttttggttgatkttccaaaaggctcagtaagcaatgcgcagcagccagatctgtccaaagcagtttcactctcaatgggactgtatatgggagagacagaaacaaaagtgat

SEQ ID NO: 9294 - DNA, 201 bp, Homo sapiens
tccttttggaaggaaactcgaatgaggactgcaagcctctcattttaccggacactaaacccaaaattaaggataatggagatctggttttgtcaagcccyagtaatgtaacactgccccaagtgaaaacagaaaaagaagatttcatcgaactctgcacccctggggtaattaagcaagagaaactgggcacagtttact

SEQ ID NO: 9295 - DNA, 201 bp, Homo sapiens
tctctaatatggcaaaaatggctagacacccattttcacattcccatctgtcaccaattggttaatctttcctgatggtacaggaaagctcagctactgayttttgtgatttagaactgtatgtcagacatccatgtttgtaaaactacacatccctaatgtgtgccatagagtttaacacaagtcctgtgaatttcttca

SEQ ID NO: 9296 - DNA, 201 bp, Homo sapiens
atggagatctggttttgtcaagccccagtaatgtaacactgccccaagtgaaaacagaaaaagaagatttcatcgaactctgcacccctggggtaattaarcaagagaaactgggcacagtttactgtcaggcaagctttcctggagcaaatataattggtaataaaatgtctgccatttctgttcatggtgtgagtacct

SEQ ID NO: 9297 - DNA, 201 bp, Homo sapiens
aatttattaaaatgattgtaaaatagcttgtatagtgtaaaataagaatgatttttagatgagattgttttatcatgacatgttatatattttttgtaggkgtcaaagaaatgctgatggataacctatatgatttatagtttgtacatgcattcatacaggcagcgatggtctcagaaaccaaacagtttgctctagggg

SEQ ID NO: 9298 - DNA, 201 bp, Homo sapiens
agaagcttcagaagtttggcaatagtttgcatagaggtaccagcaatatgtaaatagtgcagaatctcataggttgccaataatacactaattcctttctrtcctacaacaagagtttatttccaaataaaatgaggacatgtttttgttttctttgaatgctttttgaatgttatttgttattttcagtattttggagaa

SEQ ID NO: 9299 - DNA, 201 bp, Homo sapiens
ttaactattgcttccaaacatttttggataagaccatgagtattgaattccccgagatgttagctgaaatcatcaccaatcagataccaaaatattcaaayggaaatatcaaaaaacttctgtttcatcaaaagtgactgccttaataagaatggttgccttaaagaaagtcgaattaatagcttttattgtataaactat

SEQ ID NO: 9300 - DNA, 201 bp, Homo sapiens
cagatgtaccactatgacatgaatacagcatccctttctcaacagcaggatcagaagcctatttttaatgtcattccaccaattcccgttggttccgaaarttggaataggtgccaaggatctggagatgacaacttgacttctctggggactctgaacttccctggtcgaacagttttttctaatggctattcaagcccc

SEQ ID NO: 9301 - DNA, 201 bp, Homo sapiens
gcccaaagtctgtgtgatgaactttctcttcatactttttttcacagttggctggatgaaattttctagactttctgttggtgtatcccccccctgtatakttaggatagcatttttgatttatgcatggaaacctgaaaaaaagtttacaagtgtatatcagaaaagggaagttgtgccttttatagctattactgtctg

SEQ ID NO: 9302 - DNA, 201 bp, Homo sapiens
ctggaatgaacctggaagctcgaaaaacaaagaaaaaaataaaaggaattcagcaggccactacaggagtctcacaagaaacctctgaaaatcctggtaasaaaacaatagttcctgcaacgttaccacaactcacccctaccctggtgtcactgttggaggttattgaacctgaagtgttatatgcaggatatgatagct

SEQ ID NO: 9303 - DNA, 201 bp, Homo sapiens
taccactatgacatgaatacagcatccctttctcaacagcaggatcagaagcctatttttaatgtcattccaccaattcccgttggttccgaaaattggartaggtgccaaggatctggagatgacaacttgacttctctggggactctgaacttccctggtcgaacagttttttctaatggctattcaagccccagcatg

SEQ ID NO: 9304 - DNA, 201 bp, Homo sapiens
acatgctgtatgtttcctctgagttacacaggcttcaggtatcttatgaagagtatctctgtatgaaaaccttactgcttctctcttcagttcctaaggayggtctgaagagccaagagctatttgatgaaattagaatgacctacatcaaagagctaggaaaagccattgtcaagagggaaggaaactccagccagaact

SEQ ID NO: 9305 - DNA, 201 bp, Homo sapiens
cgactccccccgggcccaaattgatattcactgatggactccaaagaatcattaactcctggtagagaagaaaaccccagcagtgtgcttgctcaggagargggagatgtgatggacttctataaaaccctaagaggaggagctactgtgaaggtttctgcgtcttcaccctcactggctgtcgcttctcaatcagactcc

SEQ ID NO: 9306 - DNA, 201 bp, Homo sapiens; identical to SEQ ID NO: 9287

SEQ ID NO: 9307 - DNA, 201 bp, Homo sapiens; identical to SEQ ID NO: 9288

SEQ ID NO: 9308 - DNA, 119 bp, Homo sapiens; identical to SEQ ID NO: 9289

SEQ ID NO: 9309 - DNA, 201 bp, Homo sapiens; identical to SEQ ID NO: 9290

SEQ ID NO: 9310 - DNA, 201 bp, Homo sapiens
gcgagcggctcctctgccagagttgatattcactgatggactccaaagaatcattaactcctggtagagaagaaaaccccagcagtgtgcttgctcaggaraggggagatgtgatggacttctataaaaccctaagaggaggagctactgtgaaggtttctgcgtcttcaccctcactggctgtcgcttctcaatcagact

SEQ ID NO: 9311 - DNA, 201 bp, Homo sapiens; identical to SEQ ID NO: 9292

SEQ ID NO: 9312 - DNA, 201 bp, Homo sapiens; identical to SEQ ID NO: 9293

SEQ ID NO: 9313 - DNA, 201 bp, Homo sapiens; identical to SEQ ID NO: 9294

SEQ ID NO: 9314 - DNA, 201 bp, Homo sapiens; identical to SEQ ID NO: 9295

SEQ ID NO: 9315 - DNA, 201 bp, Homo sapiens; identical to SEQ ID NO: 9296

SEQ ID NO: 9316 - DNA, 201 bp, Homo sapiens; identical to SEQ ID NO: 9297

SEQ ID NO: 9317 - DNA, 201 bp, Homo sapiens; identical to SEQ ID NO: 9298

SEQ ID NO: 9318 - DNA, 201 bp, Homo sapiens; identical to SEQ ID NO: 9299

SEQ ID NO: 9319 - DNA, 201 bp, Homo sapiens; identical to SEQ ID NO: 9300

SEQ ID NO: 9320 - DNA, 201 bp, Homo sapiens; identical to SEQ ID NO: 9301

SEQ ID NO: 9321 - DNA, 201 bp, Homo sapiens; identical to SEQ ID NO: 9302

SEQ ID NO: 9322 - DNA, 201 bp, Homo sapiens; identical to SEQ ID NO: 9303

SEQ ID NO: 9323 - DNA, 201 bp, Homo sapiens; identical to SEQ ID NO: 9304

SEQ ID NO: 9324 - DNA, 201 bp, Homo sapiens
gagcggctcctctgccagagttgatattcactgatggactccaaagaatcattaactcctggtagagaagaaaaccccagcagtgtgcttgctcaggagargggagatgtgatggacttctataaaaccctaagaggaggagctactgtgaaggtttctgcgtcttcaccctcactggctgtcgcttctcaatcagactcc

SEQ ID NO: 9325 - DNA, 154 bp, Homo sapiens
gaggctcctctcctagaccctgcatcctgaaagctgcgtacctgagagcctgckgtctggctgcagggacacacccaaggggaggagctgcaatcgtgtctggggccccagcccaggctggccggagctcctgtttccgctgctctgctgcctg

SEQ ID NO: 9326 - DNA, 201 bp, Homo sapiens
gctgcctgcccggggtaccaacatggcccagaagcgtcctgcctgcaccctgaagcctgagtgtgtccagcagctgctggtttgctcccaggaggccaagmagtcagcctactgcccctacagtcactttcctgtgggggctgccctgctcacccaggaggggagaatcttcaaagggtgcaacatagaaaatgcctgcta

SEQ ID NO: 9327 - DNA, 201 bp, Homo sapiens
ggtccaggagctgctgccctcctcctttgggcctgaggacctgcagaagacccagtgacagccagagaatgcccactgcctgtaacagccacctggagaayttcataaagatgtctcacagccctggggacacctgcccagtgggccccagccctacagggactgggcaaagatgatgtttccagattacactccagcctg

SEQ ID NO: 9328 - DNA, 182 bp, Homo sapiens
gaggctcctctcctagaccctgcatcctgaaagctgcgtacctgagagcctgcggtctggctgcagggacacacccaagggraggagctgcaatcgtgtctggggccccagcccaggctggccggagctcctgtttccgctgctctgctgcctgcccggggtaccaacatggcccagaagcg

SEQ ID NO: 9329 - DNA, 201 bp, Homo sapiens
cagcctactgcccctacagtcactttcctgtgggggctgccctgctcacccaggaggggagaatcttcaaagggtgcaacatagaaaatgcctgctacccrctgggcatctgtgctgaacggaccgctatccagaaggccgtctcagaagggtacaaggatttcagggcaattgctatcgccagtttggcaccaactggcc

SEQ ID NO: 9330 - DNA, 201 bp, Homo sapiens
actggcccgtgtacatgaccaagccggatggtacgtatattgtcatgacggtccaggagctgctgccctcctcctttgggcctgaggacctgcagaagacycagtgacagccagagaatgcccactgcctgtaacagccacctggagaacttcataaagatgtctcacagccctggggacacctgcccagtgggccccagc

SEQ ID NO: 9331 - DNA, 178 bp, Homo sapiens
gaggctcctctcctagaccctgcatcctgaaagctgcgtacctgagagcctgcggtctggctgcagggacacacccarggggaggagctgcaatcgtgtctggggccccagcccaggctggccggagctcctgtttccgctgctctgctgcctgcccggggtaccaacatggcccaga

SEQ ID NO: 9332 - DNA, 154 bp, Homo sapiens; identical to SEQ ID NO: 9325

SEQ ID NO: 9333 - DNA, 201 bp, Homo sapiens; identical to SEQ ID NO: 9326

SEQ ID NO: 9334 - DNA, 201 bp, Homo sapiens; identical to SEQ ID NO: 9327

SEQ ID NO: 9335 - DNA, 182 bp, Homo sapiens; identical to SEQ ID NO: 9328

SEQ ID NO: 9336 - DNA, 201 bp, Homo sapiens
cagcctactgcccctacagtcactttcctgtgggggctgccctgctcacccaggaggggagaatcttcaaagggtgcaacatagaaaatgcctgctacccrctgggcatctgtgctgaacggaccgctatccagaaggccgtctcagaagggtacaaggatttcagggcaattgctatcgccagtgacatgcaagatgatt

SEQ ID NO: 9337 - DNA, 201 bp, Homo sapiens; identical to SEQ ID NO: 9330

SEQ ID NO: 9338 - DNA, 178 bp, Homo sapiens; identical to SEQ ID NO: 9331

SEQ ID NO: 9339 - DNA, 201 bp, Homo sapiens
tgaagaactttcttaaggtagatgagggttccatggcttccttcagtgtgggtgacagccagcacctggaccggctcagcttccagagcagtaagatgacygacctgttcatccgcttcccagagaatctcttgctacaccgggtggagaacacccagggccacatcctctatgctttcttggtggagaacaaggaacgag

SEQ ID NO: 9340 - DNA, 201 bp, Homo sapiens
  misc_feature (1)...(201): n = A,T,C or G, or insertion/deletion polymorphism (see Tables 1-2)
gtggagaacacccagggccacatcctctatgctttcttggtggagaacaaggaacgagaaagtcgagtggtgcactttgctgtgctcaaggcggagacagncacctctgtggccaagatgctgagcatcttcacagagttcaactccgattggcccaaggtcaaggtggtctttgtggacccttcattccattaccgggct

SEQ ID NO: 9341 - DNA, 201 bp, Homo sapiens
agagagctcggccggcaagcatgccactgaagtccaagaaggcttttggaatctgtggagagagccttaccagcctccctgcagaagagaccaagccagaygcacagcaggtacaggtacagcagcagtcacaagtgccgccctcgcaggttggcatgctggacaccttgcaccagagtggctctgaactagcctacaagc

SEQ ID NO: 9342 - DNA, 201 bp, Homo sapiens
gacagccacctctgtggccaagatgctgagcatcttcacagagttcaactccgattggcccaaggtcaaggtggtctttgtggacccttcattccattacygggctatcctgcaggagatctttcctgctgcccgcatcctcctttccatctaccacacaacccgactcttggagaagaagttgcatcgtagttcagcaaa

SEQ ID NO: 9343 - DNA, 201 bp, Homo sapiens
cgtgggccgcctccctttcctctggggaaagcaagaagaaggggagggattccctcctgctacagctgtgatgcattattgaagcactttagctgaagcaytggaccacaaacacttctccttggaagtgtgagagtttaaagtgggcaggacatactagggtttagcattttagccaatgtcttcctaggtggggctagg

SEQ ID NO: 9344 - DNA, 201 bp, Homo sapiens
tcctttccatctaccacacaacccgactcttggagaagaagttgcatcgtagttcagcaaatccatcctttaaaaggctcatgaaggaagccctgcgggargccgtgtttgtcacttctgaagccagcctgaaaaatctctgccagatgtcccaggccgtactggatgaggatctcttcaacttcctgcaggcccactggt

SEQ ID NO: 9345 - DNA, 201 bp, Homo sapiens
aggcttttggaatctgtggagagagccttaccagcctccctgcagaagagaccaagccagacgcacagcaggtacaggtacagcagcagtcacaagtgccrccctcgcaggttggcatgctggacaccttgcaccagagtggctctgaactagcctacaagctgtgccacaatgagtgggaggtggtacagaactccaccc

SEQ ID NO: 9346 - DNA, 201 bp, Homo sapiens
  misc_feature (1)...(201): n = A,T,C or G, or insertion/deletion polymorphism (see Tables 1-2)
aactgctgtggtacatgcatgttaggaagggcctgcttgcgtgtaacacctacatggacagcctagacattgtcaccagcaaggtgtcaagcctctttcgngaacagcagtcgctgctggactgcatcctctgctttgtggattacatagacttctttaataccaaaggcttgaagaacttgcccacacctcctcccaaat

SEQ ID NO: 9347 - DNA, 201 bp, Homo sapiens; identical to SEQ ID NO: 9345

SEQ ID NO: 9348 - DNA, 201 bp, Homo sapiens; identical to SEQ ID NO: 9346
  misc_feature (1)...(201): n = A,T,C or G, or insertion/deletion polymorphism (see Tables 1-2)

SEQ ID NO: 9349 - DNA, 201 bp, Homo sapiens; identical to SEQ ID NO: 9342

SEQ ID NO: 9350 - DNA, 201 bp, Homo sapiens
tcctttccatctaccacacaacccgactcttggagaagaagttgcatcgtagttcagcaaatccatcctttaaaagtctcatgaaggaagccctgcgggargccgtgtttgtcacttctgaagccagcctgaaaaatctctgccagatgtcccaggccgtactggatgaggatctcttcaacttcctgcaggcccactggt

SEQ ID NO: 9351 - DNA, 201 bp, Homo sapiens
cgtgggccgcctccctttcctctggggaaagcaagaggaaggggagggattccctcctgctacagctgtgatgcattattgaagcactttagctgaagcaytggaccacaaacacttctccttggaagtgtgagagtttaaagtgggcaggacatactagggtttagcattttagccaatgtcttcctaggtggggctagg

SEQ ID NO: 9352 - DNA, 201 bp, Homo sapiens; identical to SEQ ID NO: 9341

SEQ ID NO: 9353 - DNA, 201 bp, Homo sapiens; identical to SEQ ID NO: 9340
  misc_feature (1)...(201): n = A,T,C or G, or insertion/deletion polymorphism (see Tables 1-2)

SEQ ID NO: 9354 - DNA, 201 bp, Homo sapiens; identical to SEQ ID NO: 9339

SEQ ID NO: 9355 - DNA, 201 bp, Homo sapiens
cagaggcagctgtggtgggccaccctcatcctgtgaagggtgaatgcctctactgctttgtcaccttgtgtgatggccacaccttcagccccaagctcacygaggagctcaagaagcagattagagaaaagattggccccattgccacaccagactacatccagaatgcacctggcttgcctaaaacccgctcagggaaaa

SEQ ID NO: 9356 - DNA, 201 bp, Homo sapiens
ggtgcacggcagacattggttggatcactggtcattcctacgtcacctatgggccactggccaatggtgccaccagtgttttgtttgaggggattcccacrtatccggacgtgaaccgcctgtggagcattgtggacaaatacaaggtgaccaagttctacacagcacccacagccatccgtctgctcatgaagtttggag

SEQ ID NO: 9357 - DNA, 201 bp, Homo sapiens
gaggcagctgtgtaatcctatgtcagctctcttaggaagccccagtacttatattgggcatgcacttgcccttaaaaacaatgatttgtgagtccaggaayaatttactatttttaaaatattttgctgcttctgttctgggtctgaattcccttttgtgccagatgccagtactgtctgcccattggctccaggggctgt

SEQ ID NO: 9358 - DNA, 201 bp, Homo sapiens
  misc_feature (1)...(201): n = A,T,C or G, or insertion/deletion polymorphism (see Tables 1-2)
gggaattctggggagacattgccaaggaattttactggaagactccatgccctggcccattccttcggtacaactttgatgtgactaaagggaaaatcttnattgagtggatgaaaggagcaactaccaacatctgctacaatgtactggatcgaaatgtccatgagaaaaagcttggagataaagttgctttttactggg

SEQ ID NO: 9359 - DNA, 201 bp, Homo sapiens
attgatgacatgctcaatgtatctggacacctgctgagtacagcagaggtggagtcagcacttgtggaacatgaggctgttgcagaggcagctgtggtggsccaccctcatcctgtgaagggtgaatgcctctactgctttgtcaccttgtgtgatggccacaccttcagccccaagctcaccgaggagctcaagaagcag

SEQ ID NO: 9360 - DNA, 201 bp, Homo sapiens
  misc_feature (1)...(201): n = A,T,C or G, or insertion/deletion polymorphism (see Tables 1-2)
aggagaagggtttcccagtaagatgctgcattgtggtcaagcacctggggcgggcagagctcggcatgggtgactccaccagccagtcccccccaattaanaggtcatgcccagatgtgcagatctcatggaaccaagggattgacttgtggtggcatgagctcatgcaagaggcaggggatgagtgtgagcccgagtggt

SEQ ID NO: 9361 - DNA, 201 bp, Homo sapiens; identical to SEQ ID NO: 9355

SEQ ID NO: 9362 - DNA, 201 bp, Homo sapiens; identical to SEQ ID NO: 9356

SEQ ID NO: 9363 - DNA, 201 bp, Homo sapiens
gaggcagctgtgtaatcctatgtcagctctcttaggaagccccagtacttatattgggcatgcacttgcccttaaaaacaatgatttgtgagtccaggaayaatttactatttttaaaatattttgctgcttctgttctgggtctgaattcccttttgtgccagatgccaattcagtctccagagggtattcagatcatct

SEQ ID NO: 9364 - DNA, 201 bp, Homo sapiens; identical to SEQ ID NO: 9358
  misc_feature (1)...(201): n = A,T,C or G, or insertion/deletion polymorphism (see Tables 1-2)

SEQ ID NO: 9365 - DNA, 201 bp, Homo sapiens; identical to SEQ ID NO: 9359

SEQ ID NO: 9366 - DNA, 201 bp, Homo sapiens
  misc_feature (1)...(201): n = A,T,C or G, or insertion/deletion polymorphism (see Tables 1-2)
aggagaagggtttcccagtaagatgctgcattgtggtcaagcacctggggcgggcagagctcggcatgggtgactccaccagccagtcccccccaattaanaggtcatgcccagatgtgcagggtgtggttcacacagttgggggctacatgctctatgtagccacaaccttcaagtatgtgtttgacttccatgcagagg

SEQ ID NO: 9367 - DNA, 201 bp, Homo sapiens; identical to SEQ ID NO: 9355

SEQ ID NO: 9368 - DNA, 201 bp, Homo sapiens; identical to SEQ ID NO: 9356

SEQ ID NO: 9369 - DNA, 201 bp, Homo sapiens; identical to SEQ ID NO: 9357

SEQ ID NO: 9370 - DNA, 201 bp, Homo sapiens; identical to SEQ ID NO: 9358
  misc_feature (1)...(201): n = A,T,C or G, or insertion/deletion polymorphism (see Tables 1-2)

SEQ ID NO: 9371 - DNA, 201 bp, Homo sapiens; identical to SEQ ID NO: 9359

SEQ ID NO: 9372 - DNA, 201 bp, Homo sapiens; identical to SEQ ID NO: 9366
  misc_feature (1)...(201): n = A,T,C or G, or insertion/deletion polymorphism (see Tables 1-2)

SEQ ID NO: 9373 - DNA, 201 bp, Homo sapiens; identical to SEQ ID NO: 9355

SEQ ID NO: 9374 - DNA, 201 bp, Homo sapiens; identical to SEQ ID NO: 9356

SEQ ID NO: 9375 - DNA, 201 bp, Homo sapiens; identical to SEQ ID NO: 9363

SEQ ID NO: 9376 - DNA, 201 bp, Homo sapiens; identical to SEQ ID NO: 9358
  misc_feature (1)...(201): n = A,T,C or G, or insertion/deletion polymorphism (see Tables 1-2)

SEQ ID NO: 9377 - DNA, 201 bp, Homo sapiens; identical to SEQ ID NO: 9359

SEQ ID NO: 9378 - DNA, 201 bp, Homo sapiens; identical to SEQ ID NO: 9360
  misc_feature (1)...(201): n = A,T,C or G, or insertion/deletion polymorphism (see Tables 1-2)

SEQ ID NO: 9379 - DNA, 201 bp, Homo sapiens; identical to SEQ ID NO: 9355

SEQ ID NO: 9380 - DNA, 201 bp, Homo sapiens; identical to SEQ ID NO: 9356

SEQ ID NO: 9381 - DNA, 201 bp, Homo sapiens; identical to SEQ ID NO: 9357

SEQ ID NO: 9382 - DNA, 201 bp, Homo sapiens; identical to SEQ ID NO: 9359

SEQ ID NO: 9383 - DNA, 201 bp, Homo sapiens; identical to SEQ ID NO: 9358
  misc_feature (1)...(201): n = A,T,C or G, or insertion/deletion polymorphism (see Tables 1-2)

SEQ ID NO: 9384 - DNA, 201 bp, Homo sapiens; identical to SEQ ID NO: 9360
  misc_feature (1)...(201): n = A,T,C or G, or insertion/deletion polymorphism (see Tables 1-2)

SEQ ID NO: 9385 - DNA, 201 bp, Homo sapiens; identical to SEQ ID NO: 9355

SEQ ID NO: 9386 - DNA, 201 bp, Homo sapiens; identical to SEQ ID NO: 9356

SEQ ID NO: 9387 - DNA, 201 bp, Homo sapiens; identical to SEQ ID NO: 9363

SEQ ID NO: 9388 - DNA, 201 bp, Homo sapiens
  misc_feature (1)...(201): n = A,T,C or G, or insertion/deletion polymorphism (see Tables 1-2)
gggaattctggggagacattgccaaggaattttactggaagactccatgccctggcccattccttcggtacaactttgatgtgactaaagggaaaatcttnattgagtggatgaaaggagcaactaccaacatctgctacaatgtactggatcgaaatgtccatgagaaaaagcttggagataaagttgctttttactggt

SEQ ID NO: 9389 - DNA, 201 bp, Homo sapiens; identical to SEQ ID NO: 9359

SEQ ID NO: 9390 - DNA, 201 bp, Homo sapiens; identical to SEQ ID NO: 9360
  misc_feature (1)...(201): n = A,T,C or G, or insertion/deletion polymorphism (see Tables 1-2)

SEQ ID NO: 9391 - DNA, 201 bp, Homo sapiens
ctacaaccccaccacaagtctatagaaccacttccccaccttttgggaaaaccaccaccgttgaatacgagggggagtacgaatacacgggcgccaatgawtacgacaatggatatgaaatctatgaaagtgagaacggggaacctcgtggggacaattaccgagcctatgaagatgagtacagctactttaaaggacaag

SEQ ID NO: 9392 - DNA, 133 bp, Homo sapiens
gagtgagtgagagggcagaggaaatactcaatstgtgccactcactgccttgagcctgcttcctcactccaggactgccagagggaagcaatcaccaaaatgaagactgctttaattttgctcagcattttgg

SEQ ID NO: 9393 - DNA, 201 bp, Homo sapiens
  misc_feature (1)...(201): n = A,T,C or G, or insertion/deletion polymorphism (see Tables 1-2)
tttgaacctacaaccccaccacaagtctatagaaccacttccccaccttttgggaaaaccaccaccgttgaatacgagggggagtacgaatacacgggcgncaatgattacgacaatggatatgaaatctatgaaagtgagaacggggaacctcgtggggacaattaccgagcctatgaagatgagtacagctactttaaa

SEQ ID NO: 9394 - DNA, 201 bp, Homo sapiens
ctgctacaacactgggctatggagaggacgccacgcctggcacagggtatacagggttagctgcaatccagcttcccaagaaggctggggatataacaaayaaagctacaaaagagaaggaaagtgatgaagaagaagaggaggaagaggaaggaaatgaaaacgaagaaagcgaagcagaagtggatgaaaacgaacaag

SEQ ID NO: 9395 - DNA, 201 bp, Homo sapiens
aacgaagaaagcgaagcagaagtggatgaaaacgaacaaggcataaacggcaccagtaccaacagcacagaggcagaaaacggcaacggcagcagcggagragacaatggagaagaaggggaagaagaaagtgtcactggagccaatgcagaaggcaccacagagaccggaaggcagggcaagggcacctcgaagacaaca

SEQ ID NO: 9396 - DNA, 201 bp, Homo sapiens
ccgagcctatgaagatgagtacagctactttaaaggacaaggctacgatggctatgatggtcagaattactaccaccaccagtgaagctccagcctgggakgaattcatccattctggctttgcatccggctaccattttcgaagttcaactcaggaaggtgcaatataacaaatgtgcatattataatgaggaatggtac

SEQ ID NO: 9397 - DNA, 116 bp, Homo sapiens
gagtgagtgagagggmagaggaaatactcaatctgtgccactcactgccttgagcctgcttcctcactccaggactgccagagggaagcaatcaccaaaatgaagactgctttaat

SEQ ID NO: 9398 - DNA, 201 bp, Homo sapiens
gggcacctcgaagacaacaacctctccaaatggtgggtttgaacctacaaccccaccacaagtctatagaaccacttccccaccttttgggaaaaccaccrccgttgaatacgagggggagtacgaatacacgggcgccaatgattacgacaatggatatgaaatctatgaaagtgagaacggggaacctcgtggggacaa

SEQ ID NO: 9399 - DNA, 201 bp, Homo sapiens
ggcagaaaacggcaacggcagcagcggagaagacaatggagaagaaggggaagaagaaagtgtcactggagccaatgcagaaggcaccacagagaccggarggcagggcaagggcacctcgaagacaacaacctctccaaatggtgggtttgaacctacaaccccaccacaagtctatagaaccacttccccaccttttgg

SEQ ID NO: 9400 - DNA, 201 bp, Homo sapiens
agtaccaacagcacagaggcagaaaacggcaacggcagcagcggagaagacaatggagaagaaggggaagaagaaagtgtcactggagccaatgcagaagrcaccacagagaccggaaggcagggcaagggcacctcgaagacaacaacctctccaaatggtgggtttgaacctacaaccccaccacaagtctatagaacc

SEQ ID NO: 9401 - DNA, 201 bp, Homo sapiens
cattttcgaagttcaactcaggaaggtgcaatataacaaatgtgcatattataatgaggaatggtactaccgttccagattttctgtaattgcttctgcaragtaataggcttcttgtcccttttttttctggcatgttatggaatgatcattgtaaatcaggaccatttatcaagcagtacaccaactcataagatcaaa

SEQ ID NO: 9402 - DNA, 201 bp, Homo sapiens; identical to SEQ ID NO: 9395

SEQ ID NO: 9403 - DNA, 201 bp, Homo sapiens; identical to SEQ ID NO: 9394

SEQ ID NO: 9404 - DNA, 201 bp, Homo sapiens; identical to SEQ ID NO: 9391

SEQ ID NO: 9405 - DNA, 201 bp, Homo sapiens; identical to SEQ ID NO: 9396

SEQ ID NO: 9406 - DNA, 105 bp, Homo sapiens
caatstgtgccactcactgccttgagcctgcttcctcactccaggactgccagaggtccagaagcaatcaccaaaatgaagactgctttaattttgctcagcatt

SEQ ID NO: 9407 - DNA, 201 bp, Homo sapiens; identical to SEQ ID NO: 9398

SEQ ID NO: 9408 - DNA, 201 bp, Homo sapiens; identical to SEQ ID NO: 9399

SEQ ID NO: 9409 - DNA, 201 bp, Homo sapiens; identical to SEQ ID NO: 9400

SEQ ID NO: 9410 - DNA, 201 bp, Homo sapiens; identical to SEQ ID NO: 9401

SEQ ID NO: 9411 - DNA, 201 bp, Homo sapiens; identical to SEQ ID NO: 9393
  misc_feature (1)...(201): n = A,T,C or G, or insertion/deletion polymorphism (see Tables 1-2)

SEQ ID NO: 9412 - DNA, 201 bp, Homo sapiens
ggcagaaaacggcaacggcagcagcggaggagacaatggagaagaaggggaagaagaaagtgtcactggagccaatgcagaaggcaccacagagaccggarggcagggcaagggcacctcgaagacaacaacctctccaaatggtgggtttgaacctacaaccccaccacaagtctatagaaccacttccccaccttttgg

SEQ ID NO: 9413 - DNA, 201 bp, Homo sapiens
agtaccaacagcacagaggcagaaaacggcaacggcagcagcggaggagacaatggagaagaaggggaagaagaaagtgtcactggagccaatgcagaagrcaccacagagaccggagggcagggcaagggcacctcgaagacaacaacctctccaaatggtgggtttgaacctacaaccccaccacaagtctatagaacc

SEQ ID NO: 9414 - DNA, 201 bp, Homo sapiens
ctacaaccccaccacaagtctatagaaccacttccccaccttttgggaaaaccaccaccgttgaatacgagggggagtacgaatacacgggcgtcaatgawtacgacaatggatatgaaatctatgaaagtgagaacggggaacctcgtggggacaattaccgagcctatgaagatgagtacagctactttaaaggacaag

SEQ ID NO: 9415 - DNA, 201 bp, Homo sapiens
  misc_feature (1)...(201): n = A,T,C or G, or insertion/deletion polymorphism (see Tables 1-2)
tttgaacctacaaccccaccacaagtctatagaaccacttccccaccttttgggaaaaccaccaccgttgaatacgagggggagtacgaatacacgggcgncaatgaatacgacaatggatatgaaatctatgaaagtgagaacggggaacctcgtggggacaattaccgagcctatgaagatgagtacagctactttaaa

SEQ ID NO: 9416 - DNA, 201 bp, Homo sapiens
aacgaagaaagcgaagcagaagtggatgaaaacgaacaaggcataaacggcaccagtaccaacagcacagaggcagaaaacggcaacggcagcagcggagragacaatggagaagaaggggaagaagaaagtgtcactggagccaatgcagaaggcaccacagagaccggagggcagggcaagggcacctcgaagacaaca

SEQ ID NO: 9417 - DNA, 201 bp, Homo sapiens; identical to SEQ ID NO: 9394

SEQ ID NO: 9418 - DNA, 201 bp, Homo sapiens
gggcacctcgaagacaacaacctctccaaatggtgggtttgaacctacaaccccaccacaagtctatagaaccacttccccaccttttgggaaaaccaccrccgttgaatacgagggggagtacgaatacacgggcgtcaatgaatacgacaatggatatgaaatctatgaaagtgagaacggggaacctcgtggggacaa

SEQ ID NO: 9419 - DNA, 201 bp, Homo sapiens
cctctaagaatctcacaggacctcttagtctctgccctatacgccgccttcactccacagcctcacccctcccacccccatactggtactgctgtaatgasccaagtggcagctaaaagttgggggtgttctgcccagtcccgtcattctgggctagaaggcaggggaccttggcatgtggctggccacaccaagcaggaa

SEQ ID NO: 9420 - DNA, 201 bp, Homo sapiens
acttccccaccgaggccatgggcccaggagttctgctgctcctgctggtggccacagcttggcatggtcagggaatcccagtgatagagcccagtgtcccygagctggtcgtgaagccaggagcaacggtgaccttgcgatgtgtgggcaatggcagcgtggaatgggatggccccccatcacctcactggaccctgtact

SEQ ID NO: 9421 - DNA, 201 bp, Homo sapiens
ccaggcctgcaaggttttaactggacctacctgggacccttttctgaccaccagcctgagcccaagcttgctaatgctaccaccaaggacacatacaggcrcaccttcaccctctctctgccccgcctgaagccctctgaggctggccgctactccttcctggccagaaacccaggaggctggagagctctgacgtttgag

SEQ ID NO: 9422 - DNA, 143 bp, Homo sapiens
attctgggctagaaggcaggggaccttggcatgtggctggccacaccaagcaggaagcacaaactcccccaagctgactcatcctaactaacagtcacgcmgtgggatgtctctgtccacattaaactaacagcattaatgca

SEQ ID NO: 9423 - DNA, 201 bp, Homo sapiens
tcaactttctgcgaaggaaggctgaggccatgctgggacccagcctgagccccggccaggaccccgagggaggcgtcgactataagaacatccacctcgaraagaaatatgtccgcagggacagtggcttctccagccagggtgtggacacctatgtggagatgaggcctgtctccacttcttcaaatgactccttctctg

SEQ ID NO: 9424 - DNA, 201 bp, Homo sapiens
ccagcagcatcctcagcaccaacaacgctaccttccaaaacacggggacctatcgctgcactgagcctggagaccccctgggaggcagcgccgccatccayctctatgtcaaagaccctgcccggccctggaacgtgctagcacaggaggtggtcgtgttcgaggaccaggacgcactactgccctgtctgctcacagacc

SEQ ID NO: 9425 - DNA, 201 bp, Homo sapiens
ggccctggaacgtgctagcacaggaggtggtcgtgttcgaggaccaggacgcactactgccctgtctgctcacagacccggtgctggaagcaggcgtctcrctggtgcgtgtgcgtggccggcccctcatgcgccacaccaactactccttctcgccctggcatggcttcaccatccacagggccaagttcattcagagcc

SEQ ID NO: 9426 - DNA, 201 bp, Homo sapiens
ctgcagagctggtgcggattcgaggggaggctgcccagatcgtgtgctcagccagcagcgttgatgttaactttgatgtcttcctccaacacaacaacacyaagctcgcaatccctcaacaatctgactttcataataaccgttaccaaaaagtcctgaccctcaacctcgatcaagtagatttccaacatgccggcaact

SEQ ID NO: 9427 - DNA, 201 bp, Homo sapiens
cctgctgcgagcaaggggatatcgcccagcccttgctgcagcccaacaactatcagttctgctgaggagttgacgacagggagtaccactctcccctcctmcaaacttcaactcctccatggatggggcgacacggggagaacatacaaactctgccttcggtcatttcactcaacagctcggcccagctctgaaacttgg

SEQ ID NO: 9428 - DNA, 201 bp, Homo sapiens
gctggtgcggattcgaggggaggctgcccagatcgtgtgctcagccagcagcgttgatgttaactttgatgtcttcctccaacacaacaacaccaagctckcaatccctcaacaatctgactttcataataaccgttaccaaaaagtcctgaccctcaacctcgatcaagtagatttccaacatgccggcaactactcctg

SEQ ID NO: 9429 - DNA, 201 bp, Homo sapiens
agatctccctctctgagaggagcagcagatgctcacagaccacactcagctcaggccccttggagcaggatggctcctctaagaatctcacaggacctctyagtctctgccctatacgccgccttcactccacagcctcacccctcccacccccatactggtactgctgtaatgagccaagtggcagctaaaagttggggg

SEQ ID NO: 9430 - DNA, 201 bp, Homo sapiens
acctgctgcgagcaaggggatatcgcccagcccttgctgcagcccaacaactatcagttctgctgaggagttgacgacagggagtaccactctcccctccyccaaacttcaactcctccatggatggggcgacacggggagaacatacaaactctgccttcggtcatttcactcaacagctcggcccagctctgaaacttg

SEQ ID NO: 9431 - DNA, 201 bp, Homo sapiens
ggcagcagcagcagtgagctggaggaggagagctctagtgagcacctgacctgctgcgagcaaggggatatcgcccagcccttgctgcagcccaacaactrtcagttctgctgaggagttgacgacagggagtaccactctcccctcctccaaacttcaactcctccatggatggggcgacacggggagaacatacaaact

SEQ ID NO: 9432 - DNA, 201 bp, Homo sapiens; identical to SEQ ID NO: 9419

SEQ ID NO: 9433 - DNA, 201 bp, Homo sapiens; identical to SEQ ID NO: 9420

SEQ ID NO: 9434 - DNA, 201 bp, Homo sapiens; identical to SEQ ID NO: 9421

SEQ ID NO: 9435 - DNA, 143 bp, Homo sapiens; identical to SEQ ID NO: 9422

SEQ ID NO: 9436 - DNA, 201 bp, Homo sapiens; identical to SEQ ID NO: 9423

SEQ ID NO: 9437 - DNA, 201 bp, Homo sapiens; identical to SEQ ID NO: 9424

SEQ ID NO: 9438 - DNA, 201 bp, Homo sapiens; identical to SEQ ID NO: 9425

SEQ ID NO: 9439 - DNA, 201 bp, Homo sapiens; identical to SEQ ID NO: 9426

SEQ ID NO: 9440 - DNA, 201 bp, Homo sapiens; identical to SEQ ID NO: 9427

SEQ ID NO: 9441 - DNA, 201 bp, Homo sapiens; identical to SEQ ID NO: 9428

SEQ ID NO: 9442 - DNA, 201 bp, Homo sapiens; identical to SEQ ID NO: 9429

SEQ ID NO: 9443 - DNA, 201 bp, Homo sapiens; identical to SEQ ID NO: 9430

SEQ ID NO: 9444 - DNA, 201 bp, Homo sapiens; identical to SEQ ID NO: 9431

SEQ ID NO: 9445 - DNA, 201 bp, Homo sapiens
gaaagacgttccagggaatttgcaggtactcatgtggcacaaagaaccagaggctgactgcattaatgctgttagtttaatgtggacagagacatcccackgcgtgactgttagttaggatgagtcagcttgggggagtttgtgcttcctgcttggtgtggccagccacatgccaagaacagtaggggaggcggggggtga

SEQ ID NO: 9446 - DNA, 201 bp, Homo sapiens
  misc_feature (1)...(201): n = A,T,C or G, or insertion/deletion polymorphism (see Tables 1-2)
acctcttctggccccgagagagcacttgggggacacggtatgtttaatggaggggaggctgagggaaaggctggtagctggtgggttccgtggggcctgcngtgtgggtcagggtggaggtcctgggtgggctaaggcgtgagccccagcactaggtgggaaggctgctgaggtctctcccacccctgaggagccctggtt

SEQ ID NO: 9447 - DNA, 201 bp, Homo sapiens
  misc_feature (1)...(201): n = A,T,C or G, or insertion/deletion polymorphism (see Tables 1-2)
tccaggggtcaggagtggtaccaggaaacctcttctggccccgagagagcacttgggggacacggtatgtttaatggaggggaggctgagggaaaggctgntagctggtgggttccgtggggcctgctgtgtgggtcagggtggaggtcctgggtgggctaaggcgtgagccccagcactaggtgggaaggctgctgaggt

SEQ ID NO: 9448 - DNA, 201 bp, Homo sapiens
cagtcactaagacgccagtcgtcaaaagtggtgtgcagcctgaggtcactctggggacaactgacaatgacagtcctggagcagacgtaccaacaccatcygaggggacaagtacctccagtccactccctgctcctaaaaaacctacaggagctgacctgcttacccctgggtccagagctccagagcttaaaggcagag

SEQ ID NO: 9449 - DNA, 201 bp, Homo sapiens
atggacttcctcaccagccgcgaaattgtcaatcgtcagatccatgacattgtacagagctgccagcctggtgaggtggtcattcgtgacaccctctaccrccttggggttgctcagatcaagacagagacagaggaggagggtgaggaagaggaggtggccgcagtggcagaataagccaggctgttgtacagggactac

SEQ ID NO: 9450 - DNA, 201 bp, Homo sapiens
ctccaggggtcaggagtggtaccaggaaacctcttctggccccgagagagcacttgggggacacggtatgtttaatggaggggaggctgagggaaaggctsgtagctggtgggttccgtggggcctgctgtgtgggtcagggtggaggtcctgggtgggctaaggcgtgagccccagcactaggtgggaaggctgctgagg

SEQ ID NO: 9451 - DNA, 201 bp, Homo sapiens
  misc_feature (1)...(201): n = A,T,C or G, or insertion/deletion polymorphism (see Tables 1-2)
gggacaactgacaatgacagtcctggagcagacgtaccaacaccatccgaggggacaagtacctccagtccactccctgctcctaaaaaacctacaggagntgacctgcttacccctgggtccagagctccagagcttaaaggcagagcacggggcaagccctcattactggctgcagcaagacccatgagagcaattttg

SEQ ID NO: 9452 - DNA, 201 bp, Homo sapiens
gcccagagctcttggaccagcattatactgtggacatgacagaaactgagcactctatccagcacccagtcaccaagactgccacgcggcgcatcgtccaygcaggcctacagcccaatcctggtgaccccagtgctgggcaccactccttggccctgtgccctgaattggcaccttacgcaaccatcctggcctccatcg

SEQ ID NO: 9453 - DNA, 201 bp, Homo sapiens
aaaaacctacaggagctgacctgcttacccctgggtccagagctccagagcttaaaggcagagcacggggcaagccctcattactggctgcagcaagaccyatgagagcaattttgccagccccagttaacgtggggcgaggcagcagcatgggactgcccagggccaggcaggccttttccctgagtgataagactccct

SEQ ID NO: 9454 - DNA, 201 bp, Homo sapiens
ttgtcaatcgtcagatccatgacattgtacagagctgccagcctggtgaggtggtcattcgtgacaccctctaccgccttggggttgctcagatcaagacrgagacagaggaggagggtgaggaagaggaggtggccgcagtggcagaataagccaggctgttgtacagggactacaccatctctcaagccatagtaaggc

SEQ ID NO: 9455 - DNA, 201 bp, Homo sapiens
acgctcctccggccatggacgcatcatatgatggtactgaggtaactgtcgtgatggaggaaattgaggaagcctattgttacacctctcctgggccaccyaagaagaagaaaaagtataaaatacatggagaaaagacaaagaaacccaggtctgcttaccttctgtactattacgacatctacctgaaagtgcagcagg

SEQ ID NO: 9456 - DNA, 201 bp, Homo sapiens
agtgaggagacagtcaccatcgagcaaacctcttggtcgaattattatgagtctccgtccacgcagtgccttctctgtagcagcccattattcaaaggggracaaaactccctggctgggccccaggagtgctggctgctgacagccagccgtctgcagacagtgactgcccaggtgaagatgtgtctgaacccccattgt

SEQ ID NO: 9457 - DNA, 201 bp, Homo sapiens
gaattgtggtacagcagtcactaagacgccagtcgtcaaaagtggtgtgcagcctgaggtcactctggggacaactgacaatgacagtcctggagcagacktaccaacaccatccgaggggacaagtacctccagtccactccctgctcctaaaaaacctacaggagctgacctgcttacccctgggtccagagctccaga

SEQ ID NO: 9458 - DNA, 201 bp, Homo sapiens
ctcccacgctcagattatatcatcatccccaagagcagcctgcaggaggaccggagctgccctcagctagagctatgtgtggctcagaaccagatgtcccygaaaggacctcctcttgtgtccaacactgccccggagacagtgcccagccatgcaggcatggcagagcagtgcctggctgtggaggccctggctgaggag

SEQ ID NO: 9459 - DNA, 201 bp, Homo sapiens
ctctggagaattcggaagctgtaagccagctcctgaacgtagctcctcccagagaagtaggtgaggagagtgagtgggaggaagtgatcatctccgatgcycatgttttggttaaggaagctcccgggaattgtggtacagcagtcactaagacgccagtcgtcaaaagtggtgtgcagcctgaggtcactctggggacaa

SEQ ID NO: 9460 - DNA, 201 bp, Homo sapiens
ttaccagacaagcctggtaattgaagagaccttggtgaatggctcaccagacctccccactggaagcctggctgtgccccacccccaggttggggagagtrtatcagtggtaacagtcatgagggattccagtgagagtagctcctctgcaccagccacacagttcatcatgttgcctctgcctgcctactcggttgtgga

SEQ ID NO: 9461 - DNA, 201 bp, Homo sapiens
  misc_feature (1)...(201): n = A,T,C or G, or insertion/deletion polymorphism (see Tables 1-2)
gctattgggcctttgagtgcctcactgtccgagactacaatgacatgatctgtggcatctgtggtgtggcccccaaagtggaaatggctcagaggagtgangagaatgtgctagcactgaagagcgtggagttcacctggcctgaattcctgggctctaatgaggtaaatgtggaggacttttgggccacgatggagacag

SEQ ID NO: 9462 - DNA, 201 bp, Homo sapiens
cagcagcatgggactgcccagggccaggcaggccttttccctgagtgataagactccctctgtgaggacttgtggtctgaagccaagcacactgaagcagytgggccagcccattcaacagccatctggccctggtgaggtgaagctaccaagtggcccatccaacaggacttctcaggtgaaagttgtggaggtcaagcc

SEQ ID NO: 9463 - DNA, 201 bp, Homo sapiens
gaattctccaaccaatatttcctcactattgaaccaggagtcagctgtactagcaactgctccaaggatagatgatgaaatcccccctccacttcctgtayggacacctgaatcatttattgtggttgaggaagctggagaattctcaccaaatgttcccaaatccttatcctcagctgtgaaggtaaaaattggaacatc

SEQ ID NO: 9464 - DNA, 201 bp, Homo sapiens
ggctgtggaaggactggtgttatttgtgctattgattatacatggatgttgctaaaagatgggataattcctgagaacttcagtgttttcagtttgatccrggaaatgcggacacagaggccttcattagttcaaacgcaggaacaatatgaactggtctacaatgctgtattagaactatttaagagacagatggatgtt

SEQ ID NO: 9465 - DNA, 201 bp, Homo sapiens
gcaagaaaattactaaagaggagtttgccaatgaatttctgaagctgaaaaggcaatctaccaagtacaaggcagacaaaacctatcctacaactgtggcygagaagcccaagaatatcaagaaaaacagatataaggatattttgccctatgattatagccgggtagaactatccctgataacctctgatgaggattcca

SEQ ID NO: 9466 - DNA, 201 bp, Homo sapiens
actctaaaagttaagttcaatagtgaaactcgaactatctaccagtttcattacaagaattggccagaccatgatgtaccttcatctatagaccctattcktgagctcatctgggatgtacgttgttaccaagaggatgacagtgttcccatatgcattcactgcagtgctggctgtggaaggactggtgttatttgtgct

SEQ ID NO: 9467 - DNA, 201 bp, Homo sapiens
atacaggatctttcagatcatgtgcaatttttatctaaccaatcagaaatactagtttaaaatgaatttctatatgaatatggatctgccataagaaaatmtagttcaactctaattttatgtagtaaataaattggcaggtaattgtttttacaaagaatccacctgacttcccctaatgcattaaaaatatttttattt

SEQ ID NO: 9468 - DNA, 201 bp, Homo sapiens
tttgtcacttgagcttatgtacagaatgctatatgagaaacacttttagaatggatttatttttcatttttgccagttatttttattttcttttacttttytacataaacataaacttcaaaaggtttgtaagatttggatctcaactaatttctacattgccagaatatactataaaaagttaaaaaaaaaacttacttt

SEQ ID NO: 9469 - DNA, 201 bp, Homo sapiens
taaataaattggcaggtaattgtttttacaaagaatccacctgacttcccctaatgcattaaaaatatttttatttaaataactttatttataacttttaraaacatgtagtattgtttaaacatcatttgttcttcagtatttttcatttggaagtccaatagggcaaattgaatgaagtattattatctgtctcttgta

SEQ ID NO: 9470 - DNA, 201 bp, Homo sapiens
gaaatactagtttaaaatgaatttctatatgaatatggatctgccataagaaaatctagttcaactctaattttatgtagtaaataaattggcaggtaatygtttttacaaagaatccacctgacttcccctaatgcattaaaaatatttttatttaaataactttatttataacttttagaaacatgtagtattgtttaa

SEQ ID NO: 9471 - DNA, 201 bp, Homo sapiens; identical to SEQ ID NO: 9463

SEQ ID NO: 9472 - DNA, 201 bp, Homo sapiens; identical to SEQ ID NO: 9464

SEQ ID NO: 9473 - DNA, 201 bp, Homo sapiens; identical to SEQ ID NO: 9465

SEQ ID NO: 9474 - DNA, 201 bp, Homo sapiens; identical to SEQ ID NO: 9466

SEQ ID NO: 9475 - DNA, 201 bp, Homo sapiens; identical to SEQ ID NO: 9467

SEQ ID NO: 9476 - DNA, 201 bp, Homo sapiens; identical to SEQ ID NO: 9468

SEQ ID NO: 9477 - DNA, 201 bp, Homo sapiens; identical to SEQ ID NO: 9469

SEQ ID NO: 9478 - DNA, 201 bp, Homo sapiens; identical to SEQ ID NO: 9470

SEQ ID NO: 9479 - DNA, 201 bp, Homo sapiens; identical to SEQ ID NO: 9465

SEQ ID NO: 9480 - DNA, 201 bp, Homo sapiens; identical to SEQ ID NO: 9467

SEQ ID NO: 9481 - DNA, 201 bp, Homo sapiens; identical to SEQ ID NO: 9468

SEQ ID NO: 9482 - DNA, 201 bp, Homo sapiens; identical to SEQ ID NO: 9469

SEQ ID NO: 9483 - DNA, 201 bp, Homo sapiens; identical to SEQ ID NO: 9470

SEQ ID NO: 9484 - DNA, 201 bp, Homo sapiens; identical to SEQ ID NO: 9463

SEQ ID NO: 9485 - DNA, 201 bp, Homo sapiens; identical to SEQ ID NO: 9464

SEQ ID NO: 9486 - DNA, 201 bp, Homo sapiens; identical to SEQ ID NO: 9465

SEQ ID NO: 9487 - DNA, 201 bp, Homo sapiens; identical to SEQ ID NO: 9466

SEQ ID NO: 9488 - DNA, 201 bp, Homo sapiens
  misc_feature (1)...(201): n = A,T,C or G, or insertion/deletion polymorphism (see Tables 1-2)
gggggtctcaggagaagcgggggcggccgagccaggagccccctctcgctccccctcaccggcggcgtcgcagccgccaacatcctgggccgctgccgccnacgaatgcagccccaactgtcccaggccctgttgagcctcttctcctgccgcctccgccgccaccttcgctggcacccgccgggcccgctgtcgctgccc

SEQ ID NO: 9489 - DNA, 201 bp, Homo sapiens
cttccggcatgttcatctctggacgaagaacggccgacaagtggagggcggaggagagactccaatgcccagcgggcagtgcgcgggcggcgcttgcgcgmtgcgcggacgggggggcggtcgggccatttaaatgtgtgtttgtgggtgaaatggctgcgcaggtcggagcggtgcgcgtagtacgggcggtggcggcgc

SEQ ID NO: 9490 - DNA, 201 bp, Homo sapiens
tgatccctacagcagatatgccaaagtcacccttcaaaagacgacgatcaatgaatgaaataaaaaatctccagtacctacctcggaccagtgaaccccgygaagttctctttgaagataggactagagctcatgctgatcatgtcggtcaggggtttgactggcagagtacggctgctgttggagttttgaaagctgtac

SEQ ID NO: 9491 - DNA, 201 bp, Homo sapiens; identical to SEQ ID NO: 9488
  misc_feature (1)...(201): n = A,T,C or G, or insertion/deletion polymorphism (see Tables 1-2)

SEQ ID NO: 9492 - DNA, 201 bp, Homo sapiens; identical to SEQ ID NO: 9489

SEQ ID NO: 9493 - DNA, 201 bp, Homo sapiens; identical to SEQ ID NO: 9490

SEQ ID NO: 9494 - DNA, 201 bp, Homo sapiens; identical to SEQ ID NO: 9489

SEQ ID NO: 9495 - DNA, 201 bp, Homo sapiens; identical to SEQ ID NO: 9488
  misc_feature (1)...(201): n = A,T,C or G, or insertion/deletion polymorphism (see Tables 1-2)

SEQ ID NO: 9496 - DNA, 201 bp, Homo sapiens; identical to SEQ ID NO: 9490

SEQ ID NO: 9497 - DNA, 201 bp, Homo sapiens
ggaggatgtttcctgccatgagagtgaaaatcactggcctagatccacatcagcagtactacatagcaatggacattgtgcctgtggacaataaaagatayagatatgtgtatcatagctccaagtggatggtggctggcaatgctgattcccctgtgcccccaagagtttatatacaccctgattctctagcttctggag

SEQ ID NO: 9498 - DNA, 201 bp, Homo sapiens
ggatgtttcctgccatgagagtgaaaatcactggcctagatccacatcagcagtactacatagcaatggacattgtgcctgtggacaataaaagatacagrtatgtgtatcatagctccaagtggatggtggctggcaatgctgattcccctgtgcccccaagagtttatatacaccctgattctctagcttctggagaca

SEQ ID NO: 9499 - DNA, 201 bp, Homo sapiens
gaaaaactgagcgcctctcaaagcactttactctgttcttctccttccaacggggcctttggagagaggcagtacctgccgtcagggatggagcacagcakgcacatgattagcccttcacccaataaccaacaggcaaccaacacttgtgatggccggcagtatggggcagttccaggctcctcctcccagatgtccgtg

SEQ ID NO: 9500 - DNA, 201 bp, Homo sapiens
ctggaagcggttccatgatattggaactgaaatgatcatcaccaaagcaggcaggaggatgtttcctgccatgagagtgaaaatcactggcctagatccamatcagcagtactacatagcaatggacattgtgcctgtggacaataaaagatacagatatgtgtatcatagctccaagtggatggtggctggcaatgctga

SEQ ID NO: 9501 - DNA, 201 bp, Homo sapiens
cctctcaaagcactttactctgttcttctccttccaacggggcctttggagagaggcagtacctgccgtcagggatggagcacagcatgcacatgattagyccttcacccaataaccaacaggcaaccaacacttgtgatggccggcagtatggggcagttccaggctcctcctcccagatgtccgtgcacatggtttaaa

SEQ ID NO: 9502 - DNA, 201 bp, Homo sapiens
cagcaagatggaagcctacggtggccagctggggtcctttcccacttcccagtttcagtatgtcatgcaggcaggcaatgctgcctccagctcctcatcascacacatgttcgggggcagccacatgcagcagagctcctacaatgccttctcccttcacaacccttacaacctgtatggatacaatttccccacttcccc

SEQ ID NO: 9503 - DNA, 201 bp, Homo sapiens
tcagtgccaaagcttccctgcgcatctgaatagacacaagtgaagcccgtgtgcgcacagtgcagaggccgagcctgtatttccaggtagacgtggacttwattgactgtgaattcatttacatgtaacttctgacatttcactctgtgcaaataaagaacatgaggatacctgtgctgcccagtggactgtctgtacaca

SEQ ID NO: 9504 - DNA, 201 bp, Homo sapiens
gccccattagtttttaaagaaatgagctgggtgggaaaagtggaaatgtaatttctggtaagcttgagctactttaatttttattctatgaaactgatatmccttgatgtgggaaacaggcaggaaaggctgtggggtgggggtgggggactggtgtggcaccgtgcaaacaaaatgacaaatttcaactcacaatctttg

SEQ ID NO: 9505 - DNA, 201 bp, Homo sapiens
ctaaagagctctgacaccacttttcatgttaagatcttcatttagctcctttactgggatttattggatgctgtaaaaaaataaatttacactggatatgygaagggtttggatctcagataaatgcattttgtggaattgattttctgaaccgaccctgctgtctgcaaaccttcctccatagccatatctagagtgatc

SEQ ID NO: 9506 - DNA, 195 bp, Homo sapiens
gagagaagcaggcccgttcttccgtggcccacttcttcctttgaacaaaggctccttggacccagtggcgggaaactggccctcccacaccccctgcctgytctgggggcagcagtctttggaggagtaataatgccaggcagcccctcactgagggccccagtctcccctgcatttcttccctgattgattgat

SEQ ID NO: 9507 - DNA, 201 bp, Homo sapiens
ccgtcagcatcacggagggtgtcaccgagaggtttaaggtctccgtgttggtcctcttcgccctggccttcctcacctgcgtcgtcttcctggttgtctayaaggtgtacaagtatgaccgcgcctgccccgatgggttcgtcctcaagaacacccagtgcatcccagaaggcttggagagctactacgcggagcaagact

SEQ ID NO: 9508 - DNA, 162 bp, Homo sapiens
tcttcctttgaacaaaggctccttggacccagtggcgggaaactggccctcccacaccccctgcctgctctgggggcagcagtctttggaggagtaataatgccaggcagcccctcactgagggccccagtctcccctgcatttcttccctgattgattgat

SEQ ID NO: 9509 - DNA, 163 bp, Homo sapiens
ttcttcctttgaacaaaggctccttggacccagtggcgggaaactggccctcccacaccccctgcctgctctgggggcagcagtctttggaggagtaataatgccaggcagcccctcactgagggccccagtctcccctgcatttcttccctgattgattgat

SEQ ID NO: 9510 - DNA, 164 bp, Homo sapiens
cttcttcctttgaacaaaggctccttggacccagtggcgggaaactggccctcccacaccccctgcctgctctgggggcagcagtctttggaggagtaataatgccaggcagcccctcactgagggccccagtctcccctgcatttcttccctgattgattgat

SEQ ID NO: 9511 - DNA, 201 bp, Homo sapiens; identical to SEQ ID NO: 9503

SEQ ID NO: 9512 - DNA, 201 bp, Homo sapiens; identical to SEQ ID NO: 9504

SEQ ID NO: 9513 - DNA, 201 bp, Homo sapiens; identical to SEQ ID NO: 9505

SEQ ID NO: 9514 - DNA, 195 bp, Homo sapiens; identical to SEQ ID NO: 9506

SEQ ID NO: 9515 - DNA, 201 bp, Homo sapiens; identical to SEQ ID NO: 9507

SEQ ID NO: 9516 - DNA, 162 bp, Homo sapiens; identical to SEQ ID NO: 9508

SEQ ID NO: 9517 - DNA, 163 bp, Homo sapiens; identical to SEQ ID NO: 9509

SEQ ID NO: 9518 - DNA, 164 bp, Homo sapiens; identical to SEQ ID NO: 9510

SEQ ID NO: 9519 - DNA, 201 bp, Homo sapiens; identical to SEQ ID NO: 9503

SEQ ID NO: 9520 - DNA, 201 bp, Homo sapiens; identical to SEQ ID NO: 9504

SEQ ID NO: 9521 - DNA, 201 bp, Homo sapiens; identical to SEQ ID NO: 9505

SEQ ID NO: 9522 - DNA, 195 bp, Homo sapiens; identical to SEQ ID NO: 9506

SEQ ID NO: 9523 - DNA, 201 bp, Homo sapiens; identical to SEQ ID NO: 9507

SEQ ID NO: 9524 - DNA, 162 bp, Homo sapiens; identical to SEQ ID NO: 9508

SEQ ID NO: 9525 - DNA, 163 bp, Homo sapiens; identical to SEQ ID NO: 9509

SEQ ID NO: 9526 - DNA, 164 bp, Homo sapiens; identical to SEQ ID NO: 9510

SEQ ID NO: 9527 - DNA, 201 bp, Homo sapiens; identical to SEQ ID NO: 9503

SEQ ID NO: 9528 - DNA, 201 bp, Homo sapiens
tgcactgtagtaagtaagtggcatagagaacgaggaaaaatggaaatgtaatttctggtaagcttgagctactttaatttttattctatgaaactgatatmccttgatgtgggaaacaggcaggaaaggctgtggggtgggggtgggggactggtgtggcaccgtgcaaacaaaatgacaaatttcaactcacaatctttg

SEQ ID NO: 9529 - DNA, 201 bp, Homo sapiens; identical to SEQ ID NO: 9505

SEQ ID NO: 9530 - DNA, 195 bp, Homo sapiens; identical to SEQ ID NO: 9506

SEQ ID NO: 9531 - DNA, 201 bp, Homo sapiens; identical to SEQ ID NO: 9507

SEQ ID NO: 9532 - DNA, 162 bp, Homo sapiens; identical to SEQ ID NO: 9508

SEQ ID NO: 9533 - DNA, 163 bp, Homo sapiens; identical to SEQ ID NO: 9509

SEQ ID NO: 9534 - DNA, 164 bp, Homo sapiens; identical to SEQ ID NO: 9510

SEQ ID NO: 9535 - DNA, 201 bp, Homo sapiens
tgaagaaaaccctgccactgaagaacgtccagaaaaaattttggctgaaacacaacctgaattgggaacgtggggagatggcaaaggcgaagatgagttawccccagaagaaatacaaatgtttgaacaggaaaatcagcgactaattggtgaaatgaacagcttgtttgatgaagtgagggtagcccatgctgcccctga

SEQ ID NO: 9536 - DNA, 201 bp, Homo sapiens
gacgcggaacaaggcgctgggagtggcggtgggcggcggggtcgatggcagccgggacgagctgttccgccggagcccccggcccaagggcgacttctccrgccgggcccgcgaagtgatttctcacattggcaaactgagagattttcttctggaacacaggaaagattatattaatgcttatagccataccatgtctga

SEQ ID NO: 9537 - DNA, 201 bp, Homo sapiens
ctgcgtagccctcatcaggcaagacagactgaatgcaggagtgggtgattagctgctccttgaacttgaggctgccttggcagcaggggcacagcaggcckcaagagcccctaattgtctcagggttcaaaggaagacactgacctttcccatcccggtagcttcagggaagatcatagttaataacgtctctcaacaaat

SEQ ID NO: 9538 - DNA, 201 bp, Homo sapiens
cctcctatcaatcaatcagggaagaaatgcaggggagactggggccctcagtgaggggctgcctggcattattactcctccaaagactgctgcccccagarcaggcagggggtgtgggagggccagtttcccgccactgggtccaaggagcctttgttcaaaggaagaagtgggccacggaagaacgggcctgcttctctc

SEQ ID NO: 9539 - DNA, 201 bp, Homo sapiens
tcacagactgcgtgctttcatgtacttccagtgctggagcatggtatgaccagattttatcacagtgccatttgaagggaaaggagttcagacagacagaygtattccccaaaaagggataccccaggccgatggtgttcagccatttagcagctgaaaaaggaaacagtgcacaccaatgggaggcagcctgcgtagccc

SEQ ID NO: 9540 - DNA, 201 bp, Homo sapiens
tgctggaggcataaaagaaggacaggcgtacctcggagatatcacagatctaagctggaaccagaaccaaatacaaagacaagagaatccacatcttctgmgaaagtttcacagagtccttcaaaagactctgaagaaaaccctgccactgaagaacgtccagaaaaaattttggctgaaacacaacctgaattgggaacg

SEQ ID NO: 9541 - DNA, 201 bp, Homo sapiens
ggtatgaccagattttatcacagtgccatttgaagggaaaggagttcagacagacagacgtattccccaaaaagggataccccaggccgatggtgttcagccatttagcagctgaaaaaggaaacagtgcacaccaatgggaggcagcctgcgtagccctcatcaggcaagacagactgaatgcaggagtgggtgattagc

SEQ ID NO: 9542 - DNA, 157 bp, Homo sapiens
aggcgtgtggggcaggaccagtccttcagcggccgggttcgcgccgcggtcgccggytgcttacgtgggcgggcctagtgtggggctgagggtgcgggtcgctatggcggtggacatcacgctgctattccgggccagcgtcaagaccgtgaagacg

SEQ ID NO: 9543 - DNA, 160 bp, Homo sapiens
aggcgtgtggggcaggaccagtccttcagcggccgggttcgcgccgcggtcgccggctgmttacgtgggcgggcctagtgtggggctgagggtgcgggtcgctatggcggtggacatcacgctgctattccgggccagcgtcaagaccgtgaagacgcgg

SEQ ID NO: 9544 - DNA, 201 bp, Homo sapiens
tctaagttgacaaattcagtggcagcccagccacctcctatcaatcaatcagggaagaaatgcaggggagactggggccctcagtgaggggctgcctggcattattactcctccaaagactgctgcccccagagcaggcagggggtgtgggagggccagtttcccgccactgggtccaaggagcctttgttcaaaggaaga

SEQ ID NO: 9545 - DNA, 201 bp, Homo sapiens
ctaagttgacaaattcagtggcagcccagccacctcctatcaatcaatcagggaagaaatgcaggggagactggggccctcagtgaggggctgcctggcattattactcctccaaagactgctgcccccagagcaggcagggggtgtgggagggccagtttcccgccactgggtccaaggagcctttgttcaaaggaagaa

SEQ ID NO: 9546 - DNA, 201 bp, Homo sapiens
taagttgacaaattcagtggcagcccagccacctcctatcaatcaatcagggaagaaatgcaggggagactggggccctcagtgaggggctgcctggcattattactcctccaaagactgctgcccccagagcaggcagggggtgtgggagggccagtttcccgccactgggtccaaggagcctttgttcaaaggaagaag

SEQ ID NO: 9547 - DNA, 201 bp, Homo sapiens
gacgcggaacaaggcgctgggagtggcggtgggcggcggggtcgatggcagccgggacgagctgttccgccggagcccccggcccaagggcgacttctccrgccgggcccgcgaagtggtgagctggttgctatggaaacggcgggttgaggagggggcagtcctgcgacagggaccccgggccccaaaccagaccccgtc

SEQ ID NO: 9548 - DNA, 142 bp, Homo sapiens
cgacttctccagccgggcccgcgaagtggtgagctggttgctatggaaacggcgggttgaggagggggcagtcctgcgacagggaccccgggccccaaacsagaccccgtcccactttcagatcctcaaagactatgaatac

SEQ ID NO: 9549 - DNA, 141 bp, Homo sapiens
accagtccttcagcggccgggttcgcgccgcggtcgccggytgcttacgtgggcgggcctagtgtggggctgagggtgcgggtcgctatggcggtggacatcacgctgctattccgggccagcgtcaagaccgtgaagacg

SEQ ID NO: 9550 - DNA, 144 bp, Homo sapiens
accagtccttcagcggccgggttcgcgccgcggtcgccggctgmttacgtgggcgggcctagtgtggggctgagggtgcgggtcgctatggcggtggacatcacgctgctattccgggccagcgtcaagaccgtgaagacgcgg

SEQ ID NO: 9551 - DNA, 201 bp, Homo sapiens
tgaagaaaaccctgccactgaagaacgtccagaaaaaattttggctgaaacacaacctgaattgggaacgtggggagatggcaaaggcgaagatgagttawccccagaagaaatacaaatgtttgaacaggaaaatcagcgactaattggtgaaatgaacagcttgtttgatgaagtgaggcaaatcgaagggagagtggt

SEQ ID NO: 9552 - DNA, 201 bp, Homo sapiens; identical to SEQ ID NO: 9536

SEQ ID NO: 9553 - DNA, 201 bp, Homo sapiens; identical to SEQ ID NO: 9537

SEQ ID NO: 9554 - DNA, 201 bp, Homo sapiens; identical to SEQ ID NO: 9538

SEQ ID NO: 9555 - DNA, 201 bp, Homo sapiens; identical to SEQ ID NO: 9539

SEQ ID NO: 9556 - DNA, 201 bp, Homo sapiens
gaacagagagccatccgagttaaaagagtggtggataagaaaagattatctaagctggaaccagaaccaaatacaaagacaagagaatccacatcttctgmgaaagtttcacagagtccttcaaaagactctgaagaaaaccctgccactgaagaacgtccagaaaaaattttggctgaaacacaacctgaattgggaacg

SEQ ID NO: 9557 - DNA, 201 bp, Homo sapiens; identical to SEQ ID NO: 9541

SEQ ID NO: 9558 - DNA, 157 bp, Homo sapiens; identical to SEQ ID NO: 9542

SEQ ID NO: 9559 - DNA, 160 bp, Homo sapiens; identical to SEQ ID NO: 9543

SEQ ID NO: 9560 - DNA, 201 bp, Homo sapiens; identical to SEQ ID NO: 9544

SEQ ID NO: 9561 - DNA, 201 bp, Homo sapiens; identical to SEQ ID NO: 9545

SEQ ID NO: 9562 - DNA, 201 bp, Homo sapiens; identical to SEQ ID NO: 9546

SEQ ID NO: 9563 - DNA, 201 bp, Homo sapiens
gtgcaagttgcacggctccagctcagcccattgagccaataactgctgctcccagtggcagcgggaacgggagcgggagtagcagctctggaggcagctcrggaggcagtggattctgtgctggcagagccaacggcctctaccccgtggcaaataacagaaatgccttctggcactgcgtgaatggagtcacgtaccagc

SEQ ID NO: 9564 - DNA, 201 bp, Homo sapiens
tattaaggctcaatggcttaagcacaacaaatctggaggcgccatggtctgggccattgatctggatgacttcactggcactttctgcaaccagggcaagyttcccctaatctccaccctgaagaaggccctcggcctgcagagtgcaagttgcacggctccagctcagcccattgagccaataactgctgctcccagtgg

SEQ ID NO: 9565 - DNA, 201 bp, Homo sapiens
agaagctcatcgttggattccctacctatggacacaacttcatcctgagcaacccctccaacactggaattggtgcccccacctctggtgctggtcctgckgggccctatgccaaggagtctgggatctgggcttactacgagatctgtaccttcctgaaaaatggagccactcagggatgggatgcccctcaggaagtgc

SEQ ID NO: 9566 - DNA, 201 bp, Homo sapiens
cctcaggaagtgccttatgcctatcagggcaatgtgtgggttggctatgacaacgtcaagagcttcgatattaaggctcaatggcttaagcacaacaaatytggaggcgccatggtctgggccattgatctggatgacttcactggcactttctgcaaccagggcaagtttcccctaatctccaccctgaagaaggccctc

SEQ ID NO: 9567 - DNA, 201 bp, Homo sapiens
ggatctgggcttactacgagatctgtaccttcctgaaaaatggagccactcagggatgggatgcccctcaggaagtgccttatgcctatcagggcaatgtrtgggttggctatgacaacgtcaagagcttcgatattaaggctcaatggcttaagcacaacaaatctggaggcgccatggtctgggccattgatctggatg

SEQ ID NO: 9568 - DNA, 201 bp, Homo sapiens
gatctgtaccttcctgaaaaatggagccactcagggatgggatgcccctcaggaagtgccttatgcctatcagggcaatgtgtgggttggctatgacaacrtcaagagcttcgatattaaggctcaatggcttaagcacaacaaatctggaggcgccatggtctgggccattgatctggatgacttcactggcactttctg

SEQ ID NO: 9569 - DNA, 201 bp, Homo sapiens
aggcgccatggtctgggccattgatctggatgacttcactggcactttctgcaaccagggcaagtttcccctaatctccaccctgaagaaggccctcggcytgcagagtgcaagttgcacggctccagctcagcccattgagccaataactgctgctcccagtggcagcgggaacgggagcgggagtagcagctctggagg

SEQ ID NO: 9570 - DNA, 201 bp, Homo sapiens
cagcccattgagccaataactgctgctcccagtggcagcgggaacgggagcgggagtagcagctctggaggcagctcgggaggcagtggattctgtgctgkcagagccaacggcctctaccccgtggcaaataacagaaatgccttctggcactgcgtgaatggagtcacgtaccagcagaactgccaggccgggcttgtc

SEQ ID NO: 9571 - DNA, 201 bp, Homo sapiens
actctcctggccattggaggctggaacttcgggactgcccctttcactgccatggtttctactcctgagaaccgccagactttcatcacctcagtcatcarattcctgcgccagtatgagtttgacgggctggactttgactgggagtaccctggctctcgtgggagccctcctcaggacaagcatctcttcactgtcctg

SEQ ID NO: 9572 - DNA, 201 bp, Homo sapiens
gcaccagctgagaagctcatcgttggattccctacctatggacacaacttcatcctgagcaacccctccaacactggaattggtgcccccacctctggtgytggtcctgctgggccctatgccaaggagtctgggatctgggcttactacgagatctgtaccttcctgaaaaatggagccactcagggatgggatgcccct

SEQ ID NO: 9573 - DNA, 201 bp, Homo sapiens
ctggaggcgccatggtctgggccattgatctggatgacttcactggcactttctgcaaccagggcaagtttcccctaatctccaccctgaagaaggccctyggcctgcagagtgcaagttgcacggctccagctcagcccattgagccaataactgctgctcccagtggcagcgggaacgggagcgggagtagcagctctg

SEQ ID NO: 9574 - DNA, 201 bp, Homo sapiens
ctctggagcccaggctgttgctttccagtctggtggtgaatcctccatagtctggaacagccagctgaaaactctcctggccattggaggctggaacttcrggactgcccctttcactgccatggtttctactcctgagaaccgccagactttcatcacctcagtcatcaaattcctgcgccagtatgagtttgacgggct

SEQ ID NO: 9575 - DNA, 201 bp, Homo sapiens
actgaatttgcagctcggctctgcctaccagctgacatgctacttcaccaactgggcccagtaccggccaggcctggggcgcttcatgcctgacaacatcracccctgcctctgtacccacctgatctacgcctttgctgggaggcagaacaacgagatcaccaccatcgaatggaatgatgtgactctctaccaagcttt

SEQ ID NO: 9576 - DNA, 201 bp, Homo sapiens; identical to SEQ ID NO: 9564

SEQ ID NO: 9577 - DNA, 201 bp, Homo sapiens; identical to SEQ ID NO: 9565

SEQ ID NO: 9578 - DNA, 201 bp, Homo sapiens; identical to SEQ ID NO: 9566

SEQ ID NO: 9579 - DNA, 201 bp, Homo sapiens; identical to SEQ ID NO: 9567

SEQ ID NO: 9580 - DNA, 201 bp, Homo sapiens; identical to SEQ ID NO: 9568

SEQ ID NO: 9581 - DNA, 201 bp, Homo sapiens; identical to SEQ ID NO: 9569

SEQ ID NO: 9582 - DNA, 195 bp, Homo sapiens
gccagacacaaaatgtccacaatagaaaatctgaccacagtatctaaacagttgcttatcagcccttggaactgccaaaaaagctattaaactgrtgttttccatggtgatggtctccaccaccctgttaggagccatgacattgttctgtccttgttgggcagagaaggtggtgatgctggtggtgggagggtg

SEQ ID NO: 9583 - DNA, 201 bp, Homo sapiens; identical to SEQ ID NO: 9570

SEQ ID NO: 9584 - DNA, 201 bp, Homo sapiens; identical to SEQ ID NO: 9572

SEQ ID NO: 9585 - DNA, 201 bp, Homo sapiens; identical to SEQ ID NO: 9573

SEQ ID NO: 9586 - DNA, 201 bp, Homo sapiens
tgaccacagtatctaaacagttgcttatcagcccttggaactgccaaaaaagctattaaactggtgttttccatggtgatggtctccaccaccctgttagragccatgacattgttctgtccttgttgggcagagaaggtggtgatgctggtggtgggagggtgtaggttgaaggtcttgggagggtgtttgtagaagaga

SEQ ID NO: 9587 - DNA, 201 bp, Homo sapiens
aatgatgtgactctctaccaagctttcaatggcctgaaaaataagaacagccagctgaaaactctcctggccattggaggctggaacttcgggactgcccrtttcactgccatggtttctactcctgagaaccgccagactttcatcacctcagtcatcaaattcctgcgccagtatgagtttgacgggctggactttgac

SEQ ID NO: 9588 - DNA, 201 bp, Homo sapiens
catcgaatggaatgatgtgactctctaccaagctttcaatggcctgaaaaataagaacagccagctgaaaactctcctggccattggaggctggaacttcrggactgcccctttcactgccatggtttctactcctgagaaccgccagactttcatcacctcagtcatcaaattcctgcgccagtatgagtttgacgggct

SEQ ID NO: 9589 - DNA, 201 bp, Homo sapiens
gacaaagcttattctcctcacaggtcttgtccttatactgaatttgcagctcggctctgcctaccagctgacatgctacttcaccaactgggcccagtacyggccaggcctggggcgcttcatgcctgacaacatcgacccctgcctctgtacccacctgatctacgcctttgctgggaggcagaacaacgagatcaccac

SEQ ID NO: 9590 - DNA, 163 bp, Homo sapiens
gccagacacaaaatgtccacaatagaaaatctgaccacagtatctaaacagttgcttatcagyccttggaactgccaaaaaagctattaaactggtgttttccatggtgatggtctccaccaccctgttaggagccatgacattgttctgtccttgttgggca

SEQ ID NO: 9591 - DNA, 201 bp, Homo sapiens; identical to SEQ ID NO: 9563

SEQ ID NO: 9592 - DNA, 201 bp, Homo sapiens
ttcaccaactgggcccagtaccggccaggcctggggcgcttcatgcctgacaacatcgacccctgcctctgtacccacctgatctacgcctttgctgggakgcagaacaacgagatcaccaccatcgaatggaatgatgtgactctctaccaagctttcaatggcctgaaaaataagaacagccagctgaaaactctcctg

SEQ ID NO: 9593 - DNA, 201 bp, Homo sapiens
ccttatactgaatttgcagctcggctctgcctaccagctgacatgctacttcaccaactgggcccagtaccggccaggcctggggcgcttcatgcctgacracatcgacccctgcctctgtacccacctgatctacgcctttgctgggaggcagaacaacgagatcaccaccatcgaatggaatgatgtgactctctacca

SEQ ID NO: 9594 - DNA, 201 bp, Homo sapiens; identical to SEQ ID NO: 9571

SEQ ID NO: 9595 - DNA, 201 bp, Homo sapiens
cctaccagctgacatgctacttcaccaactgggcccagtaccggccaggcctggggcgcttcatgcctgacaacatcgacccctgcctctgtacccacctsatctacgcctttgctgggaggcagaacaacgagatcaccaccatcgaatggaatgatgtgactctctaccaagctttcaatggcctgaaaaataagaaca

SEQ ID NO: 9596 - DNA, 201 bp, Homo sapiens
gactgtccaaccaatacggccaaaaagtcactccaaggcagaagctgttttcttcactactccaccatgctctgctcttaaggggaagagccacaagcctrttggctgcctgggcgaagcaggtcatgttctttctaaggtgctagctaagcctgagaacctttctgcttcattcatcgtccaggatgtgaacatcaccgg

SEQ ID NO: 9597 - DNA, 201 bp, Homo sapiens
atgaaattacctggttctaagaatttttgagtggcaaaaatagaaaacaatcttcatttgaaaacatccctaagcttgaataaatggataccatagatagyttctcttttttattctggtgtcattaccagcatctgaatttcaagttcttaaaatttcaaaaattaaaatttttcattattagctatccatttatctttt

SEQ ID NO: 9598 - DNA, 201 bp, Homo sapiens
agataaggtttatggcaggtaattttttgtaatgtgtattaaacgaagttcaaagattagaaatacatctgtgtcctgaaaaccttagatacatagccgaytgtatacagaggttcatctcaacctcaacactattgacttttggggctggatagttctctgttgtgggggtttgtcttgtgcactgtaggtttttagtag

SEQ ID NO: 9599 - DNA, 201 bp, Homo sapiens
tcttttttattctggtgtcattaccagcatctgaatttcaagttcttaaaatttcaaaaattaaaatttttcattattagctatccatttatcttttacaygaacttgtcatgaacaaattcaaatgtttatgccagcaaatttttgtactgttgcatagttaaaaatgctgggagtctctgcatagatacaaaatattat

SEQ ID NO: 9600 - DNA, 201 bp, Homo sapiens
tcttttaaaggtcataaggataatatattttccccatcaatgctgattctgagaaaagagcaatttatcaaaattaaacactgtaaaagaaaggtgtccayatgtctttacctacctaagtaaaacaggaagaaaatcagtaacattatccttaggttttgacaatggtacttgcttcttgttgttttattgtttcctgaa

SEQ ID NO: 9601 - DNA, 201 bp, Homo sapiens
tccaggaatgttttgcagctttgtacaagtaacataaattggacacctcagaatgaaagttcatgttggttctgaatggttcactgcagctcctgtcacargctgggatggatttatcacattgagttatgaaattacctggttctaagaatttttgagtggcaaaaatagaaaacaatcttcatttgaaaacatccctaa

SEQ ID NO: 9602 - DNA, 201 bp, Homo sapiens
gttttcgtagctcaccaatggtgagtaaagatacagctcttttaaaggtcataaggataatatattttccccatcaatgctgattctgagaaaagagcaakttatcaaaattaaacactgtaaaagaaaggtgtccatatgtctttacctacctaagtaaaacaggaagaaaatcagtaacattatccttaggttttgaca

SEQ ID NO: 9603 - DNA, 201 bp, Homo sapiens
tatttaaaaagtggatattccaggaatgttttgcagctttgtacaagtaacataaattggacacctcagaatgaaagttcatgttggttctgaatggttcrctgcagctcctgtcacaagctgggatggatttatcacattgagttatgaaattacctggttctaagaatttttgagtggcaaaaatagaaaacaatcttc

SEQ ID NO: 9604 - DNA, 201 bp, Homo sapiens
atatatatgcaaatatatgtacatatacatgtatatacacacagacacatgcatatacatgaatataccttgagcatgaatccctggagaaatcgttttcrtagctcaccaatggtgagtaaagatacagctcttttaaaggtcataaggataatatattttccccatcaatgctgattctgagaaaagagcaatttatca

SEQ ID NO: 9605 - DNA, 201 bp, Homo sapiens
gctttcaaatctagtatatcttactttttggaaatgttttatgctacaaattagtgccttgtagcatgaacttaagtcaaaacgtgttatcaatatagagwgttgcagtgtatattgtaacaacctaaaacgcagagaagtttaatttaatactgttttttttcttgaaggaatactcacatacatggtttgaaatgtgca

SEQ ID NO: 9606 - DNA, 201 bp, Homo sapiens
tttttgtaatgtgtattaaacgaagttcaaagattagaaatacatctgtgtcctgaaaaccttagatacatagccgactgtatacagaggttcatctcaamctcaacactattgacttttggggctggatagttctctgttgtgggggtttgtcttgtgcactgtaggtttttagtagcatccacactttctcctcaccag

SEQ ID NO: 9607 - DNA, 201 bp, Homo sapiens
gcggcggctggacgagtcgctgtctgccgggagcgtccagcgcgctcgctgcgcctccaggtgcctgagcctgcagatcactcgcatctccgccttcttcyagcacttccagaacaatggttccctggtttggtgccagaatcacaagcaatgttctaagtgcctggagccctgcaaggaatcaggggacctgaggaaaca

SEQ ID NO: 9608 - DNA, 201 bp, Homo sapiens
acctccggctggccaactccaccgtcaacagtgatgggagtgtgaccgtcactatagtttgggatctccccgaggagccggacatccctgtgcatcattasaaggtcttttggagctggatggtcagcagtaagtctcttgtcccaacaaagaagaagcggagaaagactacggatgggtttcaaaattctgtgatcctgg

SEQ ID NO: 9609 - DNA, 160 bp, Homo sapiens
gtcggcgaggagggtccggccggagttgaaggattgaactttccggctcagtcgcggcgkctgcctggtcctcagcagtgcagccccggcgcggagcagggagcctcggcccgcgcccggcgccctcgccctcgccctcgacccgcagccatggtgcccg

SEQ ID NO: 9610 - DNA, 201 bp, Homo sapiens
gagaaacaaccgcacacgcctggctctcatcatatgcaatacagagtttgaccatctgcctccgaggaatggagctgactttgacatcacagggatgaagragctacttgagggtctggactatagtgtagatgtagaagagaatctgacagccagggatatggagtcagcgctgagggcatttgctaccagaccagagca

SEQ ID NO: 9611 - DNA, 201 bp, Homo sapiens
tcattgtccaggcctgcagaggtgcaaaccgtggggaactgtgggtcagagactctccagcatccttggaagtggcctcttcacagtcatctgagaacctrgaggaagatgctgtttacaagacccacgtggagaaggacttcattgctttctgctcttcaacgccacacaacgtgtcctggagagacagcacaatgggct

SEQ ID NO: 9612 - DNA, 201 bp, Homo sapiens
tgataatgagtctggaattctgagcagcagtttcacaatctgtaattacacgtttccgccctttgcaataaggaaatacatagtttactttcatttttgastctgaggctctttccaacgctgtaaaaaaggacagaggctgttccctatggcagaaggcaaccacagaaaaaagccacttaaggtgttggaatccctggg

SEQ ID NO: 9613 - DNA, 201 bp, Homo sapiens
gaggctgttccctatggcagaaggcaaccacagaaaaaagccacttaaggtgttggaatccctgggcaaagatttcctcactggtgttttggataacttgrtggaacaaaatgtactgaactggaaggaagaggaaaaaaagaaatattacgatgctaaaactgaagacaaagttcgggtcatggcagactctatgcaaga

SEQ ID NO: 9614 - DNA, 201 bp, Homo sapiens
agaggctgttccctatggcagaaggcaaccacagaaaaaagccacttaaggtgttggaatccctgggcaaagatttcctcactggtgttttggataacttrgtggaacaaaatgtactgaactggaaggaagaggaaaaaaagaaatattacgatgctaaaactgaagacaaagttcgggtcatggcagactctatgcaag

SEQ ID NO: 9615 - DNA, 201 bp, Homo sapiens
tagatgtagaagagaatctgacagccagggatatggagtcagcgctgagggcatttgctaccagaccagagcacaagtcctctgacagcacattcttggtmctcatgtctcatggcatcctggagggaatctgcggaactgtgcatgatgacgcaactgcctcagtctgaaggacaaacccaaggtcatcattgtccaggc

SEQ ID NO: 9616 - DNA, 201 bp, Homo sapiens
aggtcatcattgtccaggcctgcagaggtgcaaaccgtggggaactgtgggtcagagactctccagcatccttggaagtggcctcttcacagtcatctgakaacctggaggaagatgctgtttacaagacccacgtggagaaggacttcattgctttctgctcttcaacgccacacaacgtgtcctggagagacagcacaa

SEQ ID NO: 9617 - DNA, 201 bp, Homo sapiens; identical to SEQ ID NO: 9610

SEQ ID NO: 9618 - DNA, 201 bp, Homo sapiens; identical to SEQ ID NO: 9611

SEQ ID NO: 9619 - DNA, 201 bp, Homo sapiens
agctcttcaccaactgtcagaaggcaaccacagaaaaaagccacttaaggtgttggaatccctgggcaaagatttcctcactggtgttttggataacttgrtggaacaaaatgtactgaactggaaggaagaggaaaaaaagaaatattacgatgctaaaactgaagacaaagttcgggtcatggcagactctatgcaaga

SEQ ID NO: 9620 - DNA, 201 bp, Homo sapiens
aagctcttcaccaactgtcagaaggcaaccacagaaaaaagccacttaaggtgttggaatccctgggcaaagatttcctcactggtgttttggataacttrgtggaacaaaatgtactgaactggaaggaagaggaaaaaaagaaatattacgatgctaaaactgaagacaaagttcgggtcatggcagactctatgcaag

SEQ ID NO: 9621 - DNA, 201 bp, Homo sapiens
tagatgtagaagagaatctgacagccagggatatggagtcagcgctgagggcatttgctaccagaccagagcacaagtcctctgacagcacattcttggtmctcatgtctcatggcatcctggagggaatctgcggaactgtgcatgatgagaaaaaaccagatgtgctgctttatgacaccatcttccagatattcaaca

SEQ ID NO: 9622 - DNA, 201 bp, Homo sapiens; identical to SEQ ID NO: 9616

SEQ ID NO: 9623 - DNA, 201 bp, Homo sapiens; identical to SEQ ID NO: 9610

SEQ ID NO: 9624 - DNA, 201 bp, Homo sapiens; identical to SEQ ID NO: 9611

SEQ ID NO: 9625 - DNA, 201 bp, Homo sapiens; identical to SEQ ID NO: 9612

SEQ ID NO: 9626 - DNA, 201 bp, Homo sapiens; identical to SEQ ID NO: 9613

SEQ ID NO: 9627 - DNA, 201 bp, Homo sapiens; identical to SEQ ID NO: 9614

SEQ ID NO: 9628 - DNA, 201 bp, Homo sapiens; identical to SEQ ID NO: 9621

SEQ ID NO: 9629 - DNA, 201 bp, Homo sapiens; identical to SEQ ID NO: 9616

SEQ ID NO: 9630 - DNA, 201 bp, Homo sapiens; identical to SEQ ID NO: 9610

SEQ ID NO: 9631 - DNA, 201 bp, Homo sapiens; identical to SEQ ID NO: 9611

SEQ ID NO: 9632 - DNA, 201 bp, Homo sapiens; identical to SEQ ID NO: 9612

SEQ ID NO: 9633 - DNA, 201 bp, Homo sapiens; identical to SEQ ID NO: 9613

SEQ ID NO: 9634 - DNA, 201 bp, Homo sapiens; identical to SEQ ID NO: 9614

SEQ ID NO: 9635 - DNA, 201 bp, Homo sapiens; identical to SEQ ID NO: 9621

SEQ ID NO: 9636 - DNA, 201 bp, Homo sapiens; identical to SEQ ID NO: 9616

SEQ ID NO: 9637 - DNA, 201 bp, Homo sapiens; identical to SEQ ID NO: 9610

SEQ ID NO: 9638 - DNA, 201 bp, Homo sapiens; identical to SEQ ID NO: 9611

SEQ ID NO: 9639 - DNA, 201 bp, Homo sapiens; identical to SEQ ID NO: 9619

SEQ ID NO: 9640 - DNA, 201 bp, Homo sapiens; identical to SEQ ID NO: 9620

SEQ ID NO: 9641 - DNA, 201 bp, Homo sapiens; identical to SEQ ID NO: 9621

SEQ ID NO: 9642 - DNA, 201 bp, Homo sapiens; identical to SEQ ID NO: 9616

SEQ ID NO: 9643 - DNA, 201 bp, Homo sapiens; identical to SEQ ID NO: 9610

SEQ ID NO: 9644 - DNA, 201 bp, Homo sapiens; identical to SEQ ID NO: 9611

SEQ ID NO: 9645 - DNA, 201 bp, Homo sapiens; identical to SEQ ID NO: 9612

SEQ ID NO: 9646 - DNA, 201 bp, Homo sapiens; identical to SEQ ID NO: 9613

SEQ ID NO: 9647 - DNA, 201 bp, Homo sapiens; identical to SEQ ID NO: 9614

SEQ ID NO: 9648 - DNA, 201 bp, Homo sapiens; identical to SEQ ID NO: 9621

SEQ ID NO: 9649 - DNA, 201 bp, Homo sapiens; identical to SEQ ID NO: 9616

SEQ ID NO: 9650 - DNA, 201 bp, Homo sapiens; identical to SEQ ID NO: 9610

SEQ ID NO: 9651 - DNA, 201 bp, Homo sapiens; identical to SEQ ID NO: 9611

SEQ ID NO: 9652 - DNA, 201 bp, Homo sapiens; identical to SEQ ID NO: 9612

SEQ ID NO: 9653 - DNA, 201 bp, Homo sapiens; identical to SEQ ID NO: 9613

SEQ ID NO: 9654 - DNA, 201 bp, Homo sapiens; identical to SEQ ID NO: 9614

SEQ ID NO: 9655 - DNA, 201 bp, Homo sapiens; identical to SEQ ID NO: 9621

SEQ ID NO: 9656 - DNA, 201 bp, Homo sapiens; identical to SEQ ID NO: 9616

SEQ ID NO: 9657 - DNA, 201 bp, Homo sapiens
cgtaatcctggtgaccgagaagagagcagagccactgccagaaggaaggggacaagacccagcaggacaccttctttccacgctttccagcctgtgggagyggcaggggcaacagagagaggatctggagccaggattaatgactcatttatgaagcatcttattctgcgaccgaggctcagtggtcagtggcgacgtaaa

SEQ ID NO: 9658 - DNA, 196 bp, Homo sapiens
ttaatacatagcaacagactgggttatttatttaagatgtgtattgtgtcatatgaagtttaagagacataaatggcattttgttatttattaagacaaaytccaattgttctctggctgtttttttcagttgtgtctagcaaaatacttatctgccctttgaaataaaatgtttttgtttaaaaaatctcagaac

SEQ ID NO: 9659 - DNA, 201 bp, Homo sapiens
tgcacaggtagccccgaccctctcaggcattccagccacagaacatcaaagtgagcgagtactgcgctggctgtggcttcagagaacctgtatgtgccacytggaaaaacaggacaccagagcccaccagacagtgccggccagcagagaagcagagagccagcgccacacaacatcaagaaggccgacaaccaggttgga

SEQ ID NO: 9660 - DNA, 201 bp, Homo sapiens
  misc_feature (1)...(201): n = A,T,C or G, or insertion/deletion polymorphism (see Tables 1-2)
gatcctggcaggtgtgatctcagaccgactggagaaaagggcctccacctgcggcctgatgctgctgctcgcggcccccacgctctacatcttctccaccntcagcaagatggggcttgaggccaccatcgccatgctgctgctcagcggagccctggtcagtgggccctacacactcatcaccaccgccgtctccgccga

SEQ ID NO: 9661 - DNA, 201 bp, Homo sapiens
actcactgctccctcgcctactagagcagagccactgccagaaggaaggggacaagacccagcaggacaccttctttccacgctttccagcctgtgggagyggcaggggcaacagagagaggatctggagccaggattaatgactcatttatgaagcatcttattctgcgaccgaggctcagtggtcagtggcgacgtaaa

SEQ ID NO: 9662 - DNA, 196 bp, Homo sapiens; identical to SEQ ID NO: 9658

SEQ ID NO: 9663 - DNA, 201 bp, Homo sapiens; identical to SEQ ID NO: 9659

SEQ ID NO: 9664 - DNA, 201 bp, Homo sapiens; identical to SEQ ID NO: 9660
  misc_feature (1)...(201): n = A,T,C or G, or insertion/deletion polymorphism (see Tables 1-2)

SEQ ID NO: 9665 - DNA, 201 bp, Homo sapiens
ctattttaaaggagacatattgctgaacagcagtgagaaaagtctgcaggaactgctgcctgagccaagccagagaaccgaagacccggccggccctggcytcacaggcgtgtgcccatgcagccacccaaatgcacgcgtgacaacaaggccgggagggtggggggggtgcacaggtagccccgaccctctcaggcattc

SEQ ID NO: 9666 - DNA, 201 bp, Homo sapiens; identical to SEQ ID NO: 9659

SEQ ID NO: 9667 - DNA, 201 bp, Homo sapiens
cgccacacaacatcaagaaggccgacaaccaggttggaaaccaagacggagctcagacccaccacatcgccccagaggcttttccagcacccatgatgttycggactgacctaaaaactaattgtcgagaagccaagggtgaggaggcaggaagcacctccggttggaggcacccaggcttgccagccacagagcgccccg

SEQ ID NO: 9668 - DNA, 201 bp, Homo sapiens
ccggactgacctaaaaactaattgtcgagaagccaagggtgaggaggcaggaagcacctccggttggaggcacccaggcttgccagccacagagcgccccraagtcaccgtcatcccagcccctggccttcctgccgccctccggggccatggcgctgctgttcagctcaggcacaggggcacagcagaggtttgggaagc

SEQ ID NO: 9669 - DNA, 201 bp, Homo sapiens
agggtgaggaggcaggaagcacctccggttggaggcacccaggcttgccagccacagagcgccccgaagtcaccgtcatcccagcccctggccttcctgcygccctccggggccatggcgctgctgttcagctcaggcacaggggcacagcagaggtttgggaagcggtctccccaccggcactgggattggcgggtccaa

SEQ ID NO: 9670 - DNA, 201 bp, Homo sapiens
cacctccggttggaggcacccaggcttgccagccacagagcgccccgaagtcaccgtcatcccagcccctggccttcctgccgccctccggggccatggcrctgctgttcagctcaggcacaggggcacagcagaggtttgggaagcggtctccccaccggcactgggattggcgggtccaagcccagcaaccggcttcgc

SEQ ID NO: 9671 - DNA, 181 bp, Homo sapiens
ttaatacatagcaacagactgggttatttatttaagatgtgtattgtgtcatatgaagtttaagagacataaatggcattttgttatttattaagacaaaytccaattgttctctggctgtttttttcagttgtgtctagcaaaatacttatctgccctttgaaataaaatgtttttgttt

SEQ ID NO: 9672 - DNA, 201 bp, Homo sapiens
cattgaacatccgaacgacgtcaggtgctcctccaccctggtgacgcactcaaaaggctatgagaatggtacaaacagattgagactccagaagcaaatcytgaagagcgaaaagaacaagcctctggacccagagatgcagtgcctgctgctctcagatgggaagggctccatccacccgaaccaggtcgtcattctccc

SEQ ID NO: 9673 - DNA, 201 bp, Homo sapiens; identical to SEQ ID NO: 9660
  misc_feature (1)...(201): n = A,T,C or G, or insertion/deletion polymorphism (see Tables 1-2)

SEQ ID NO: 9674 - DNA, 201 bp, Homo sapiens; identical to SEQ ID NO: 9657

SEQ ID NO: 9675 - DNA, 104 bp, Homo sapiens
ctgsgcctggcgtcaccgaccggtgcggacaggaagaggctctgggctggcacatgtgtatggcggtgaggcgggcgggtacatggcgggctctgtgggactgg

SEQ ID NO: 9676 - DNA, 201 bp, Homo sapiens
ccaccttctccaactctggcagctattttgctttaaccgatgacagtaagcgtctgattcttttccgtacaaaaccatggcaatgtctgagtgtcaggacygtggcaaggaggtgtacagccctgactttcatagcctcggaggagaaggtcttggtggccgacaagtctggagacgtctactccttttcggtgctggagc

SEQ ID NO: 9677 - DNA, 201 bp, Homo sapiens
atgactgcagtgctgcagaaaagaagtcacaagaaaataaaggggaggacgcgcccttggaccaggggagcggtgcgattctggcgtccaccttctccaastctggcagctattttgctttaaccgatgacagtaagcgtctgattcttttccgtacaaaaccatggcaatgtctgagtgtcaggaccgtggcaaggaggt

SEQ ID NO: 9678 - DNA, 201 bp, Homo sapiens
tcatagcctcggaggagaaggtcttggtggccgacaagtctggagacgtctactccttttcggtgctggagccacacgggtgtggccgtctagagctgggrcacctgtctatgctgttagatgtggctgtgagtcctgatgaccgcttcatcctcactgccgaccgggacgagaagatccgagtcagctgggccgcggcgc

SEQ ID NO: 9679 - DNA, 201 bp, Homo sapiens
  misc_feature (1)...(201): n = A,T,C or G, or insertion/deletion polymorphism (see Tables 1-2)
ttcagcagtctctacaaggccacgttcgacaacgtgacctcctacctgaagaagaaagaggagagactgcagcagcagctagagaagaagcagcggcgccngagtcccccgcctgggcccgacgggcatgccaagaagatgagaccgggggaggcgacgctaagttgctgatcgtggcggtcagtggtgtctctcacctca

SEQ ID NO: 9680 - DNA, 201 bp, Homo sapiens
gcaccgtgttaaagaaagtctctggtgttcttcgtgggaactgggccatgctggaaggctctgccggcgcagacgccagcttcagcagtctctacaaggcyacgttcgacaacgtgacctcctacctgaagaagaaagaggagagactgcagcagcagctagagaagaagcagcggcgccggagtcccccgcctgggcccg

SEQ ID NO: 9681 - DNA, 104 bp, Homo sapiens; identical to SEQ ID NO: 9675

SEQ ID NO: 9682 - DNA, 201 bp, Homo sapiens; identical to SEQ ID NO: 9676

SEQ ID NO: 9683 - DNA, 201 bp, Homo sapiens; identical to SEQ ID NO: 9678

SEQ ID NO: 9684 - DNA, 201 bp, Homo sapiens
ccgtctcagcatccaggtgacgtgctgtcccgcagtagctgctcgccacacaggctgttgaaactcagcacgaatgcttgagcctgccccagccccagccrtagcccttgtgctcaggagctgctcctggagagtggctcccttgtgggaagtgagaaacacgtttcggagtcgcagggagctctgtctggcatcggtggc

SEQ ID NO: 9685 - DNA, 201 bp, Homo sapiens
  misc_feature (1)...(201): n = A,T,C or G, or insertion/deletion polymorphism (see Tables 1-2)
catggtggatgttttcatgttgttccgccgtctcagcatccaggtgacgtgctgtcccgcagtagctgctcgccacacaggctgttgaaactcagcacgantgcttgagcctgccccagccccagccgtagcccttgtgctcaggagctgctcctggagagtggctcccttgtgggaagtgagaaacacgtttcggagtcg

SEQ ID NO: 9686 - DNA, 201 bp, Homo sapiens
  misc_feature (1)...(201): n = A,T,C or G, or insertion/deletion polymorphism (see Tables 1-2)
gcaggagctggtggacccccaggccccccagaagtttgccgcgtccaggattgcattctggtgccaggagaactgcgtggcgctcctgtgcgacggcactnctgtggtctacatcttccagctggacgcccgcagacagcagttggtgtacaggcagcagctggcgttccagcaccaagtgtgggacgtggctttcgagga

SEQ ID NO: 9687 - DNA, 201 bp, Homo sapiens; identical to SEQ ID NO: 9677

SEQ ID NO: 9688 - DNA, 201 bp, Homo sapiens
gcactcctgtggtctacatcttccagctggacgcccgcagacagcagttggtgtacaggcagcagctggcgttccagcaccaagtgtgggacgtggctttygaggagacccaggggctgtgggtgctccaggactgccaggaagcccccctggtgctctacaggcctgtgggcgaccagtggcagtctgttcctgagagca

SEQ ID NO: 9689 - DNA, 201 bp, Homo sapiens
agctcttgaagcactttcttttcatgtcggaggctgcgtgtgagccggtggtggcggcagctgtctgtgtttctcctgttctcataccgcccttcgtgtcsgctgcatcttcctctaggagcatctgtgggctgacgtttctggcatggtggatgttttcatgttgttccgccgtctcagcatccaggtgacgtgctgtcc

SEQ ID NO: 9690 - DNA, 201 bp, Homo sapiens
cttggcacacactgcagagccacagggatgttgctgaatttcaatcaccgatcagcaaggatgaaccttctcaacttcctaggaatgtttagcagcaacckaatataccaggcaaaactccttggtgcctgcgctgtgtgtgtgtgaggtgcgcggtgtgattgtgcgctgtgtgtgtgtgaggtgcacgctgcgtgatcg

SEQ ID NO: 9691 - DNA, 201 bp, Homo sapiens; identical to SEQ ID NO: 9679
  misc_feature (1)...(201): n = A,T,C or G, or insertion/deletion polymorphism (see Tables 1-2)

SEQ ID NO: 9692 - DNA, 201 bp, Homo sapiens; identical to SEQ ID NO: 9680

SEQ ID NO: 9693 - DNA, 104 bp, Homo sapiens
ctgsgcctggcgtcaccgaccggtgcggacaggaagaggctctgggctggcacatgtgtatggcgtgatgatgacagcctcttcatctatgactgcagtgctgc

SEQ ID NO: 9694 - DNA, 201 bp, Homo sapiens
aataaaggggaggacgcgcccttggaccaggggagcggtgcgattctggcgtccaccttctccaactctggcagctattttgctttaaccgatgacagacygtggcaaggaggtgtacagccctgactttcatagcctcggaggagaaggtcttggtggccgacaagtctggagacgtctactccttttcggtgctggagc

SEQ ID NO: 9695 - DNA, 201 bp, Homo sapiens; identical to SEQ ID NO: 9678

SEQ ID NO: 9696 - DNA, 201 bp, Homo sapiens; identical to SEQ ID NO: 9684

SEQ ID NO: 9697 - DNA, 201 bp, Homo sapiens; identical to SEQ ID NO: 9685
  misc_feature (1)...(201): n = A,T,C or G, or insertion/deletion polymorphism (see Tables 1-2)

SEQ ID NO: 9698 - DNA, 201 bp, Homo sapiens; identical to SEQ ID NO: 9686
  misc_feature (1)...(201): n = A,T,C or G, or insertion/deletion polymorphism (see Tables 1-2)

SEQ ID NO: 9699 - DNA, 201 bp, Homo sapiens
atgactgcagtgctgcagaaaagaagtcacaagaaaataaaggggaggacgcgcccttggaccaggggagcggtgcgattctggcgtccaccttctccaastctggcagctattttgctttaaccgatgacagaccgtggcaaggaggtgtacagccctgactttcatagcctcggaggagaaggtcttggtggccgacaa

SEQ ID NO: 9700 - DNA, 201 bp, Homo sapiens; identical to SEQ ID NO: 9688

SEQ ID NO: 9701 - DNA, 201 bp, Homo sapiens; identical to SEQ ID NO: 9689

SEQ ID NO: 9702 - DNA, 201 bp, Homo sapiens; identical to SEQ ID NO: 9690

SEQ ID NO: 9703 - DNA, 201 bp, Homo sapiens
  misc_feature (1)...(201): n = A,T,C or G, or insertion/deletion polymorphism (see Tables 1-2)
ttcagcagtctctacaaggccacgttcgacaacgtgacctcctacctgaagaagaaagaggagagactgcagcagcagctagagaagaagcagcggcgccngagtcccccgcctgggcccgacgggcatgccaagaagatgagaccgggggaggcgacgctaagttgctgatcgtggcggtctgtttctgtcgactgtgga

SEQ ID NO: 9704 - DNA, 201 bp, Homo sapiens; identical to SEQ ID NO: 9686
  misc_feature (1)...(201): n = A,T,C or G, or insertion/deletion polymorphism (see Tables 1-2)

SEQ ID NO: 9705 - DNA, 201 bp, Homo sapiens; identical to SEQ ID NO: 9680

SEQ ID NO: 9706 - DNA, 104 bp, Homo sapiens; identical to SEQ ID NO: 9675

SEQ ID NO: 9707 - DNA, 201 bp, Homo sapiens; identical to SEQ ID NO: 9676

SEQ ID NO: 9708 - DNA, 201 bp, Homo sapiens; identical to SEQ ID NO: 9677

SEQ ID NO: 9709 - DNA, 201 bp, Homo sapiens; identical to SEQ ID NO: 9688

SEQ ID NO: 9710 - DNA, 201 bp, Homo sapiens; identical to SEQ ID NO: 9678

SEQ ID NO: 9711 - DNA, 201 bp, Homo sapiens
acgtgctgcgggcactgggggctgagattgtgaggacgcccaccaatgccaggttcgactccccggagtcacacgtgggggtggcctggcggctgaagaaygaaatccccaattctcacatcctagaccagtaccgcaacgccagcaaccccctggctcactacgacaccaccgctgatgagatcctgcagcagtgtgatg

SEQ ID NO: 9712 - DNA, 201 bp, Homo sapiens
tgccccggcaaaatctccaaaaatcttgccagatattctgaagaaaatcggggacacccctatggtcagaatcaacaagattgggaagaagttcggcctgmagtgtgagctcttggccaagtgtgagttcttcaacgcgggcgggagcgtgaaggaccgcatcagcctgcggatgattgaggatgctgagcgcgacgggac

SEQ ID NO: 9713 - DNA, 201 bp, Homo sapiens
aatcaatcacttgaaagtgaacaatcagcggcatttagtacatccagaaagttgtgtaggcaccacctctgtcacgttctggaacattctgtcatcacccygtgaagcaatcatttcccctcccgtcttcctcctcccctggcaactgctgatcgactttgtgtctctgttgtctaaaataggttttccctgttctggaca

SEQ ID NO: 9714 - DNA, 201 bp, Homo sapiens
atatgtgattttctctaatgtaacttcctcttaggatgtttcaccaaggaaatattgagagagaagtcggccaggtaggatgaacacaggcaatgactgcrcagagtggattaaaggcaaaagagagaagagtccaggaaggggcggggagaagcctgggtggctcagcatcctccacgggctgcgccgtctgctcggggc

SEQ ID NO: 9715 - DNA, 201 bp, Homo sapiens
tggacaagtggttcaagagcaacgatgaggaggcgttcacctttgcccgcatgctgatcgcgcaagaggggctgctgtgcggtggcagtgctggcagcacrgtggcggtggccgtgaaggccgcgcaggagctgcaggagggccagcgctgcgtggtcattctgcccgactcagtgcggaactacatgaccaagttcctga

SEQ ID NO: 9716 - DNA, 201 bp, Homo sapiens
cgagcaggtgcacctggcagctgggccggcctgcctccgagtccccacatcaccacactgccccggcaaaatctccaaaaatcttgccagatattctgaaraaaatcggggacacccctatggtcagaatcaacaagattgggaagaagttcggcctgaagtgtgagctcttggccaagtgtgagttcttcaacgcgggcg

SEQ ID NO: 9717 - DNA, 201 bp, Homo sapiens
atgaaattcaaataacctaaaaatcaatcacttgaaagtgaacaatcagcggcatttagtacatccagaaagttgtgtaggcaccacctctgtcacgttcyggaacattctgtcatcaccccgtgaagcaatcatttcccctcccgtcttcctcctcccctggcaactgctgatcgactttgtgtctctgttgtctaaaat

SEQ ID NO: 9718 - DNA, 201 bp, Homo sapiens
cggagtcacacgtgggggtggcctggcggctgaagaacgaaatccccaattctcacatcctagaccagtaccgcaacgccagcaaccccctggctcactaygacaccaccgctgatgagatcctgcagcagtgtgatgggaagctggacatgctggtggcttcagtgggcacgggcggcaccatcacgggcattgccagga

SEQ ID NO: 9719 - DNA, 201 bp, Homo sapiens
gctgggccggcctgcctccgagtccccacatcaccacactgccccggcaaaatctccaaaaatcttgccagatattctgaagaaaatcggggacacccctwtggtcagaatcaacaagattgggaagaagttcggcctgaagtgtgagctcttggccaagtgtgagttcttcaacgcgggcgggagcgtgaaggaccgcat

SEQ ID NO: 9720 - DNA, 201 bp, Homo sapiens
ggggcggggagaagcctgggtggctcagcatcctccacgggctgcgccgtctgctcggggctgagctggcgggagcagtttgcgtgtttgggttttttaaytgagatgaaattcaaataacctaaaaatcaatcacttgaaagtgaacaatcagcggcatttagtacatccagaaagttgtgtaggcaccacctctgtcac

SEQ ID NO: 9721 - DNA, 201 bp, Homo sapiens
aggagcgggaccagaagtgaagtccggagcgctgggcggtgcggagcgggcccgccacccttgcccacttctccttcgctttcctgagccctaaacacacrcgtgattggtaactgcctggcctggcaccgttatccctgcacacggcacagagcatccgtctcccctcgttaacacatggcttcctaaatggccctgttt

SEQ ID NO: 9722 - DNA, 201 bp, Homo sapiens
gaagtccagtcagcggcagatggtgttcggggtggtcaccgccattgacttgctgaacttcgtggccgcccaggagcgggaccagaagtgaagtccggagmgctgggcggtgcggagcgggcccgccacccttgcccacttctccttcgctttcctgagccctaaacacacgcgtgattggtaactgcctggcctggcacc

SEQ ID NO: 9723 - DNA, 201 bp, Homo sapiens
cgcatgctgatcgcgcaagaggggctgctgtgcggtggcagtgctggcagcacggtggcggtggccgtgaaggccgcgcaggagctgcaggagggccagcrctgcgtggtcattctgcccgactcagtgcggaactacatgaccaagttcctgagcgacaggtggatgctgcagaagggctttctgaaggaggaggacctc

SEQ ID NO: 9724 - DNA, 201 bp, Homo sapiens
ggagcgggcccgccacccttgcccacttctccttcgctttcctgagccctaaacacacgcgtgattggtaactgcctggcctggcaccgttatccctgcasacggcacagagcatccgtctcccctcgttaacacatggcttcctaaatggccctgtttacggcctatgagatgaaatatgtgattttctctaatgtaact

SEQ ID NO: 9725 - DNA, 201 bp, Homo sapiens
gatgggaagctggacatgctggtggcttcagtgggcacgggcggcaccatcacgggcattgccaggaagctgaaggagaagtgtcctggatgcaggatcaytggggtggatcccgaagggtccatcctcgcagagccggaggagctgaaccagacggagcagacaacctacgaggtggaagggatcggctacgacttcatc

SEQ ID NO: 9726 - DNA, 201 bp, Homo sapiens
acgatgaggaggcgttcacctttgcccgcatgctgatcgcgcaagaggggctgctgtgcggtggcagtgctggcagcacggtggcggtggccgtgaaggcygcgcaggagctgcaggagggccagcgctgcgtggtcattctgcccgactcagtgcggaactacatgaccaagttcctgagcgacaggtggatgctgcaga

SEQ ID NO: 9727 - DNA, 201 bp, Homo sapiens
tggatcccgaagggtccatcctcgcagagccggaggagctgaaccagacggagcagacaacctacgaggtggaagggatcggctacgacttcatccccacrgtgctggacaggacggtggtggacaagtggttcaagagcaacgatgaggaggcgttcacctttgcccgcatgctgatcgcgcaagaggggctgctgtgcg

SEQ ID NO: 9728 - DNA, 201 bp, Homo sapiens
ctgagcgcgacgggacgctgaagcccggggacacgattatcgagccgacatccgggaacaccgggatcgggctggccctggctgcggcagtgaggggctaycgctgcatcatcgtgatgccagagaagatgagctccgagaaggtggacgtgctgcgggcactgggggctgagattgtgaggacgcccaccaatgccaggt

SEQ ID NO: 9729 - DNA, 201 bp, Homo sapiens
aggatcccatgacagattctgttgtcacgtctccttacagagtttgagcggtgctgaactgtcagcaccatctgtccggtcccagcatgccttctgagacyccccaggcagaagtggggcccacaggctgcccccaccgctcagggccacactcggcgaaggggagcctggagaaggggtccccagaggataaggaagcca

SEQ ID NO: 9730 - DNA, 201 bp, Homo sapiens; identical to SEQ ID NO: 9711

SEQ ID NO: 9731 - DNA, 201 bp, Homo sapiens; identical to SEQ ID NO: 9712

SEQ ID NO: 9732 - DNA, 201 bp, Homo sapiens; identical to SEQ ID NO: 9713

SEQ ID NO: 9733 - DNA, 201 bp, Homo sapiens
gcgggaccagaagtgaagtccggagcgctgggcggatgtttcaccaaggaaatattgagagagaagtcggccaggtaggatgaacacaggcaatgactgcrcagagtggattaaaggcaaaagagagaagagtccaggaaggggcggggagaagcctgggtggctcagcatcctccacgggctgcgccgtctgctcggggc

SEQ ID NO: 9734 - DNA, 201 bp, Homo sapiens; identical to SEQ ID NO: 9715

SEQ ID NO: 9735 - DNA, 201 bp, Homo sapiens; identical to SEQ ID NO: 9716

SEQ ID NO: 9736 - DNA, 201 bp, Homo sapiens; identical to SEQ ID NO: 9717

SEQ ID NO: 9737 - DNA, 201 bp, Homo sapiens; identical to SEQ ID NO: 9718

SEQ ID NO: 9738 - DNA, 201 bp, Homo sapiens; identical to SEQ ID NO: 9719

SEQ ID NO: 9739 - DNA, 201 bp, Homo sapiens; identical to SEQ ID NO: 9720

SEQ ID NO: 9740 - DNA, 201 bp, Homo sapiens
gaagtccagtcagcggcagatggtgttcggggtggtcaccgccattgacttgctgaacttcgtggccgcccaggagcgggaccagaagtgaagtccggagmgctgggcggatgtttcaccaaggaaatattgagagagaagtcggccaggtaggatgaacacaggcaatgactgcgcagagtggattaaaggcaaaagaga

SEQ ID NO: 9741 - DNA, 201 bp, Homo sapiens; identical to SEQ ID NO: 9723

SEQ ID NO: 9742 - DNA, 201 bp, Homo sapiens; identical to SEQ ID NO: 9725

SEQ ID NO: 9743 - DNA, 201 bp, Homo sapiens; identical to SEQ ID NO: 9726

SEQ ID NO: 9744 - DNA, 201 bp, Homo sapiens; identical to SEQ ID NO: 9727

SEQ ID NO: 9745 - DNA, 201 bp, Homo sapiens; identical to SEQ ID NO: 9728

SEQ ID NO: 9746 - DNA, 201 bp, Homo sapiens; identical to SEQ ID NO: 9729

SEQ ID NO: 9747 - DNA, 201 bp, Homo sapiens; identical to SEQ ID NO: 9713

SEQ ID NO: 9748 - DNA, 134 bp, Homo sapiens
aaggccctgggatcagaaaactcgctggttaatragtggccaagaacatatcagcttaagtttgggaaaaacacacaacagggcattgtgtcagagggtgaccaaagtgactccccagcagatggaccagggaa

SEQ ID NO: 9749 - DNA, 201 bp, Homo sapiens; identical to SEQ ID NO: 9714

SEQ ID NO: 9750 - DNA, 201 bp, Homo sapiens; identical to SEQ ID NO: 9715

SEQ ID NO: 9751 - DNA, 201 bp, Homo sapiens; identical to SEQ ID NO: 9717

SEQ ID NO: 9752 - DNA, 201 bp, Homo sapiens; identical to SEQ ID NO: 9718

SEQ ID NO: 9753 - DNA, 201 bp, Homo sapiens; identical to SEQ ID NO: 9721

SEQ ID NO: 9754 - DNA, 201 bp, Homo sapiens; identical to SEQ ID NO: 9722

SEQ ID NO: 9755 - DNA, 201 bp, Homo sapiens; identical to SEQ ID NO: 9723

SEQ ID NO: 9756 - DNA, 201 bp, Homo sapiens; identical to SEQ ID NO: 9726

SEQ ID NO: 9757 - DNA, 201 bp, Homo sapiens
agagccctggtagacctcagcatcgtcacagagaaagctgtgggtgcagaggccttggggacaaggcggggacggaatttcgtatttcagatgaccaaggycaatggccaagtgtgagttcttcaacgcgggcgggagcgtgaaggaccgcatcagcctgcggatgattgaggatgctgagcgcgacgggacgctgaagcc

SEQ ID NO: 9758 - DNA, 201 bp, Homo sapiens
ggctggcctcgtcctgggtgcgcagggggtcacctgaggtgtggtctgaggcctccggggaagggcatttctttgcaggacgcagtttccaggctcaagarcgtggagggaattcctaagggtcgctcttcaccaagagcgcagagccctggtagacctcagcatcgtcacagagaaagctgtgggtgcagaggccttggg

SEQ ID NO: 9759 - DNA, 201 bp, Homo sapiens
gttaatgagtggccaagaacatatcagcttaagtttgggaaaaacacacaacagggcattgtgtcagagggtgaccaaagtgactccccagcagatggacmagggaacgaacaggtgacctttgaactgaggccggagtggaagcagcgagggtgtgaagggccgggtgagggtcaaaggcagaagcaagcaggtggggag

SEQ ID NO: 9760 - DNA, 201 bp, Homo sapiens; identical to SEQ ID NO: 9711

SEQ ID NO: 9761 - DNA, 201 bp, Homo sapiens; identical to SEQ ID NO: 9720

SEQ ID NO: 9762 - DNA, 201 bp, Homo sapiens; identical to SEQ ID NO: 9724

SEQ ID NO: 9763 - DNA, 201 bp, Homo sapiens; identical to SEQ ID NO: 9725

SEQ ID NO: 9764 - DNA, 201 bp, Homo sapiens; identical to SEQ ID NO: 9727

SEQ ID NO: 9765 - DNA, 201 bp, Homo sapiens; identical to SEQ ID NO: 9728

SEQ ID NO: 9766 - DNA, 201 bp, Homo sapiens; identical to SEQ ID NO: 9711

SEQ ID NO: 9767 - DNA, 201 bp, Homo sapiens; identical to SEQ ID NO: 9712

SEQ ID NO: 9768 - DNA, 201 bp, Homo sapiens; identical to SEQ ID NO: 9716

SEQ ID NO: 9769 - DNA, 201 bp, Homo sapiens; identical to SEQ ID NO: 9719

SEQ ID NO: 9770 - DNA, 201 bp, Homo sapiens; identical to SEQ ID NO: 9718

SEQ ID NO: 9771 - DNA, 201 bp, Homo sapiens; identical to SEQ ID NO: 9728

SEQ ID NO: 9772 - DNA, 145 bp, Homo sapiens
tgtgatgggaagctggacatgctggtggcttcagtgggcacgggcggcaccatcacgggcattgccaggaagctgaaggagaagtgtcctggatgcatcaytggggtggatcccgaagggtccatcctcgcagagccggaggagc

SEQ ID NO: 9773 - DNA, 201 bp, Homo sapiens; identical to SEQ ID NO: 9729

SEQ ID NO: 9774 - DNA, 201 bp, Homo sapiens
  misc_feature (1)...(201): n = A,T,C or G, or insertion/deletion polymorphism (see Tables 1-2)
agacggcacggcccccaagacctaaaataccaccagctggcccttgtcggaaagtcccctggctggccctagtccattgactctgggccgagctgccaggnccacagaagcctgcggcactcagggctcccagggctcccttctccaacagttgctgtgcctccgtttccccaaaatgcaaggagctgatctcatctgtgt

SEQ ID NO: 9775 - DNA, 201 bp, Homo sapiens
  misc_feature (1)...(201): n = A,T,C or G, or insertion/deletion polymorphism (see Tables 1-2)
ctcataacagagacggcacggcccccaagacctaaaataccaccagctggcccttgtcggaaagtcccctggctggccctagtccattgactctgggccgngctgccagggccacagaagcctgcggcactcagggctcccagggctcccttctccaacagttgctgtgcctccgtttccccaaaatgcaaggagctgatc

SEQ ID NO: 9776 - DNA, 201 bp, Homo sapiens; identical to SEQ ID NO: 9711

SEQ ID NO: 9777 - DNA, 201 bp, Homo sapiens; identical to SEQ ID NO: 9712

SEQ ID NO: 9778 - DNA, 201 bp, Homo sapiens
  misc_feature (1)...(201): n = A,T,C or G, or insertion/deletion polymorphism (see Tables 1-2)
ccccaaatcaagtcttcctggagcatgtccacgcttgtcaccaccgtctgtggctgctttcaagcacgtcagggctgcgtgctcataacagagacggcacngcccccaagacctaaaataccaccagctggcccttgtcggaaagtcccctggctggccctagtccattgactctgggccgagctgccagggccacagaag

SEQ ID NO: 9779 - DNA, 201 bp, Homo sapiens
ttcgccctggtggtgcacgagcagatccagtcgcaggaccaggcctgggcaggcgtggtgggggggcctgcagggtccccaaatcaagtcttcctggagcytgtccacgcttgtcaccaccgtctgtggctgctttcaagcacgtcagggctgcgtgctcataacagagacggcacggcccccaagacctaaaataccacc

SEQ ID NO: 9780 - DNA, 201 bp, Homo sapiens; identical to SEQ ID NO: 9715

SEQ ID NO: 9781 - DNA, 201 bp, Homo sapiens; identical to SEQ ID NO: 9716

SEQ ID NO: 9782 - DNA, 201 bp, Homo sapiens; identical to SEQ ID NO: 9718

SEQ ID NO: 9783 - DNA, 201 bp, Homo sapiens; identical to SEQ ID NO: 9719

SEQ ID NO: 9784 - DNA, 201 bp, Homo sapiens
ctgatccttctgcctcagtctcccaagtagctgggaccacaagcgtgtgccaccatgctcgactaatttatttttaaaaatattctgtagagacagggtcwcaatatgttgcccaggctggtcccagacttccgggcttaaatgatcctcccaccttggcctcccacagcgctgggatcacaggtgtgagccactgtgccc

SEQ ID NO: 9785 - DNA, 201 bp, Homo sapiens; identical to SEQ ID NO: 9723

SEQ ID NO: 9786 - DNA, 201 bp, Homo sapiens
cctgctgtgctcaactgatccttctgcctcagtctcccaagtagctgggaccacaagcgtgtgccaccatgctcgactaatttatttttaaaaatattctrtagagacagggtctcaatatgttgcccaggctggtcccagacttccgggcttaaatgatcctcccaccttggcctcccacagcgctgggatcacaggtgt

SEQ ID NO: 9787 - DNA, 201 bp, Homo sapiens; identical to SEQ ID NO: 9725

SEQ ID NO: 9788 - DNA, 201 bp, Homo sapiens; identical to SEQ ID NO: 9726

SEQ ID NO: 9789 - DNA, 201 bp, Homo sapiens
  misc_feature (1)...(201): n = A,T,C or G, or insertion/deletion polymorphism (see Tables 1-2)
gaagcctgcggcactcagggctcccagggctcccttctccaacagttgctgtgcctccgtttccccaaaatgcaaggagctgatctcatctgtgttccctntcttttcctggggctctaagtgggccaccccaagggacctctgcctacaaagagaggagtgacagccgtggcggagttgggacgggctccgagggctctt

SEQ ID NO: 9790 - DNA, 201 bp, Homo sapiens; identical to SEQ ID NO: 9727

SEQ ID NO: 9791 - DNA, 201 bp, Homo sapiens; identical to SEQ ID NO: 9728

SEQ ID NO: 9792 - DNA, 201 bp, Homo sapiens
ggggcagccgctcgcccctcttttccatgtatccgtccagagtttgagcggtgctgaactgtcagcaccatctgtccggtcccagcatgccttctgagacyccccaggcagaagtggggcccacaggctgcccccaccgctcagggccacactcggcgaaggggagcctggagaaggggtccccagaggataaggaagcca

SEQ ID NO: 9793 - DNA, 201 bp, Homo sapiens
  misc_feature (1)...(201): n = A,T,C or G, or insertion/deletion polymorphism (see Tables 1-2)
tccattgactctgggccgagctgccagggccacagaagcctgcggcactcagggctcccagggctcccttctccaacagttgctgtgcctccgtttccccnaaatgcaaggagctgatctcatctgtgttccctatcttttcctggggctctaagtgggccaccccaagggacctctgcctacaaagagaggagtgacagc

SEQ ID NO: 9794 - DNA, 201 bp, Homo sapiens; identical to SEQ ID NO: 9712

SEQ ID NO: 9795 - DNA, 201 bp, Homo sapiens; identical to SEQ ID NO: 9713

SEQ ID NO: 9796 - DNA, 201 bp, Homo sapiens; identical to SEQ ID NO: 9714

SEQ ID NO: 9797 - DNA, 201 bp, Homo sapiens; identical to SEQ ID NO: 9715

SEQ ID NO: 9798 - DNA, 201 bp, Homo sapiens; identical to SEQ ID NO: 9716

SEQ ID NO: 9799 - DNA, 201 bp, Homo sapiens; identical to SEQ ID NO: 9717

SEQ ID NO: 9800 - DNA, 201 bp, Homo sapiens; identical to SEQ ID NO: 9718

SEQ ID NO: 9801 - DNA, 201 bp, Homo sapiens; identical to SEQ ID NO: 9719

SEQ ID NO: 9802 - DNA, 201 bp, Homo sapiens; identical to SEQ ID NO: 9721

SEQ ID NO: 9803 - DNA, 201 bp, Homo sapiens; identical to SEQ ID NO: 9722

SEQ ID NO: 9804 - DNA, 201 bp, Homo sapiens; identical to SEQ ID NO: 9723

SEQ ID NO: 9805 - DNA, 201 bp, Homo sapiens; identical to SEQ ID NO: 9726

SEQ ID NO: 9806 - DNA, 201 bp, Homo sapiens
taccaccctgcgcggagtcggccccgtccccgagagcgcccggcagcccctggccgtgggccgcaccggagccgcgcaaggcgactgttctgcgcctcggmtcggggttcggacccggctctgggcgcggtcacgcggggcgctgcgcacggcgtccggcggccacagagcgcggccatcgagtcccgccccggcgcggcg

SEQ ID NO: 9807 - DNA, 201 bp, Homo sapiens; identical to SEQ ID NO: 9711

SEQ ID NO: 9808 - DNA, 201 bp, Homo sapiens; identical to SEQ ID NO: 9720

SEQ ID NO: 9809 - DNA, 201 bp, Homo sapiens; identical to SEQ ID NO: 9724

SEQ ID NO: 9810 - DNA, 201 bp, Homo sapiens; identical to SEQ ID NO: 9725

SEQ ID NO: 9811 - DNA, 201 bp, Homo sapiens; identical to SEQ ID NO: 9727

SEQ ID NO: 9812 - DNA, 201 bp, Homo sapiens; identical to SEQ ID NO: 9728

SEQ ID NO: 9813 - DNA, 201 bp, Homo sapiens; identical to SEQ ID NO: 9729

SEQ ID NO: 9814 - DNA, 201 bp, Homo sapiens; identical to SEQ ID NO: 9711

SEQ ID NO: 9815 - DNA, 201 bp, Homo sapiens; identical to SEQ ID NO: 9712

SEQ ID NO: 9816 - DNA, 201 bp, Homo sapiens; identical to SEQ ID NO: 9713

SEQ ID NO: 9817 - DNA, 201 bp, Homo sapiens; identical to SEQ ID NO: 9733

SEQ ID NO: 9818 - DNA, 201 bp, Homo sapiens; identical to SEQ ID NO: 9715

SEQ ID NO: 9819 - DNA, 201 bp, Homo sapiens; identical to SEQ ID NO: 9716

SEQ ID NO: 9820 - DNA, 201 bp, Homo sapiens; identical to SEQ ID NO: 9717

SEQ ID NO: 9821 - DNA, 201 bp, Homo sapiens; identical to SEQ ID NO: 9718

SEQ ID NO: 9822 - DNA, 201 bp, Homo sapiens; identical to SEQ ID NO: 9719

SEQ ID NO: 9823 - DNA, 201 bp, Homo sapiens; identical to SEQ ID NO: 9720

SEQ ID NO: 9824 - DNA, 201 bp, Homo sapiens; identical to SEQ ID NO: 9740

SEQ ID NO: 9825 - DNA, 201 bp, Homo sapiens; identical to SEQ ID NO: 9723

SEQ ID NO: 9826 - DNA, 201 bp, Homo sapiens; identical to SEQ ID NO: 9725

SEQ ID NO: 9827 - DNA, 201 bp, Homo sapiens; identical to SEQ ID NO: 9726

SEQ ID NO: 9828 - DNA, 201 bp, Homo sapiens; identical to SEQ ID NO: 9727

SEQ ID NO: 9829 - DNA, 201 bp, Homo sapiens; identical to SEQ ID NO: 9728

SEQ ID NO: 9830 - DNA, 201 bp, Homo sapiens; identical to SEQ ID NO: 9729

SEQ ID NO: 9831 - DNA, 201 bp, Homo sapiens
tcacccaccccctctaccatcacctctaaccaggcaagccagggtgggagagcaatcaggagagccaggcctcagcttccaatgcctggagggcctccackttgtggccagcctgtggtggtggctctgaggcctaggcaacgagcgacagggctgccagttgcccctgggttcctttgtgctgctgtgtgcctcctctcc

SEQ ID NO: 9832 - DNA, 201 bp, Homo sapiens
agagctttgagccgccagagaccccagttgtcaaggacagcaccatcggtggctcaccacagcctcgcccctctgtcggggccttcaaccccgggatggargatattcttgactctgcaatgggcactaattgggtcccagaagaagcctctggagaggccagtgagattcccgtaccccaagggacagagctttccccct

SEQ ID NO: 9833 - DNA, 201 bp, Homo sapiens
cccactggccaggactggaatcacaccccccagaagacagaccatccatctgccctgctcagagaccccccggagccaggctctcccaggatctcatcacygcgcccccagggcctcagcaacccctccaccctctctgctcagccacagctttccagaagccactcctcgggcagcgtgctgccccttggggagctggag

SEQ ID NO: 9834 - DNA, 201 bp, Homo sapiens
gatctcatcactgcgcccccagggcctcagcaacccctccaccctctctgctcagccacagctttccagaagccactcctcgggcagcgtgctgccccttrgggagctggagggcaggaggagcaccagggatcggaggagccccgcagagccagaaggaggaccagcaagtgaaggggcagccaggcccctgccccgttt

SEQ ID NO: 9835 - DNA, 201 bp, Homo sapiens
tcagatggagacctcgtgccaaattacatttgagtttgtagaccaggaacagttgaaagatccagtgtgctaccttaagaaggcatttctcctggtacaakacataatggaggacaccatgcgcttcagagataacacccccaatgccatcgccattgtgcagctgcaggaactctctttgaggctgaagagctgcttcac

SEQ ID NO: 9836 - DNA, 201 bp, Homo sapiens
acacaggccatgagaggcagtccgagggatcctccagcccgcagctccaggagtctgtcttccacctgctggtgcccagtgtcatcctggtcttgctggcygtcggaggcctcttgttctacaggtggaggcggcggagccatcaagagcctcagagagcggattctcccttggagcaaccagagggcagccccctgactc

SEQ ID NO: 9837 - DNA, 201 bp, Homo sapiens
ggccagggacccaccggcctgtggtttgtgggaaagcagggtggacgctgaggagtgaaagaaccctgcacccagagggcctgcctggtgccaaggtatcycagcctggacaggcatggacctgtctccagagagaggagcctgaagttcgtggggcgggacagcgtcggcctgatttcccgtaaaggtgtgcagcctgag

SEQ ID NO: 9838 - DNA, 201 bp, Homo sapiens
aagccactcctcgggcagcgtgctgccccttggggagctggagggcaggaggagcaccagggatcggaggagccccgcagagccagaaggaggaccagcargtgaaggggcagccaggcccctgccccgttttaactccgttcctttgactgacacaggccatgagaggcagtccgagggatcctccagcccgcagctcca

SEQ ID NO: 9839 - DNA, 201 bp, Homo sapiens
  misc_feature (1)...(201): n = A,T,C or G, or insertion/deletion polymorphism (see Tables 1-2)
ctttgaaatataggtatgcacctgaggttgggggagggtctgcactcccaaaccccagcgcagtgtcctttccctgctgccgacaggaacctggggctgancaggttatccctgtcaggagccctggactgggctgcatctcagccccacctgcatggtatccagctcccatccacttctcacccttctttcctcctgacc

SEQ ID NO: 9840 - DNA, 201 bp, Homo sapiens
ctgttgttggtctgtctcctggcgagcaggagtatcaccgaggaggtgtcggagtactgtagccacatgattgggagtggacacctgcagtctctgcagcrgctgattgacagtcagatggagacctcgtgccaaattacatttgagtttgtagaccaggaacagttgaaagatccagtgtgctaccttaagaaggcattt

SEQ ID NO: 9841 - DNA, 201 bp, Homo sapiens
cagcccgcagctccaggagtctgtcttccacctgctggtgcccagtgtcatcctggtcttgctggccgtcggaggcctcttgttctacaggtggaggcggmggagccatcaagagcctcagagagcggattctcccttggagcaaccagagggcagccccctgactcaggatgacagacaggtggaactgccagtgtagag

SEQ ID NO: 9842 - DNA, 201 bp, Homo sapiens
gggcgggacagcgtcggcctgatttcccgtaaaggtgtgcagcctgagagacgggaagaggaggcctctggacctgctggtctgcactgacagcctgaagkgtctacaccctcggctcacctaagtgccctgtgctggttgccaggcgcagaggggaggccagccctgccctcaggacctgcctgacctgccagtgatgcc

SEQ ID NO: 9843 - DNA, 201 bp, Homo sapiens
gcctctggagaggccagtgagattcccgtaccccaagggacagagctttccccctccaggccaggagggggcagcatgcagacagagcccgccagacccarcaacttcctctcagcatcttctccactccctgcatcagcaaagggccaacagccggcagatgtaactggtaccgccttgcccagggtgggccccgtgagg

SEQ ID NO: 9844 - DNA, 201 bp, Homo sapiens
gcatgcagacagagcccgccagacccagcaacttcctctcagcatcttctccactccctgcatcagcaaagggccaacagccggcagatgtaactggtacmgccttgcccagggtgggccccgtgaggcccactggccaggactggaatcacaccccccagaagacagaccatccatctgccctgctcagagaccccccgg

SEQ ID NO: 9845 - DNA, 201 bp, Homo sapiens
gaaggaggaccagcaagtgaaggggcagccaggcccctgccccgttttaactccgttcctttgactgacacaggccatgagaggcagtccgagggatcctrcagcccgcagctccaggagtctgtcttccacctgctggtgcccagtgtcatcctggtcttgctggccgtcggaggcctcttgttctacaggtggaggcgg

SEQ ID NO: 9846 - DNA, 201 bp, Homo sapiens; identical to SEQ ID NO: 9831

SEQ ID NO: 9847 - DNA, 201 bp, Homo sapiens; identical to SEQ ID NO: 9832

SEQ ID NO: 9848 - DNA, 201 bp, Homo sapiens; identical to SEQ ID NO: 9833

SEQ ID NO: 9849 - DNA, 201 bp, Homo sapiens; identical to SEQ ID NO: 9834

SEQ ID NO: 9850 - DNA, 201 bp, Homo sapiens; identical to SEQ ID NO: 9835

SEQ ID NO: 9851 - DNA, 201 bp, Homo sapiens; identical to SEQ ID NO: 9836

SEQ ID NO: 9852 - DNA, 201 bp, Homo sapiens; identical to SEQ ID NO: 9837

SEQ ID NO: 9853 - DNA, 201 bp, Homo sapiens; identical to SEQ ID NO: 9838

SEQ ID NO: 9854 - DNA, 201 bp, Homo sapiens; identical to SEQ ID NO: 9839
  misc_feature (1)...(201): n = A,T,C or G, or insertion/deletion polymorphism (see Tables 1-2)

SEQ ID NO: 9855 - DNA, 201 bp, Homo sapiens; identical to SEQ ID NO: 9840

SEQ ID NO: 9856 - DNA, 201 bp, Homo sapiens; identical to SEQ ID NO: 9841

SEQ ID NO: 9857 - DNA, 201 bp, Homo sapiens; identical to SEQ ID NO: 9842

SEQ ID NO: 9858 - DNA, 201 bp, Homo sapiens; identical to SEQ ID NO: 9843

SEQ ID NO: 9859 - DNA, 201 bp, Homo sapiens; identical to SEQ ID NO: 9844

SEQ ID NO: 9860 - DNA, 201 bp, Homo sapiens; identical to SEQ ID NO: 9845

SEQ ID NO: 9861 - DNA, 201 bp, Homo sapiens; identical to SEQ ID NO: 9831

SEQ ID NO: 9862 - DNA, 201 bp, Homo sapiens; identical to SEQ ID NO: 9832

SEQ ID NO: 9863 - DNA, 201 bp, Homo sapiens; identical to SEQ ID NO: 9835

SEQ ID NO: 9864 - DNA, 201 bp, Homo sapiens
taactggccatgagaggcagtccgagggatcctccagcccgcagctccaggagtctgtcttccacctgctggtgcccagtgtcatcctggtcttgctggcygtcggaggcctcttgttctacaggtggaggcggcggagccatcaagagcctcagagagcggattctcccttggagcaaccagagggcagccccctgactc

SEQ ID NO: 9865 - DNA, 201 bp, Homo sapiens; identical to SEQ ID NO: 9837

SEQ ID NO: 9866 - DNA, 201 bp, Homo sapiens; identical to SEQ ID NO: 9839
  misc_feature (1)...(201): n = A,T,C or G, or insertion/deletion polymorphism (see Tables 1-2)

SEQ ID NO: 9867 - DNA, 201 bp, Homo sapiens; identical to SEQ ID NO: 9840

SEQ ID NO: 9868 - DNA, 201 bp, Homo sapiens; identical to SEQ ID NO: 9841

SEQ ID NO: 9869 - DNA, 201 bp, Homo sapiens; identical to SEQ ID NO: 9842

SEQ ID NO: 9870 - DNA, 201 bp, Homo sapiens
gcctctggagaggccagtgagattcccgtaccccaagggacagagctttccccctccaggccaggagggggcagcatgcagacagagcccgccagacccarcaacttcctctcagcatcttctccactccctgcatcagcaaagggccaacagccggcagatgtaactggccatgagaggcagtccgagggatcctccagc

SEQ ID NO: 9871 - DNA, 201 bp, Homo sapiens
cccagcaacttcctctcagcatcttctccactccctgcatcagcaaagggccaacagccggcagatgtaactggccatgagaggcagtccgagggatcctrcagcccgcagctccaggagtctgtcttccacctgctggtgcccagtgtcatcctggtcttgctggccgtcggaggcctcttgttctacaggtggaggcgg

SEQ ID NO: 9872 - DNA, 201 bp, Homo sapiens; identical to SEQ ID NO: 9831

SEQ ID NO: 9873 - DNA, 201 bp, Homo sapiens; identical to SEQ ID NO: 9835

SEQ ID NO: 9874 - DNA, 201 bp, Homo sapiens
gccaaggccatgagaggcagtccgagggatcctccagcccgcagctccaggagtctgtcttccacctgctggtgcccagtgtcatcctggtcttgctggcygtcggaggcctcttgttctacaggtggaggcggcggagccatcaagagcctcagagagcggattctcccttggagcaaccagagggcagccccctgactc

SEQ ID NO: 9875 - DNA, 201 bp, Homo sapiens; identical to SEQ ID NO: 9837

SEQ ID NO: 9876 - DNA, 201 bp, Homo sapiens; identical to SEQ ID NO: 9839
  misc_feature (1)...(201): n = A,T,C or G, or insertion/deletion polymorphism (see Tables 1-2)

SEQ ID NO: 9877 - DNA, 201 bp, Homo sapiens; identical to SEQ ID NO: 9840

SEQ ID NO: 9878 - DNA, 201 bp, Homo sapiens; identical to SEQ ID NO: 9842

SEQ ID NO: 9879 - DNA, 201 bp, Homo sapiens; identical to SEQ ID NO: 9841

SEQ ID NO: 9880 - DNA, 201 bp, Homo sapiens
aatctccttgacaaggactggaatattttcagcaagaactgcaacaacagctttgctgaatgctccagccaaggccatgagaggcagtccgagggatcctrcagcccgcagctccaggagtctgtcttccacctgctggtgcccagtgtcatcctggtcttgctggccgtcggaggcctcttgttctacaggtggaggcgg

SEQ ID NO: 9881 - DNA, 187 bp, Homo sapiens
tcctttctcgggaagcttgggtctccctgggagcgggtctgcccttagggggaggcctctgggctctgtgccctgcagctcggcagycattcgaggcggacagaaacggggcttggcgccccccgcgtgcacgtgtgctagcccaggcaggagggagcgcctcggcggaggagtcaaggaagagggg

SEQ ID NO: 9882 - DNA, 201 bp, Homo sapiens
ctgccaggctgggcccagcttgctcagtcaaggggctgccaggcccccagaaaacacttggagccatcgggtagcgatggtctatgccatggggaacaccyccattggtgtggccaagctgcccccattcctatccacccctctccccaccccgtcctgtccatgcgcttccagggccccacggtccccaggaggacgctt

SEQ ID NO: 9883 - DNA, 201 bp, Homo sapiens
  misc_feature (1)...(201): n = A,T,C or G, or insertion/deletion polymorphism (see Tables 1-2)
ggccccacggtccccaggaggacgcttcctggccaaagccccaagcctttggtgagaagccaattcccacttgacagaaggcgtccatccattcatctcantggccaaggacaaactctcctctgggacgtctgggactggcatttgtcccccactcaaattatcaaagctttctgctcagtcagttgtgtggggatggtg

SEQ ID NO: 9884 - DNA, 201 bp, Homo sapiens
agttagactgcaatactttaaacacgagacaaaacaatccatatgtttagggaaccagaaaagtcccctggtctgtcccttctttggggagcagggcctcracagctccagctcccttgacctaccttcctccccgcaccccgcccccaccttgtgcccctgtgtccagccccccagggggcctgtgtctgtgtctgtgcc

SEQ ID NO: 9885 - DNA, 201 bp, Homo sapiens
agacctggctgtggagagcagctaatgtgtggcccagagagcctgtctgtgtggagcacgtagtgcacagaatacgtgagagttgctctggcaggggcagyatcctcacaggatcgcctgggaggtgaggtgtgtgtgacccactggatgggagggcaatgagtgtgcacatacaaatggggcagtgtgcatgcaacacac

SEQ ID NO: 9886 - DNA, 201 bp, Homo sapiens
ggaaggagcaatcatttgtagatgggtgaaaaaagaatgaggttcaagggagcgtgcaccaggtgaggtgagcgtgtgtgctctcagggaagggcccaggmtcccatgcctgggaggagctgccagagagaagcaaaaaggcggctgtggatcgccctgggctgggcaccagtgacaggtcaggatctccaaacatggacg

SEQ ID NO: 9887 - DNA, 201 bp, Homo sapiens
ccaaacatggacgtcctcccctccaaatccagaagctcccagaaggtgtccttaactgcaaagctgtgcagggtactcctccagatggaatcaggaagtcsagacaccatcccaggtgtgtgtaagagagagagagagaacagggaggatacagaagtattgcagcccagatcccctatcagggggacagctggtgggcaa

SEQ ID NO: 9888 - DNA, 201 bp, Homo sapiens
gggaggatacagaagtattgcagcccagatcccctatcagggggacagctggtgggcaaagcagccaccccacagccttgtggctagagtacagtggggtrgaccctccagccccaatagccctagtacccagctggcagggttgcccacccctgctgtccacctgctccatcctctagggttccacaggcccctgaccgc

SEQ ID NO: 9889 - DNA, 201 bp, Homo sapiens
cctctgcccctcttccctggccaggggcttctccccctcagctctccctcacacctcccttcatcccagggtatccacctgcaccccactcccaagtagcytgaaaaagggaggacagtctttccccagcaggggtcaggggggcccctcaggaagcctaaggtcgtgctagtgtggtgacccccatacattcctccctgc

SEQ ID NO: 9890 - DNA, 201 bp, Homo sapiens
ccacgctctgcactggggagaaaacgggaggtgctcgtgctggccctgggtgggagcggggagtcctggtgagaccccggtgagatggaccatcctgcccscgtgggggatcccctttcccacatccgtgctgtgtcattgttgctctgcttcctttcaatgtgtcagtgcctggggggaggggaggagcaccccctcagc

SEQ ID NO: 9891 - DNA, 201 bp, Homo sapiens
gtctttccccagcaggggtcaggggggcccctcaggaagcctaaggtcgtgctagtgtggtgacccccatacattcctccctgctccccactgccaggagraccactgtccccagccagccaaagtaatgacacattccagccctgcccagcatgctgacctttggcctctaaccctcagtgggcccccaggtcagggcag

SEQ ID NO: 9892 - DNA, 201 bp, Homo sapiens
acccctctccccaccccgtcctgtccatgcgcttccagggccccacggtccccaggaggacgcttcctggccaaagccccaagcctttggtgagaagccayttcccacttgacagaaggcgtccatccattcatctcattggccaaggacaaactctcctctgggacgtctgggactggcatttgtcccccactcaaatta

SEQ ID NO: 9893 - DNA, 201 bp, Homo sapiens
aggggaaaacctcagttggcctctgcccctcttccctggccaggggcttctccccctcagctctccctcacacctcccttcatcccagggtatccacctgyaccccactcccaagtagcttgaaaaagggaggacagtctttccccagcaggggtcaggggggcccctcaggaagcctaaggtcgtgctagtgtggtgacc

SEQ ID NO: 9894 - DNA, 187 bp, Homo sapiens; identical to SEQ ID NO: 9881

SEQ ID NO: 9895 - DNA, 201 bp, Homo sapiens; identical to SEQ ID NO: 9882

SEQ ID NO: 9896 - DNA, 201 bp, Homo sapiens; identical to SEQ ID NO: 9883
  misc_feature (1)...(201): n = A,T,C or G, or insertion/deletion polymorphism (see Tables 1-2)

SEQ ID NO: 9897 - DNA, 201 bp, Homo sapiens; identical to SEQ ID NO: 9884

SEQ ID NO: 9898 - DNA, 201 bp, Homo sapiens; identical to SEQ ID NO: 9885

SEQ ID NO: 9899 - DNA, 201 bp, Homo sapiens
ggccccagaattcagcacgcacacaacacacaagggagagaacccccagatgagaaaataggaaggagtgagcgtgtgtgctctcagggaagggcccaggmtcccatgcctgggaggagctgccagagagaagcaaaaaggcggctgtggatcgccctgggctgggcaccagtgacaggtcaggatctccaaacatggacg

SEQ ID NO: 9900 - DNA, 201 bp, Homo sapiens; identical to SEQ ID NO: 9887

SEQ ID NO: 9901 - DNA, 201 bp, Homo sapiens; identical to SEQ ID NO: 9888

SEQ ID NO: 9902 - DNA, 201 bp, Homo sapiens; identical to SEQ ID NO: 9889

SEQ ID NO: 9903 - DNA, 201 bp, Homo sapiens; identical to SEQ ID NO: 9890

SEQ ID NO: 9904 - DNA, 201 bp, Homo sapiens; identical to SEQ ID NO: 9891

SEQ ID NO: 9905 - DNA, 201 bp, Homo sapiens; identical to SEQ ID NO: 9892

SEQ ID NO: 9906 - DNA, 201 bp, Homo sapiens; identical to SEQ ID NO: 9893

SEQ ID NO: 9907 - DNA, 201 bp, Homo sapiens
gaccccaatgtctcactagtgccaaaagacggaacaggatgggcaagcaaacaggagcagtccgaccccaagagttccgatgcctcaaccgctcagccgcyggaatcgcagccactgccggcttcacagacgcctgcctccaaccagccgaaacgacccccagcagcccccgagaacactcctttggttccaagcggggta

SEQ ID NO: 9908 - DNA, 201 bp, Homo sapiens
agaatgatgatggttgggcaggggcccatgaagaggttgactacactgaaaagctcaagttcagcgatgaggaagatgggcgagactctgatgaggagggwgctgagggccacagggattcccaatcagcttctggtgaggaacggccccctgaagcagatggcaaaaagggcaactcccccaacagcgaaccgcccactc

SEQ ID NO: 9909 - DNA, 201 bp, Homo sapiens
ccgccctatggaccccaggggccttaccgataccccactcctgatgggcccagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggggcc

SEQ ID NO: 9910 - DNA, 201 bp, Homo sapiens
tcctaagacggcctgggcagaaacctctcggcctccagagacagagccgggacctcctgccccaaagcctcccctacccccacctcaccggggccccgccrggaactggggcccccctggggactacccagatcgtgggggtcctccctgcaagcccccagcacctgaagatgaggatgaggcatggcggcagcgacgaaa

SEQ ID NO: 9911 - DNA, 201 bp, Homo sapiens
aggacaaggctgccaaggaaagggagtctgccgaacagtcgtctgggcccggaccaagcctccgcccccaaaattctacaacttggagggacggaggtggkcgtggccctgatgagctggagggcccggactccaaacttcatcatggtcatgatccccggggtgggctacagccttcaggcccaccccagttccctccct

SEQ ID NO: 9912 - DNA, 201 bp, Homo sapiens; identical to SEQ ID NO: 9907

SEQ ID NO: 9913 - DNA, 201 bp, Homo sapiens
aggggctcctgcccagcagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccag

SEQ ID NO: 9914 - DNA, 201 bp, Homo sapiens
ccagtcctttgcctgacacatcgttgcttcaggtacgccaggatctgccatccccttcggatttttattctactcctctgcagcctggtggccaaagtggmtttctcccttcaggggctcctgcccagcagatgcttctacccatggtagactcacagctgcctgtggtgaactttggctccctgccgccagcaccacctc

SEQ ID NO: 9915 - DNA, 201 bp, Homo sapiens
gcagcaggataaaccgcctcgtttccggaggctgaagcaggaacgggagaatgccgcaagggggtctgagggcaagccctccctaacccttccagcctccrctcctggacctgaggaggccctcacaacagtcacagtggccccagcacctcgccgggcagctgccaagtctcctgatctgtcaaaccagaactcagacca

SEQ ID NO: 9916 - DNA, 201 bp, Homo sapiens; identical to SEQ ID NO: 9911

SEQ ID NO: 9917 - DNA, 201 bp, Homo sapiens
acggagcttctcaagtcagcggccaggcatggaacggcagaatcggcgccctggcccagggggcaaggctggcagcagtggcagcagcagtggaggaggcrgtgggggtcctggaggaaggaccgggccaggacgaggcgacaagaggagctggccctctcccaagaaccgaagtcgtcctccagaggagcgtcccccggg

SEQ ID NO: 9918 - DNA, 201 bp, Homo sapiens
agccagagagccaaggatttgagtaaacggagcttctcaagtcagcggccaggcatggaacggcagaatcggcgccctggcccagggggcaaggctggcarcagtggcagcagcagtggaggaggcggtgggggtcctggaggaaggaccgggccaggacgaggcgacaagaggagctggccctctcccaagaaccgaagt

SEQ ID NO: 9919 - DNA, 201 bp, Homo sapiens
acaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggca

SEQ ID NO: 9920 - DNA, 201 bp, Homo sapiens
cagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggagcgagactc

SEQ ID NO: 9921 - DNA, 201 bp, Homo sapiens
gataaaccgcctcgtttccggaggctgaagcaggaacgggagaatgccgcaagggggtctgagggcaagccctccctaacccttccagcctccgctcctgsacctgaggaggccctcacaacagtcacagtggccccagcacctcgccgggcagctgccaagtctcctgatctgtcaaaccagaactcagaccaagccaat

SEQ ID NO: 9922 - DNA, 201 bp, Homo sapiens
aggctgcggatgaggatgacaaggggatgaggagcgagactcctccagtacctcccccaccaccctatctggccagttatccaggctttcctgagaatggrgcccctgggcccccaatctctcgctttcctctggaggaaccagggccccgtccactcccctggcccccaggcagtgatgaagtggccaagatacaaactc

SEQ ID NO: 9923 - DNA, 201 bp, Homo sapiens
ccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatccctccagaggagccaggggccccaccccgcc

SEQ ID NO: 9924 - DNA, 201 bp, Homo sapiens; identical to SEQ ID NO: 9908

SEQ ID NO: 9925 - DNA, 201 bp, Homo sapiens
ggctgcggatgaggatgacaaggggatgaggagcgagactcctccagtacctcccccaccaccctatctggccagttatccaggctttcctgagaatggarcccctgggcccccaatctctcgctttcctctggaggaaccagggccccgtccactcccctggcccccaggcagtgatgaagtggccaagatacaaactcc

SEQ ID NO: 9926 - DNA, 201 bp, Homo sapiens; identical to SEQ ID NO: 9909

SEQ ID NO: 9927 - DNA, 201 bp, Homo sapiens
cggagcccagctcctcaggccagcgcctgtatcctgaggttttctatggcagtgctgggccttccagttctcagatctctgggggagccatggactctcarttacatccaaacagtggaggcttccgccctgggacaccctcactgcacccttacagatcacagcccctatacctaccccccggcccagcccctccctcag

SEQ ID NO: 9928 - DNA, 201 bp, Homo sapiens
ggggagccatggactctcaattacatccaaacagtggaggcttccgccctgggacaccctcactgcacccttacagatcacagcccctatacctacccccsggcccagcccctccctcagcactgctctctggggtagctctcaagggccagtttctggatttctccacaatgcaagctacagagctggggaagttgccgg

SEQ ID NO: 9929 - DNA, 201 bp, Homo sapiens
  misc_feature (1)...(201): n = A,T,C or G, or insertion/deletion polymorphism (see Tables 1-2)
cctaggagaccaccacctgccccccacgatggggacagaaaggagctgccccgggagcagcctctgccccctggccccattggcacagaacgatcacagcntacagaccgaggcacagagcctggccccattcggccatcccatcgacctggtcccccagtccagtttggcactagtgacaaggactcagacttacgccta

SEQ ID NO: 9930 - DNA, 201 bp, Homo sapiens
gacccccactttgaggagccggggccaatggtgagaggggtgggtgggactcctcgggactctgccggggttagtccctttccccctaaacgtcgggagcrgcctcccagaaaaccagagctgctacaggaggaatctttgccacctcctcatagctctggattcttgggctctaagcctgagggcccaggccctcaggca

SEQ ID NO: 9931 - DNA, 201 bp, Homo sapiens
tacagtggagtcttccgcacccagcgcgtcgacctttaccagcaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgc

SEQ ID NO: 9932 - DNA, 201 bp, Homo sapiens
tctcctaggcccccaacccgatacgagccccagagggtcaacagcggcctcagttctgacccccactttgaggagccggggccaatggtgagaggggtggrtgggactcctcgggactctgccggggttagtccctttccccctaaacgtcgggagcggcctcccagaaaaccagagctgctacaggaggaatctttgcca

SEQ ID NO: 9933 - DNA, 191 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattta

SEQ ID NO: 9934 - DNA, 201 bp, Homo sapiens
cacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctgacccccactttgaggagccg

SEQ ID NO: 9935 - DNA, 201 bp, Homo sapiens
attggcacagaacgatcacagcgtacagaccgaggcacagagcctggccccattcggccatcccatcgacctggtcccccagtccagtttggcactagtgrcaaggactcagacttacgcctagtggtaggagacagcttgaaagcagagaaggagctaacagcatcagtcactgaggccattcctgtatcacgagactgg

SEQ ID NO: 9936 - DNA, 201 bp, Homo sapiens
ccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagt

SEQ ID NO: 9937 - DNA, 201 bp, Homo sapiens
tacagaccgaggcacagagcctggccccattcggccatcccatcgacctggtcccccagtccagtttggcactagtgacaaggactcagacttacgcctartggtaggagacagcttgaaagcagagaaggagctaacagcatcagtcactgaggccattcctgtatcacgagactgggagctgcttcccagtgctgctgc

SEQ ID NO: 9938 - DNA, 201 bp, Homo sapiens
ccccagtccagtttggcactagtgacaaggactcagacttacgcctagtggtaggagacagcttgaaagcagagaaggagctaacagcatcagtcactgargccattcctgtatcacgagactgggagctgcttcccagtgctgctgcctctgctgagccacaatccaagaacctggattctgggcactgtgtcccggagc

SEQ ID NO: 9939 - DNA, 201 bp, Homo sapiens
tggaggcttccgccctgggacaccctcactgcacccttacagatcacagcccctatacctaccccccggcccagcccctccctcagcactgctctctgggktagctctcaagggccagtttctggatttctccacaatgcaagctacagagctggggaagttgccggctggaggagttctctaccctccaccttccttcct

SEQ ID NO: 9940 - DNA, 201 bp, Homo sapiens
ccccgctagcttggggcgagcagagctgcatccagtggaactaaagccgttccaggattatcaaaaactgagcagcaaccttgggggacctggatcatcayggactcccccaactggaaggtccttctctggcctcaattcccgtctcaaggccacgccttccacctacagtggagtcttccgcacccagcgcgtcgacct

SEQ ID NO: 9941 - DNA, 201 bp, Homo sapiens
ctgcatccagtggaactaaagccgttccaggattatcaaaaactgagcagcaaccttgggggacctggatcatcacggactcccccaactggaaggtcctyctctggcctcaattcccgtctcaaggccacgccttccacctacagtggagtcttccgcacccagcgcgtcgacctttaccagcaggcctccccaccagat

SEQ ID NO: 9942 - DNA, 201 bp, Homo sapiens
cgttccaggattatcaaaaactgagcagcaaccttgggggacctggatcatcacggactcccccaactggaaggtccttctctggcctcaattcccgtctsaaggccacgccttccacctacagtggagtcttccgcacccagcgcgtcgacctttaccagcaggcctccccaccagatgccctgcgctggatacctaagc

SEQ ID NO: 9943 - DNA, 201 bp, Homo sapiens; identical to SEQ ID NO: 9907

SEQ ID NO: 9944 - DNA, 201 bp, Homo sapiens; identical to SEQ ID NO: 9913

SEQ ID NO: 9945 - DNA, 201 bp, Homo sapiens; identical to SEQ ID NO: 9914

SEQ ID NO: 9946 - DNA, 201 bp, Homo sapiens; identical to SEQ ID NO: 9910

SEQ ID NO: 9947 - DNA, 201 bp, Homo sapiens; identical to SEQ ID NO: 9911

SEQ ID NO: 9948 - DNA, 201 bp, Homo sapiens; identical to SEQ ID NO: 9915

SEQ ID NO: 9949 - DNA, 201 bp, Homo sapiens; identical to SEQ ID NO: 9917

SEQ ID NO: 9950 - DNA, 201 bp, Homo sapiens; identical to SEQ ID NO: 9918

SEQ ID NO: 9951 - DNA, 201 bp, Homo sapiens; identical to SEQ ID NO: 9919

SEQ ID NO: 9952 - DNA, 201 bp, Homo sapiens; identical to SEQ ID NO: 9920

SEQ ID NO: 9953 - DNA, 201 bp, Homo sapiens; identical to SEQ ID NO: 9921

SEQ ID NO: 9954 - DNA, 201 bp, Homo sapiens; identical to SEQ ID NO: 9908

SEQ ID NO: 9955 - DNA, 201 bp, Homo sapiens; identical to SEQ ID NO: 9922

SEQ ID NO: 9956 - DNA, 201 bp, Homo sapiens; identical to SEQ ID NO: 9923

SEQ ID NO: 9957 - DNA, 201 bp, Homo sapiens; identical to SEQ ID NO: 9909

SEQ ID NO: 9958 - DNA, 201 bp, Homo sapiens; identical to SEQ ID NO: 9925

SEQ ID NO: 9959 - DNA, 201 bp, Homo sapiens; identical to SEQ ID NO: 9927

SEQ ID NO: 9960 - DNA, 201 bp, Homo sapiens; identical to SEQ ID NO: 9928

SEQ ID NO: 9961 - DNA, 201 bp, Homo sapiens; identical to SEQ ID NO: 9929
  misc_feature (1)...(201): n = A,T,C or G, or insertion/deletion polymorphism (see Tables 1-2)

SEQ ID NO: 9962 - DNA, 201 bp, Homo sapiens; identical to SEQ ID NO: 9930

SEQ ID NO: 9963 - DNA, 201 bp, Homo sapiens; identical to SEQ ID NO: 9931

SEQ ID NO: 9964 - DNA, 201 bp, Homo sapiens; identical to SEQ ID NO: 9932

SEQ ID NO: 9965 - DNA, 190 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggattt

SEQ ID NO: 9966 - DNA, 201 bp, Homo sapiens; identical to SEQ ID NO: 9934

SEQ ID NO: 9967 - DNA, 201 bp, Homo sapiens; identical to SEQ ID NO: 9935

SEQ ID NO: 9968 - DNA, 201 bp, Homo sapiens; identical to SEQ ID NO: 9936

SEQ ID NO: 9969 - DNA, 201 bp, Homo sapiens; identical to SEQ ID NO: 9937

SEQ ID NO: 9970 - DNA, 201 bp, Homo sapiens; identical to SEQ ID NO: 9938

SEQ ID NO: 9971 - DNA, 201 bp, Homo sapiens; identical to SEQ ID NO: 9939

SEQ ID NO: 9972 - DNA, 201 bp, Homo sapiens
ccccgctagcttggggcgagcagagctgcatccagtggaactaaagccgttccaggattatcaaaaactgagcagcaaccttgggggacctggatcatcayggactcccccaactggaagacgcccttcttcccttaggtccttctctggcctcaattcccgtctcaaggccacgccttccacctacagtggagtcttccg

SEQ ID NO: 9973 - DNA, 201 bp, Homo sapiens
aagccgttccaggattatcaaaaactgagcagcaaccttgggggacctggatcatcacggactcccccaactggaagacgcccttcttcccttaggtcctyctctggcctcaattcccgtctcaaggccacgccttccacctacagtggagtcttccgcacccagcgcgtcgacctttaccagcaggcctccccaccagat

SEQ ID NO: 9974 - DNA, 201 bp, Homo sapiens
aactgagcagcaaccttgggggacctggatcatcacggactcccccaactggaagacgcccttcttcccttaggtccttctctggcctcaattcccgtctsaaggccacgccttccacctacagtggagtcttccgcacccagcgcgtcgacctttaccagcaggcctccccaccagatgccctgcgctggatacctaagc

SEQ ID NO: 9975 - DNA, 201 bp, Homo sapiens; identical to SEQ ID NO: 9907

SEQ ID NO: 9976 - DNA, 201 bp, Homo sapiens; identical to SEQ ID NO: 9913

SEQ ID NO: 9977 - DNA, 201 bp, Homo sapiens; identical to SEQ ID NO: 9914

SEQ ID NO: 9978 - DNA, 201 bp, Homo sapiens; identical to SEQ ID NO: 9910

SEQ ID NO: 9979 - DNA, 201 bp, Homo sapiens; identical to SEQ ID NO: 9911

SEQ ID NO: 9980 - DNA, 201 bp, Homo sapiens; identical to SEQ ID NO: 9915

SEQ ID NO: 9981 - DNA, 201 bp, Homo sapiens; identical to SEQ ID NO: 9917

SEQ ID NO: 9982 - DNA, 201 bp, Homo sapiens; identical to SEQ ID NO: 9918

SEQ ID NO: 9983 - DNA, 201 bp, Homo sapiens; identical to SEQ ID NO: 9919

SEQ ID NO: 9984 - DNA, 201 bp, Homo sapiens; identical to SEQ ID NO: 9920

SEQ ID NO: 9985 - DNA, 201 bp, Homo sapiens; identical to SEQ ID NO: 9921

SEQ ID NO: 9986 - DNA, 201 bp, Homo sapiens; identical to SEQ ID NO: 9908

SEQ ID NO: 9987 - DNA, 201 bp, Homo sapiens; identical to SEQ ID NO: 9922

SEQ ID NO: 9988 - DNA, 201 bp, Homo sapiens; identical to SEQ ID NO: 9923

SEQ ID NO: 9989 - DNA, 201 bp, Homo sapiens; identical to SEQ ID NO: 9909

SEQ ID NO: 9990 - DNA, 201 bp, Homo sapiens; identical to SEQ ID NO: 9925

SEQ ID NO: 9991 - DNA, 201 bp, Homo sapiens; identical to SEQ ID NO: 9927

SEQ ID NO: 9992 - DNA, 201 bp, Homo sapiens; identical to SEQ ID NO: 9928

SEQ ID NO: 9993 - DNA, 201 bp, Homo sapiens; identical to SEQ ID NO: 9929
  misc_feature (1)...(201): n = A,T,C or G, or insertion/deletion polymorphism (see Tables 1-2)

SEQ ID NO: 9994 - DNA, 201 bp, Homo sapiens; identical to SEQ ID NO: 9930

SEQ ID NO: 9995 - DNA, 201 bp, Homo sapiens; identical to SEQ ID NO: 9931

SEQ ID NO: 9996 - DNA, 201 bp, Homo sapiens; identical to SEQ ID NO: 9932

SEQ ID NO: 9997 - DNA, 191 bp, Homo sapiens; identical to SEQ ID NO: 9933

SEQ ID NO: 9998 - DNA, 201 bp, Homo sapiens; identical to SEQ ID NO: 9934

SEQ ID NO: 9999 - DNA, 201 bp, Homo sapiens; identical to SEQ ID NO: 9935

SEQ ID NO: 10000 - DNA, 201 bp, Homo sapiens; identical to SEQ ID NO: 9936

SEQ ID NO: 10001 - DNA, 201 bp, Homo sapiens; identical to SEQ ID NO: 9937

SEQ ID NO: 10002 - DNA, 201 bp, Homo sapiens; identical to SEQ ID NO: 9938

SEQ ID NO: 10003 - DNA, 201 bp, Homo sapiens; identical to SEQ ID NO: 9939

SEQ ID NO: 10004 - DNA, 201 bp, Homo sapiens; identical to SEQ ID NO: 9940

SEQ ID NO: 10005 - DNA, 201 bp, Homo sapiens; identical to SEQ ID NO: 9941

SEQ ID NO: 10006 - DNA, 201 bp, Homo sapiens; identical to SEQ ID NO: 9942

SEQ ID NO: 10007 - DNA, 201 bp, Homo sapiens; identical to SEQ ID NO: 9907

SEQ ID NO: 10008 - DNA, 201 bp, Homo sapiens; identical to SEQ ID NO: 9913

SEQ ID NO: 10009 - DNA, 201 bp, Homo sapiens; identical to SEQ ID NO: 9914

SEQ ID NO: 10010 - DNA, 201 bp, Homo sapiens; identical to SEQ ID NO: 9910

SEQ ID NO: 10011 - DNA, 201 bp, Homo sapiens; identical to SEQ ID NO: 9911

SEQ ID NO: 10012 - DNA, 201 bp, Homo sapiens; identical to SEQ ID NO: 9915

SEQ ID NO: 10013 - DNA, 201 bp, Homo sapiens; identical to SEQ ID NO: 9917

SEQ ID NO: 10014 - DNA, 201 bp, Homo sapiens; identical to SEQ ID NO: 9918

SEQ ID NO: 10015 - DNA, 201 bp, Homo sapiens; identical to SEQ ID NO: 9919

SEQ ID NO: 10016 - DNA, 201 bp, Homo sapiens; identical to SEQ ID NO: 9920

SEQ ID NO: 10017 - DNA, 201 bp, Homo sapiens; identical to SEQ ID NO: 9921

SEQ ID NO: 10018 - DNA, 201 bp, Homo sapiens; identical to SEQ ID NO: 9908

SEQ ID NO: 10019 - DNA, 201 bp, Homo sapiens; identical to SEQ ID NO: 9922

SEQ ID NO: 10020 - DNA, 201 bp, Homo sapiens; identical to SEQ ID NO: 9923

SEQ ID NO: 10021 - DNA, 201 bp, Homo sapiens; identical to SEQ ID NO: 9909

SEQ ID NO: 10022 - DNA, 201 bp, Homo sapiens; identical to SEQ ID NO: 9925

SEQ ID NO: 10023 - DNA, 201 bp, Homo sapiens; identical to SEQ ID NO: 9927

SEQ ID NO: 10024 - DNA, 201 bp, Homo sapiens; identical to SEQ ID NO: 9928

SEQ ID NO: 10025 - DNA, 201 bp, Homo sapiens; identical to SEQ ID NO: 9929
  misc_feature (1)...(201): n = A,T,C or G, or insertion/deletion polymorphism (see Tables 1-2)

SEQ ID NO: 10026 - DNA, 201 bp, Homo sapiens; identical to SEQ ID NO: 9930

SEQ ID NO: 10027 - DNA, 201 bp, Homo sapiens; identical to SEQ ID NO: 9931

SEQ ID NO: 10028 - DNA, 201 bp, Homo sapiens; identical to SEQ ID NO: 9932

SEQ ID NO: 10029 - DNA, 191 bp, Homo sapiens; identical to SEQ ID NO: 9933

SEQ ID NO: 10030 - DNA, 201 bp, Homo sapiens; identical to SEQ ID NO: 9934

SEQ ID NO: 10031 - DNA, 201 bp, Homo sapiens; identical to SEQ ID NO: 9935

SEQ ID NO: 10032 - DNA, 201 bp, Homo sapiens; identical to SEQ ID NO: 9936

SEQ ID NO: 10033 - DNA, 201 bp, Homo sapiens; identical to SEQ ID NO: 9937

SEQ ID NO: 10034 - DNA, 201 bp, Homo sapiens; identical to SEQ ID NO: 9938

SEQ ID NO: 10035 - DNA, 201 bp, Homo sapiens; identical to SEQ ID NO: 9939

SEQ ID NO: 10036 - DNA, 201 bp, Homo sapiens; identical to SEQ ID NO: 9940

SEQ ID NO: 10037 - DNA, 201 bp, Homo sapiens; identical to SEQ ID NO: 9941

SEQ ID NO: 10038 - DNA, 201 bp, Homo sapiens; identical to SEQ ID NO: 9942

SEQ ID NO: 10039 - DNA, 201 bp, Homo sapiens
gcgcctgcagttggaggccaccgagcgccagcgtggcggggctgagggggagctgcaggcactgcgtgcacgggcggaggaggctgaggcacaaaagcgayaggcgcaggaggaggccgagcgcttgcggaggcaggtgcaggacgagagccagcgtaagcggcaggcggaggtggagctggcctcgcgcgtgaaggccga

SEQ ID NO: 10040 - DNA, 201 bp, Homo sapiens; identical to SEQ ID NO: 3720

SEQ ID NO: 10041 - DNA, 201 bp, Homo sapiens
ggagaggctggctgagcagcagcgggcagaggagcgcgagcggctggccgaggtggaggccgcgctggagaagcagcggcagctggccgaggcgcacgccyaggcaaaggcacaggcggagcgggaggcgaaggagctgcagcagcgcatgcaggaggaggtggtgcggcgggaggaggcggcggtggacgcgcagcagca

SEQ ID NO: 10042 - DNA, 201 bp, Homo sapiens; identical to SEQ ID NO: 3721

SEQ ID NO: 10043 - DNA, 201 bp, Homo sapiens; identical to SEQ ID NO: 3722

SEQ ID NO: 10044 - DNA, 201 bp, Homo sapiens
gcctcctacgactacgtgcgccgccgcctcacggctgaggacctgttcgaggctcggatcatctctctcgagacctacaacctgctccgggagggcaccargagcctccgtgaggctctcgaggcggagtccgcctggtgctacctctatggcacgggctccgtggctggtgtctacctgcccggttccaggcagacactg

SEQ ID NO: 10045 - DNA, 201 bp, Homo sapiens; identical to SEQ ID NO: 3723

SEQ ID NO: 10046 - DNA, 201 bp, Homo sapiens
cgaccagctgtcagagcccagcgaggtgcgcagctacgtggacccgtccaccgacgagcgcctcagctacacgcagctgctcagggcggtgccgtcgtgaygacggcaccggccagctgctcctgccactgtcggacgcccgcaagctgaccttccgtggcctgcggaagcagatcaccatggaggagctggtgcgctcgc

SEQ ID NO: 10047 - DNA, 201 bp, Homo sapiens
tcagagcccagcgaggtgcgcagctacgtggacccgtccaccgacgagcgcctcagctacacgcagctgctcagggcggtgccgtcgtgacgacggcaccrgccagctgctcctgccactgtcggacgcccgcaagctgaccttccgtggcctgcggaagcagatcaccatggaggagctggtgcgctcgcaggtcatgga

SEQ ID NO: 10048 - DNA, 201 bp, Homo sapiens; identical to SEQ ID NO: 3746

SEQ ID NO: 10049 - DNA, 201 bp, Homo sapiens
gcgcagctacgtggacccgtccaccgacgagcgcctcagctacacgcagctgctcagggcggtgccgtcgtgacgacggcaccggccagctgctcctgccrctgtcggacgcccgcaagctgaccttccgtggcctgcggaagcagatcaccatggaggagctggtgcgctcgcaggtcatggacgaggccacggcgctgc

SEQ ID NO: 10050 - DNA, 201 bp, Homo sapiens; identical to SEQ ID NO: 3796

SEQ ID NO: 10051 - DNA, 201 bp, Homo sapiens
gcaggaggaacacgtggctgtggcacagctgcgggaggaggctgagcggcgggcacagcagcaggccgaggccgagcgggcgcgcgaggaggcagagcggsagctggagcgctggcagctcaaggccaacgaggcgctacggctgcggctgcaggcggaggaggtggcgcagcagaagagcctggcgcaggccgaggctga

SEQ ID NO: 10052 - DNA, 201 bp, Homo sapiens
gcgtgaaggccgaggccgaggcggcgcgcgagaagcagcgggccctgcaggccctggaggagctgcggctgcaggcggaggaggcggagcggcgcctgcgscaggccgaggtggagcgagcgcggcaggtacaggtggccctggagacggcgcagcgcagtgcagaggcggagctgcagagcaaacgcgcctccttcgccg

SEQ ID NO: 10053 - DNA, 201 bp, Homo sapiens
cgcacgcccaggcaaaggcacaggcggagcgggaggcgaaggagctgcagcagcgcatgcaggaggaggtggtgcggcgggaggaggcggcggtggacgcscagcagcagaagcgcagcattcaggaggagctgcagcagctgcggcagagctcggaggcggagatccaggccaaggcccggcaggcagaggcggctgagc

SEQ ID NO: 10054 - DNA, 201 bp, Homo sapiens; identical to SEQ ID NO: 3748

SEQ ID NO: 10055 - DNA, 201 bp, Homo sapiens; identical to SEQ ID NO: 3749

SEQ ID NO: 10056 - DNA, 201 bp, Homo sapiens; identical to SEQ ID NO: 3731

SEQ ID NO: 10057 - DNA, 201 bp, Homo sapiens; identical to SEQ ID NO: 3750

SEQ ID NO: 10058 - DNA, 201 bp, Homo sapiens; identical to SEQ ID NO: 3751

SEQ ID NO: 10059 - DNA, 201 bp, Homo sapiens; identical to SEQ ID NO: 3752

SEQ ID NO: 10060 - DNA, 201 bp, Homo sapiens; identical to SEQ ID NO: 3753

SEQ ID NO: 10061 - DNA, 201 bp, Homo sapiens; identical to SEQ ID NO: 3754

SEQ ID NO: 10062 - DNA, 201 bp, Homo sapiens; identical to SEQ ID NO: 3755

SEQ ID NO: 10063 - DNA, 201 bp, Homo sapiens; identical to SEQ ID NO: 3758

SEQ ID NO: 10064 - DNA, 201 bp, Homo sapiens; identical to SEQ ID NO: 3732

SEQ ID NO: 10065 - DNA, 201 bp, Homo sapiens; identical to SEQ ID NO: 3759

SEQ ID NO: 10066 - DNA, 201 bp, Homo sapiens; identical to SEQ ID NO: 3733

SEQ ID NO: 10067 - DNA, 201 bp, Homo sapiens; identical to SEQ ID NO: 3734

SEQ ID NO: 10068 - DNA, 201 bp, Homo sapiens; identical to SEQ ID NO: 3735

SEQ ID NO: 10069 - DNA, 201 bp, Homo sapiens; identical to SEQ ID NO: 3736

SEQ ID NO: 10070 - DNA, 201 bp, Homo sapiens
tccgccagcagggtctggcctcctacgactacgtgcgccgccgcctcacggctgaggacctgttcgaggctcggatcatctctctcgagacctacaacctkctccgggagggcaccaggagcctccgtgaggctctcgaggcggagtccgcctggtgctacctctatggcacgggctccgtggctggtgtctacctgcccg

SEQ ID NO: 10071 - DNA, 201 bp, Homo sapiens; identical to SEQ ID NO: 3737

SEQ ID NO: 10072 - DNA, 201 bp, Homo sapiens
tcatccgccagcagggtctggcctcctacgactacgtgcgccgccgcctcacggctgaggacctgttcgaggctcggatcatctctctcgagacctacaayctgctccgggagggcaccaggagcctccgtgaggctctcgaggcggagtccgcctggtgctacctctatggcacgggctccgtggctggtgtctacctgc

SEQ ID NO: 10073 - DNA, 201 bp, Homo sapiens
aggcctaccgcaagggcctgattgaccaccagacgtacctggagctgtccgagcaggagtgcgagtgggaggagatcaccatctcctcctcggacggcgtrgtcaagtccatgatcatcgaccgccgctccgggcgccagtacgacatcgatgatgccatcgccaagaacctcatcgaccgctcggcactggaccagtacc

SEQ ID NO: 10074 - DNA, 201 bp, Homo sapiens; identical to SEQ ID NO: 3739

SEQ ID NO: 10075 - DNA, 201 bp, Homo sapiens; identical to SEQ ID NO: 3740

SEQ ID NO: 10076 - DNA, 201 bp, Homo sapiens; identical to SEQ ID NO: 3741

SEQ ID NO: 10077 - DNA, 201 bp, Homo sapiens
aggagcgcctggcccagctgcgcaaggcatcggacagcgagctggagcggcagaaggggctggtggaggacacgctgaggcagcggcggcaggtggaggargagatcctggcgctgaaggcgagcttcgagaaggcggccgctggcaaggcggagctggagctggagctgggacgcatccgcagcaacgcggaggacacgc

SEQ ID NO: 10078 - DNA, 201 bp, Homo sapiens; identical to SEQ ID NO: 3742

SEQ ID NO: 10079 - DNA, 201 bp, Homo sapiens
cagcgtgaggcggctgcagccacgcagaaacggcaggagctggaagccgagctggccaaggtgcgggccgagatggaggtgctgctggccagcaaggcgarggctgaggaggagtcgcgctccaccagcgagaagtccaagcagaggctggaggccgaggccggccggttccgcgagctggccgaggaggccgcccgcctg

SEQ ID NO: 10080 - DNA, 201 bp, Homo sapiens; identical to SEQ ID NO: 3743

SEQ ID NO: 10081 - DNA, 201 bp, Homo sapiens; identical to SEQ ID NO: 3744

SEQ ID NO: 10082 - DNA, 201 bp, Homo sapiens; identical to SEQ ID NO: 3745

SEQ ID NO: 10083 - DNA, 201 bp, Homo sapiens
gaacgcatgatcatcatcatcatcgagatcattgagaagacagagatcatccgccagcagggtctggcctcctacgactacgtgcgccgccgcctcacggstgaggacctgttcgaggctcggatcatctctctcgagacctacaacctgctccgggagggcaccaggagcctccgtgaggctctcgaggcggagtccgcc

SEQ ID NO: 10084 - DNA, 201 bp, Homo sapiens
aacacgcatgagaacctcacgtacaggcagctgctggagcggtgcgtggaggaccccgagacgggcttgcgccttctgccactgaaaggggcggagaaggytgaggtggtggagaccacgcaggtgtacactgaggaggagacaagaagggcatttgaagagacacagatcgacattcccggcggcggcagccacggcggc

SEQ ID NO: 10085 - DNA, 201 bp, Homo sapiens; identical to SEQ ID NO: 3747

SEQ ID NO: 10086 - DNA, 201 bp, Homo sapiens; identical to SEQ ID NO: 3730

SEQ ID NO: 10087 - DNA, 201 bp, Homo sapiens; identical to SEQ ID NO: 3773

SEQ ID NO: 10088 - DNA, 201 bp, Homo sapiens; identical to SEQ ID NO: 3774

SEQ ID NO: 10089 - DNA, 201 bp, Homo sapiens
agcagcggcaggagctgttgcgtcagttccgcacgggcaaggtcaccgtggagaaggtcatcaagattctcattaccatcgtggaggaggtggagaccctkcggcaggagaggctgtccttcagcggcctccgtgcccctgtgccagccagcgagctcctggcttccggggtcctcagcagagcccagtttgagcagctca

SEQ ID NO: 10090 - DNA, 201 bp, Homo sapiens
aggagctctactcagagctgcaggcccgtgagacctttgaaaagaccccggttgaggtccccgtgggtggcttcaagggcaggacggtgacggtgtgggarctcatcagctctgagtacttcactgcggagcagcggcaggagctgttgcgtcagttccgcacgggcaaggtcaccgtggagaaggtcatcaagattctca

SEQ ID NO: 10091 - DNA, 201 bp, Homo sapiens; identical to SEQ ID NO: 3775

SEQ ID NO: 10092 - DNA, 201 bp, Homo sapiens; identical to SEQ ID NO: 3756

SEQ ID NO: 10093 - DNA, 201 bp, Homo sapiens; identical to SEQ ID NO: 3757

SEQ ID NO: 10094 - DNA, 201 bp, Homo sapiens; identical to SEQ ID NO: 3776

SEQ ID NO: 10095 - DNA, 201 bp, Homo sapiens; identical to SEQ ID NO: 3760

SEQ ID NO: 10096 - DNA, 201 bp, Homo sapiens
tccagccggcatggctgggaactgcagacctgtcctcctggtgggtccaggggcccctccagcttgtggagccccacactggggtgccgcctgcccgtctytctcccatggagccccagccccctttgggcccagggacaccagccaggctctgtgctgaccctcctgttgcacccagccctggtctcagcagcgaccacc

SEQ ID NO: 10097 - DNA, 201 bp, Homo sapiens; identical to SEQ ID NO: 3761

SEQ ID NO: 10098 - DNA, 201 bp, Homo sapiens; identical to SEQ ID NO: 3762

SEQ ID NO: 10099 - DNA, 201 bp, Homo sapiens; identical to SEQ ID NO: 3763

SEQ ID NO: 10100 - DNA, 201 bp, Homo sapiens
aacaaggacacgcacgaccagctgtcagagcccagcgaggtgcgcagctacgtggacccgtccaccgacgagcgcctcagctacacgcagctgctcagggmggtgccgtcgtgacgacggcaccggccagctgctcctgccactgtcggacgcccgcaagctgaccttccgtggcctgcggaagcagatcaccatggagga

SEQ ID NO: 10101 - DNA, 201 bp, Homo sapiens; identical to SEQ ID NO: 3764

SEQ ID NO: 10102 - DNA, 201 bp, Homo sapiens; identical to SEQ ID NO: 3765

SEQ ID NO: 10103 - DNA, 201 bp, Homo sapiens; identical to SEQ ID NO: 3767

SEQ ID NO: 10104 - DNA, 201 bp, Homo sapiens; identical to SEQ ID NO: 3768

SEQ ID NO: 10105 - DNA, 201 bp, Homo sapiens; identical to SEQ ID NO: 3989

SEQ ID NO: 10106 - DNA, 201 bp, Homo sapiens
gaggccgagcgggcgcgcgaggaggcagagcgggagctggagcgctggcagctcaaggccaacgaggcgctacggctgcggctgcaggcggaggaggtggygcagcagaagagcctggcgcaggccgaggctgagaagcagaaggaggaggcggagcgcgaggcgcggcggcgcggcaaggcggaggagcaggccgtccgg

SEQ ID NO: 10107 - DNA, 201 bp, Homo sapiens
agctggagcgctccctgcaggaggaacacgtggctgtggcacagctgcgggaggaggctgagcggcgggcacagcagcaggccgaggccgagcgggcgcgygaggaggcagagcgggagctggagcgctggcagctcaaggccaacgaggcgctacggctgcggctgcaggcggaggaggtggcgcagcagaagagcctgg

SEQ ID NO: 10108 - DNA, 201 bp, Homo sapiens; identical to SEQ ID NO: 3771

SEQ ID NO: 10109 - DNA, 201 bp, Homo sapiens
ggcctcgcgcgtgaaggccgaggccgaggcggcgcgcgagaagcagcgggccctgcaggccctggaggagctgcggctgcaggcggaggaggcggagcggygcctgcggcaggccgaggtggagcgagcgcggcaggtacaggtggccctggagacggcgcagcgcagtgcagaggcggagctgcagagcaaacgcgcctc

SEQ ID NO: 10110 - DNA, 201 bp, Homo sapiens
gcagcagaagagcctggcgcaggccgaggctgagaagcagaaggaggaggcggagcgcgaggcgcggcggcgcggcaaggcggaggagcaggccgtccggyagcgggagctggctgaacaagagctggagaagcagcggcagctggcggaaggcaccgcgcagcagcgcctggccgcggagcaggagttgatccggctgcg

SEQ ID NO: 10111 - DNA, 201 bp, Homo sapiens
gacggaggcggagatcgcgctcaaggagaaggaggcggagaacgagcgcctgcggcggctggcggaggacgaggccttccagcggcggcggctggaggagyaggccgcgcaacacaaggctgacatcgaggagcgcctggcccagctgcgcaaggcatcggacagcgagctggagcggcagaaggggctggtggaggacac

SEQ ID NO: 10112 - DNA, 201 bp, Homo sapiens
ccagcggcggcggctggaggagcaggccgcgcaacacaaggctgacatcgaggagcgcctggcccagctgcgcaaggcatcggacagcgagctggagcggyagaaggggctggtggaggacacgctgaggcagcggcggcaggtggaggaggagatcctggcgctgaaggcgagcttcgagaaggcggccgctggcaaggc

SEQ ID NO: 10113 - DNA, 201 bp, Homo sapiens
ggagctggagctgggacgcatccgcagcaacgcggaggacacgctgcgcagcaaggagcaggccgagctggaggctgcgaggcagcggcagctggcggcgkaggaggagcggcggcgccgtgaggctgaggagcgcgtgcagaagagcctggcggccgaggaggaggccgcacggcagcggaaggcggcgctggaggaagt

SEQ ID NO: 10114 - DNA, 201 bp, Homo sapiens
tgcgcgactgcggcagctggcagaggaggacctggcacagcagcgggccttggcagagaagatgctcaaggagaagatgcaggcggtgcaggaggccacgygactcaaggctgaggcggaactgctgcagcagcagaaggagcttgcgcaggagcaggcgcggcggctgcaggaggacaaggagcagatggcgcagcagct

SEQ ID NO: 10115 - DNA, 201 bp, Homo sapiens
gacgcagggcttccagcggacgctggaggccgagcggcagcggcagctggagatgagcgctgaggctgagcgcctcaagctgcgtgtggccgagatgagcygagcccaggcccgcgctgaggaggacgcccagcgcttccggaagcaggcggaggagatcggtgagaagctgcaccgcacggagctcgccacccaggagaa

SEQ ID NO: 10116 - DNA, 201 bp, Homo sapiens; identical to SEQ ID NO: 3777

SEQ ID NO: 10117 - DNA, 201 bp, Homo sapiens
caacacgcacgagaacctcacgtacctgcagctactggagcgctgcgtggaggaccccgagacgggcctgtgccttctgccactcacggataaggctgccragggcggggagctggtctacactgactccgaggcccgggacgtctttgagaaggccaccgtgtctgcgccgttcggcaagttccagggcaagacggtgac

SEQ ID NO: 10118 - DNA, 201 bp, Homo sapiens; identical to SEQ ID NO: 3778

SEQ ID NO: 10119 - DNA, 201 bp, Homo sapiens; identical to SEQ ID NO: 3779

SEQ ID NO: 10120 - DNA, 201 bp, Homo sapiens; identical to SEQ ID NO: 3780

SEQ ID NO: 10121 - DNA, 201 bp, Homo sapiens; identical to SEQ ID NO: 3781

SEQ ID NO: 10122 - DNA, 201 bp, Homo sapiens; identical to SEQ ID NO: 3782

SEQ ID NO: 10123 - DNA, 201 bp, Homo sapiens; identical to SEQ ID NO: 3783

SEQ ID NO: 10124 - DNA, 201 bp, Homo sapiens; identical to SEQ ID NO: 3784

SEQ ID NO: 10125 - DNA, 201 bp, Homo sapiens; identical to SEQ ID NO: 3785

SEQ ID NO: 10126 - DNA, 201 bp, Homo sapiens
cacgaccagctgtcagagcccagcgaggtgcgcagctacgtggacccgtccaccgacgagcgcctcagctacacgcagctgctcagggcggtgccgtcgtsacgacggcaccggccagctgctcctgccactgtcggacgcccgcaagctgaccttccgtggcctgcggaagcagatcaccatggaggagctggtgcgctc

SEQ ID NO: 10127 - DNA, 201 bp, Homo sapiens
gtgaggctgaggagcgcgtgcagaagagcctggcggccgaggaggaggccgcacggcagcggaaggcggcgctggaggaagtcgagcggctgaaagccaasgtggaggaggcgcggcgcctgcgggagcgagcggagcaggagtcggcgcggcagctgcagctggcccaggaggccgcccagaagcggctgcaggcggaag

SEQ ID NO: 10128 - DNA, 201 bp, Homo sapiens
cgaggccgagcgggcgcgcgaggaggcagagcgggagctggagcgctggcagctcaaggccaacgaggcgctacggctgcggctgcaggcggaggaggtgscgcagcagaagagcctggcgcaggccgaggctgagaagcagaaggaggaggcggagcgcgaggcgcggcggcgcggcaaggcggaggagcaggccgtccg

SEQ ID NO: 10129 - DNA, 201 bp, Homo sapiens; identical to SEQ ID NO: 3787

SEQ ID NO: 10130 - DNA, 201 bp, Homo sapiens
aggtggaggccgcgctggagaagcagcggcagctggccgaggcgcacgcccaggcaaaggcacaggcggagcgggaggcgaaggagctgcagcagcgcatkcaggaggaggtggtgcggcgggaggaggcggcggtggacgcgcagcagcagaagcgcagcattcaggaggagctgcagcagctgcggcagagctcggagg

SEQ ID NO: 10131 - DNA, 201 bp, Homo sapiens; identical to SEQ ID NO: 3727

SEQ ID NO: 10132 - DNA, 201 bp, Homo sapiens; identical to SEQ ID NO: 3788

SEQ ID NO: 10133 - DNA, 201 bp, Homo sapiens; identical to SEQ ID NO: 3728

SEQ ID NO: 10134 - DNA, 201 bp, Homo sapiens; identical to SEQ ID NO: 3789

SEQ ID NO: 10135 - DNA, 201 bp, Homo sapiens; identical to SEQ ID NO: 3729

SEQ ID NO: 10136 - DNA, 201 bp, Homo sapiens
gcccgacacgccgggccgcgtgcccctggacgaggccctgcagcgcggcacggtggacgcccgcaccgcacagaagctgcgtgacgtgggcgcctactccwagtacctcacctgccctaagaccaagctcaagatctcctataaggacgcgctggaccgcagcatggtggaggagggcacggggctgcggctgctggaggc

SEQ ID NO: 10137 - DNA, 201 bp, Homo sapiens; identical to SEQ ID NO: 3790

SEQ ID NO: 10138 - DNA, 201 bp, Homo sapiens
aaaaggctgctcgggcccggcaggaggagctctactcagagctgcaggcccgtgagacctttgaaaagaccccggttgaggtccccgtgggtggcttcaarggcaggacggtgacggtgtgggagctcatcagctctgagtacttcactgcggagcagcggcaggagctgttgcgtcagttccgcacgggcaaggtcaccg

SEQ ID NO: 10139 - DNA, 201 bp, Homo sapiens
cacctacggcgagctccagcagcggtgccggcccgaccagctgaccgggctgagcctgctgccgctctcagaaaaggctgctcgggcccggcaggaggagytctactcagagctgcaggcccgtgagacctttgaaaagaccccggttgaggtccccgtgggtggcttcaagggcaggacggtgacggtgtgggagctcat

SEQ ID NO: 10140 - DNA, 201 bp, Homo sapiens; identical to SEQ ID NO: 3714

SEQ ID NO: 10141 - DNA, 201 bp, Homo sapiens; identical to SEQ ID NO: 3716

SEQ ID NO: 10142 - DNA, 201 bp, Homo sapiens
gagcgtgctggaccagctgcgcggcgaggcggaggcggcccggcgggcggctgaggaggcggaggaggcccgggtgcaggcggagcgtgaggcggcgcagkcccggcggcaggtggaagaggccgagcggctgaagcagtcggcagaggagcaggcacaggcccgggctcaggcacaggcggctgcagagaagctgcgcaa

SEQ ID NO: 10143 - DNA, 201 bp, Homo sapiens
tcaacaaggacacgcacgaccagctgtcagagcccagcgaggtgcgcagctacgtggacccgtccaccgacgagcgcctcagctacacgcagctgctcagrgcggtgccgtcgtgacgacggcaccggccagctgctcctgccactgtcggacgcccgcaagctgaccttccgtggcctgcggaagcagatcaccatggag

SEQ ID NO: 10144 - DNA, 201 bp, Homo sapiens; identical to SEQ ID NO: 3717

SEQ ID NO: 10145 - DNA, 201 bp, Homo sapiens
aagcggctgcaggcggaagagaaggcacacgccttcgcggtgcagcagaaggagcaggagctacagcagacgctgcagcaggagcagagcgtgctggaccrgctgcgcggcgaggcggaggcggcccggcgggcggctgaggaggcggaggaggcccgggtgcaggcggagcgtgaggcggcgcagtcccggcggcaggtg

SEQ ID NO: 10146 - DNA, 201 bp, Homo sapiens; identical to SEQ ID NO: 3718

SEQ ID NO: 10147 - DNA, 201 bp, Homo sapiens
ggcggcgccgtgaggctgaggagcgcgtgcagaagagcctggcggccgaggaggaggccgcacggcagcggaaggcggcgctggaggaagtcgagcggctkaaagccaacgtggaggaggcgcggcgcctgcgggagcgagcggagcaggagtcggcgcggcagctgcagctggcccaggaggccgcccagaagcggctgc

SEQ ID NO: 10148 - DNA, 201 bp, Homo sapiens
ggccaggacagctactgtctggaggagcctgggccccttctggggggaggagtacacggtgcacctgcctctggatttccaccagctggccttctacgtgytggatgaggacactgtcgggcacgacgacatcatcggcaagatctcgctgagcagggaggcgattacagccgacccccgagggattgacagctggattaa

SEQ ID NO: 10149 - DNA, 201 bp, Homo sapiens
agcctgccggcctggccacgcgctttgccttcaagaagcgctacgtctggctcagcggggagaccctctccttctccaagagtcctgagtggcagatgtgycactccatccccgtgtctcacatccgcgccgtggagcgcgtagacgagggcgccttccaactgccccacgtgatgcaggtggtgacgcaggacggcacgg

SEQ ID NO: 10150 - DNA, 201 bp, Homo sapiens
gggaggagtttctctgactgtgggccaaagaccacccgctagaatgtctgctagaaatgcagatttctgaggcccagccagctactgactcagaatctgarggtatatgagggcaagaatcagggttatttaacagattccgtaggtcatttggatgagtatcagctttgaggaccacaggcctggggaatgggcaatttt

SEQ ID NO: 10151 - DNA, 201 bp, Homo sapiens
caggtaccctcaggaagaaccaaggctgggtgggggtccagtgtgccaaactcagacccttggagcctgggagaccttgggccaggctgtttatctctctytgggtctcagattaccctgtataaaaagaggagggaaagtctagatgtgtggttttcaaactggattccaatgaggtagttcaagaacaagggaggagtt

SEQ ID NO: 10152 - DNA, 201 bp, Homo sapiens
agcagcgacccctactgcctagtgaaagtggacgacgaggtggtggccaggacagctactgtctggaggagcctgggccccttctggggggaggagtacayggtgcacctgcctctggatttccaccagctggccttctacgtgctggatgaggacactgtcgggcacgacgacatcatcggcaagatctcgctgagcagg

SEQ ID NO: 10153 - DNA, 201 bp, Homo sapiens
ggtatatgagggcaagaatcagggttatttaacagattccgtaggtcatttggatgagtatcagctttgaggaccacaggcctggggaatgggcaattttmttttattttgtttttagagttgggggtctcactctgttgcccaggctgcagtacagtggcatgatcataggtcagtgcaccctcaaacttctggacttca

SEQ ID NO: 10154 - DNA, 201 bp, Homo sapiens
agtctcctgtctccttggacctctttgattctgtggtttggaggctcccagagacgtgcctagtcctgtgtgccttgagtccagaactcagggcatggaarccctttggcaggggccagccttgcactgagtgaaacttgccctctggcttgattcagactggagtggataggataaggaacctgacttatttgactgaga

SEQ ID NO: 10155 - DNA, 201 bp, Homo sapiens
gggcctgtcctgaggtcctggcccggcaaagagcagcaactgcccgcctgctggaggtgctcgcagacctggatcgtgcccacgaggagttccagcagcargagcgagggaaggcggccctgggcccccttggcccctaaggaaatgccagagctagcccggaaggaggagcaagagccagggggccctcttcagcgcatc

SEQ ID NO: 10156 - DNA, 201 bp, Homo sapiens
tgtctcacgtgtgagagacttcctggaccggctggtggatgtggatggggatgaagctggtgtcccagccagggccctgttcccgccctcggccattgttygagaaggctatctgctgaagcgcaaggaggagcctgccggcctggccacgcgctttgccttcaagaagcgctacgtctggctcagcggggagaccctctc

SEQ ID NO: 10157 - DNA, 201 bp, Homo sapiens
agccccttggctttgctggaagagctgaccttgggggactgccgccaggaccttgccaccaagctggtgaaactctttcttggccggggactggctgggcrctttctggactatctcacccggcgtgaggtggctcggaccatggaccccaacaccctcttccgttctaactccctggcatccaagtcgatggaacagttt

SEQ ID NO: 10158 - DNA, 201 bp, Homo sapiens
gcagcgacccctactgcctagtgaaagtggacgacgaggtggtggccaggacagctactgtctggaggagcctgggccccttctggggggaggagtacacrgtgcacctgcctctggatttccaccagctggccttctacgtgctggatgaggacactgtcgggcacgacgacatcatcggcaagatctcgctgagcaggg

SEQ ID NO: 10159 - DNA, 201 bp, Homo sapiens
agagctgaccttgggggactgccgccaggaccttgccaccaagctggtgaaactctttcttggccggggactggctgggcactttctggactatctcaccyggcgtgaggtggctcggaccatggaccccaacaccctcttccgttctaactccctggcatccaagtcgatggaacagtttatgaagctcgtgggcatgcc

SEQ ID NO: 10160 - DNA, 201 bp, Homo sapiens
agatgccaggtgccccgtccccactgcgggtggagctctgggactgggacatggtgggcaagaatgacttcttgggcatggtggagttctctccaaagacyctccagcagaagccacctaaaggctggttccgcctcctgccctttcccagagccgaggaggattctggggggaacctgggtgccctgcgagtgaaggtac

SEQ ID NO: 10161 - DNA, 201 bp, Homo sapiens
acaggcctggggaatgggcaattttattttattttgtttttagagttgggggtctcactctgttgcccaggctgcagtacagtggcatgatcataggtcartgcaccctcaaacttctggacttcagtgatcctcccacgttagcctccagagcagctgcgactacaggtgcaagccatcacgcctggctaatttttaaat

SEQ ID NO: 10162 - DNA, 201 bp, Homo sapiens; identical to SEQ ID NO: 10148

SEQ ID NO: 10163 - DNA, 201 bp, Homo sapiens; identical to SEQ ID NO: 10150

SEQ ID NO: 10164 - DNA, 201 bp, Homo sapiens; identical to SEQ ID NO: 10151

SEQ ID NO: 10165 - DNA, 201 bp, Homo sapiens; identical to SEQ ID NO: 10152

SEQ ID NO: 10166 - DNA, 201 bp, Homo sapiens; identical to SEQ ID NO: 10153

SEQ ID NO: 10167 - DNA, 201 bp, Homo sapiens; identical to SEQ ID NO: 10154

SEQ ID NO: 10168 - DNA, 201 bp, Homo sapiens; identical to SEQ ID NO: 10155

SEQ ID NO: 10169 - DNA, 201 bp, Homo sapiens
ctcacgtgtgagagacttcctggaccggctggtggatgtggatggggatgaagaagctggtgtcccagccagggccctgttcccgccctcggccattgttygagaaggctatctgctgaagcgcaaggaggagcctgccggcctggccacgcgctttgccttcaagaagcgctacgtctggctcagcggggagaccctctc

SEQ ID NO: 10170 - DNA, 201 bp, Homo sapiens; identical to SEQ ID NO: 10157

SEQ ID NO: 10171 - DNA, 201 bp, Homo sapiens; identical to SEQ ID NO: 10158

SEQ ID NO: 10172 - DNA, 201 bp, Homo sapiens; identical to SEQ ID NO: 10159

SEQ ID NO: 10173 - DNA, 201 bp, Homo sapiens; identical to SEQ ID NO: 10160

SEQ ID NO: 10174 - DNA, 201 bp, Homo sapiens; identical to SEQ ID NO: 10161

SEQ ID NO: 10175 - DNA, 201 bp, Homo sapiens; identical to SEQ ID NO: 10148

SEQ ID NO: 10176 - DNA, 201 bp, Homo sapiens; identical to SEQ ID NO: 10149

SEQ ID NO: 10177 - DNA, 201 bp, Homo sapiens; identical to SEQ ID NO: 10150

SEQ ID NO: 10178 - DNA, 201 bp, Homo sapiens; identical to SEQ ID NO: 10151

SEQ ID NO: 10179 - DNA, 201 bp, Homo sapiens; identical to SEQ ID NO: 10152

SEQ ID NO: 10180 - DNA, 201 bp, Homo sapiens; identical to SEQ ID NO: 10153

SEQ ID NO: 10181 - DNA, 201 bp, Homo sapiens; identical to SEQ ID NO: 10154

SEQ ID NO: 10182 - DNA, 201 bp, Homo sapiens; identical to SEQ ID NO: 10155

SEQ ID NO: 10183 - DNA, 201 bp, Homo sapiens; identical to SEQ ID NO: 10169

SEQ ID NO: 10184 - DNA, 201 bp, Homo sapiens; identical to SEQ ID NO: 10157

SEQ ID NO: 10185 - DNA, 201 bp, Homo sapiens; identical to SEQ ID NO: 10158

SEQ ID NO: 10186 - DNA, 201 bp, Homo sapiens; identical to SEQ ID NO: 10159

SEQ ID NO: 10187 - DNA, 201 bp, Homo sapiens; identical to SEQ ID NO: 10160

SEQ ID NO: 10188 - DNA, 201 bp, Homo sapiens; identical to SEQ ID NO: 10161

SEQ ID NO: 10189 - DNA, 201 bp, Homo sapiens; identical to SEQ ID NO: 10148

SEQ ID NO: 10190 - DNA, 201 bp, Homo sapiens; identical to SEQ ID NO: 10149

SEQ ID NO: 10191 - DNA, 201 bp, Homo sapiens; identical to SEQ ID NO: 10150

SEQ ID NO: 10192 - DNA, 201 bp, Homo sapiens; identical to SEQ ID NO: 10151

SEQ ID NO: 10193 - DNA, 201 bp, Homo sapiens; identical to SEQ ID NO: 10152

SEQ ID NO: 10194 - DNA, 201 bp, Homo sapiens; identical to SEQ ID NO: 10153

SEQ ID NO: 10195 - DNA, 201 bp, Homo sapiens; identical to SEQ ID NO: 10154

SEQ ID NO: 10196 - DNA, 201 bp, Homo sapiens; identical to SEQ ID NO: 10155

SEQ ID NO: 10197 - DNA, 201 bp, Homo sapiens; identical to SEQ ID NO: 10169

SEQ ID NO: 10198 - DNA, 201 bp, Homo sapiens; identical to SEQ ID NO: 10157

SEQ ID NO: 10199 - DNA, 201 bp, Homo sapiens; identical to SEQ ID NO: 10158

SEQ ID NO: 10200 - DNA, 201 bp, Homo sapiens; identical to SEQ ID NO: 10159

SEQ ID NO: 10201 - DNA, 201 bp, Homo sapiens; identical to SEQ ID NO: 10160

SEQ ID NO: 10202 - DNA, 201 bp, Homo sapiens; identical to SEQ ID NO: 10161

SEQ ID NO: 10203 - DNA, 201 bp, Homo sapiens; identical to SEQ ID NO: 10148

SEQ ID NO: 10204 - DNA, 201 bp, Homo sapiens; identical to SEQ ID NO: 10149

SEQ ID NO: 10205 - DNA, 201 bp, Homo sapiens; identical to SEQ ID NO: 10159

SEQ ID NO: 10206 - DNA, 201 bp, Homo sapiens; identical to SEQ ID NO: 10152

SEQ ID NO: 10207 - DNA, 201 bp, Homo sapiens; identical to SEQ ID NO: 10169

SEQ ID NO: 10208 - DNA, 201 bp, Homo sapiens; identical to SEQ ID NO: 10157

SEQ ID NO: 10209 - DNA, 201 bp, Homo sapiens; identical to SEQ ID NO: 10160

SEQ ID NO: 10210 - DNA, 201 bp, Homo sapiens; identical to SEQ ID NO: 10158

SEQ ID NO: 10211 - DNA, 130 bp, Homo sapiens
ttgtaatgcaattccaagtttaattggttttcacctaaatacacaatagcttattaaattaaaacctactctttgaacttataatttcaatttttcttttgtttattttgtaagctctgtggtggtttat

SEQ ID NO: 10212 - DNA, 201 bp, Homo sapiens
  misc_feature (1)...(201): n = A,T,C or G, or insertion/deletion polymorphism (see Tables 1-2)
ttttagatgcctggatggggtactcattgatgggaatgacaaagggatatcaaaagttgtgtacagatcttgcaatgggagggatcgactcggccctttanaaatgagtgatagtacatggctaacgtcagaaattcataaccctctggctgtgggacagtatgtcaacaattgttccaatgacagagcagctaatgtctg

SEQ ID NO: 10213 - DNA, 134 bp, Homo sapiens
aaatttgtaatgcaattccaagtttaattggttttcacctaaatacacaatagcttattaaattaaaacctactctttgaacttataatttcaatttttcttttgtttattttgtaagctctgtggtggtttat

SEQ ID NO: 10214 - DNA, 133 bp, Homo sapiens
aatttgtaatgcaattccaagtttaattggttttcacctaaatacacaatagcttattaaattaaaacctactctttgaacttataatttcaatttttcttttgtttattttgtaagctctgtggtggtttat

SEQ ID NO: 10215 - DNA, 132 bp, Homo sapiens
atttgtaatgcaattccaagtttaattggttttcacctaaatacacaatagcttattaaattaaaacctactctttgaacttataatttcaatttttcttttgtttattttgtaagctctgtggtggtttat

SEQ ID NO: 10216 - DNA, 130 bp, Homo sapiens; identical to SEQ ID NO: 10211

SEQ ID NO: 10217 - DNA, 201 bp, Homo sapiens; identical to SEQ ID NO: 10212
  misc_feature (1)...(201): n = A,T,C or G, or insertion/deletion polymorphism (see Tables 1-2)

SEQ ID NO: 10218 - DNA, 134 bp, Homo sapiens; identical to SEQ ID NO: 10213

SEQ ID NO: 10219 - DNA, 133 bp, Homo sapiens; identical to SEQ ID NO: 10214

SEQ ID NO: 10220 - DNA, 201 bp, Homo sapiens
caaagacaaagttatctcagatgaagatgtcctaggaacattactgaaagttttccaggctctattcttaaatgatttcaataaacaatcagaaatcttgwctatgcttccagaatctgttaaatcaaaatatcaagacctactggcagttgaacatcaaggggtgaaactgcttgaaaacagacatcaacagcaaagtac

SEQ ID NO: 10221 - DNA, 132 bp, Homo sapiens; identical to SEQ ID NO: 10215

SEQ ID NO: 10222 - DNA, 201 bp, Homo sapiens
  misc_feature (1)...(201): n = A,T,C or G, or insertion/deletion polymorphism (see Tables 1-2)
ttttagatgcctggatggggtactcattgatgggaatgacaaagggatatcaaaagttgtgtacagatcttgcaatgggagggatcgactcggccctttanaaatgagtgatagtacatggctaacgtcagaaattcataaccctctggctgtgggacagtatgtcaacaattgttccaatggtaagaaggcatcatgggg

SEQ ID NO: 10223 - DNA, 201 bp, Homo sapiens; identical to SEQ ID NO: 10220

SEQ ID NO: 10224 - DNA, 201 bp, Homo sapiens
gcccggcccctagcagagctgcgcaaccagtcggtgcgtgagttcctggacggcacccgcaagaccaacaacatcttctgctccaaccccaaccaccgcamccctacgctgaccagcatctactgccgaggatgttccaagccgctgtgctgctcgtgcgcgctccttgacagcagccacagtgagctcaagtgcgacatc

SEQ ID NO: 10225 - DNA, 121 bp, Homo sapiens
ggcagtctcaccaccccacctggatggaccgcctagccccaggagccccgtcataggaagtgaggtcttcctgcccaacagcaaccacgtggccagtggcrccggggaggcaggtagggag

SEQ ID NO: 10226 - DNA, 201 bp, Homo sapiens; identical to SEQ ID NO: 10224

SEQ ID NO: 10227 - DNA, 124 bp, Homo sapiens
ggcagtctcaccaccccacctggatggaccgcctagccccaggagccccgtcataggaagtgaggtcttcctgcccaacagcaaccacgtggccagtggcrccggggaggcaggtagggaggtg

SEQ ID NO: 10228 - DNA, 201 bp, Homo sapiens; identical to SEQ ID NO: 10224

SEQ ID NO: 10229 - DNA, 201 bp, Homo sapiens; identical to SEQ ID NO: 10224

SEQ ID NO: 10230 - DNA, 201 bp, Homo sapiens
ggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcgtcctcccgagagctggatgacagcagcagtgagtc

SEQ ID NO: 10231 - DNA, 201 bp, Homo sapiens
ctcagatgccgaaaactcgtcctcccgagagctggatgacagcagcagtgagtccagtgacctccagctggaaggccccagcaccctcagggtcctggackagaaccttgctgacccccaagcagaagacagacctctggttttctttgacctcaagattgacaatgaaacccagaagattagccagctggctgcggtgaa

SEQ ID NO: 10232 - DNA, 201 bp, Homo sapiens
ggcaggggaaggcagagcccagactcttggagcagttgttccccctggggactctgtcagaggctccatggaggcctctcaagtccaagtgcctctggaascctctccaattacattcccaccaccctgtgccccagaaaggccccccatcagcccagtcccaggcgcccgtcaagcaggcctctgagagtgctacccttc

SEQ ID NO: 10233 - DNA, 201 bp, Homo sapiens
ttgcccaagaaagaaacttctgtcacccttgcactctcctgtgttctgagtccctggccaatagcacagccttccatgccccgacccccaccccaagcctytccactaggcctctgccaggatctaagcccatgagcacagggactggctatcccaagacctggcagatgtggctgctcaataaacacttgttgaaccatc

SEQ ID NO: 10234 - DNA, 201 bp, Homo sapiens
ctcctcccatttatcccagtggctcaacaacttttttgccctccccttctcctccatggcttcccagcttgacatgtcttccgtggtgggggcaggggaargcagagcccagactcttggagcagttgttccccctggggactctgtcagaggctccatggaggcctctcaagtccaagtgcctctggaagcctctccaat

SEQ ID NO: 10235 - DNA, 201 bp, Homo sapiens
cctccagcccatgctcttacaggccctgcacagagtagcactcattaattcttggttaaggaatgaatcaacgaatgaatggctatgcatggacctctggkcagggagacctgggtcttctctggctgagaggggaaggctaaggcatggctgagattcaagccaccattccaggcctctttgcccaagaaagaaacttct

SEQ ID NO: 10236 - DNA, 188 bp, Homo sapiens
aaacttctgtcacccttgcactctcctgtgttctgagtccctggccaatagcacagccttccatgccccgacccccaccccaagcctctccactaggcctytgccaggatctaagcccatgagcacagggactggctatcccaagacctggcagatgtggctgctcaataaacacttgttgaaccatc

SEQ ID NO: 10237 - DNA, 178 bp, Homo sapiens
cacccttgcactctcctgtgttctgagtccctggccaatagcacagccttccatgccccgacccccaccccaagcctctccactaggcctctgccaggatytaagcccatgagcacagggactggctatcccaagacctggcagatgtggctgctcaataaacacttgttgaaccatc

SEQ ID NO: 10238 - DNA, 201 bp, Homo sapiens
aacaacttttttgccctccccttctcctccatggcttcccagcttgacatgtcttccgtggtgggggcaggggaaggcagagcccagactcttggagcagktgttccccctggggactctgtcagaggctccatggaggcctctcaagtccaagtgcctctggaagcctctccaattacattcccaccaccctgtgcccca

SEQ ID NO: 10239 - DNA, 201 bp, Homo sapiens
tggctgagaggggaaggctaaggcatggctgagattcaagccaccattccaggcctctttgcccaagaaagaaacttctgtcacccttgcactctcctgtrttctgagtccctggccaatagcacagccttccatgccccgacccccaccccaagcctctccactaggcctctgccaggatctaagcccatgagcacaggg

SEQ ID NO: 10240 - DNA, 201 bp, Homo sapiens
ctgagaggggaaggctaaggcatggctgagattcaagccaccattccaggcctctttgcccaagaaagaaacttctgtcacccttgcactctcctgtgttytgagtccctggccaatagcacagccttccatgccccgacccccaccccaagcctctccactaggcctctgccaggatctaagcccatgagcacagggact

SEQ ID NO: 10241 - DNA, 201 bp, Homo sapiens; identical to SEQ ID NO: 10224

SEQ ID NO: 10242 - DNA, 201 bp, Homo sapiens
ggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcgtgcatggagcccatggagaccgccgagccacaccc

SEQ ID NO: 10243 - DNA, 201 bp, Homo sapiens; identical to SEQ ID NO: 10224

SEQ ID NO: 10244 - DNA, 201 bp, Homo sapiens
ggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcgtgcatggagcccatggagaccgccgagccacagtc

SEQ ID NO: 10245 - DNA, 201 bp, Homo sapiens
ggcaggggaaagcagagcccagactcttggagcaggtgttccccctggggactctgtcagaggctccatggaggcctctcaagtccaagtgcctctggaascctctccaattacattcccaccaccctgtgccccagaaaggccccccatcagcccagtcccaggcgcccgtcaagcaggcctctgagagtgctacccttc

SEQ ID NO: 10246 - DNA, 201 bp, Homo sapiens
ttgcccaagaaagaaacttctgtcacccttgcactctcctgtattctgagtccctggccaatagcacagccttccatgccccgacccccaccccaagcctytccactaggcctctgccaggatctaagcccatgagcacagggactggctatcccaagacctggcagatgtggctgctcaataaacacttgttgaaccatc

SEQ ID NO: 10247 - DNA, 201 bp, Homo sapiens
ctcctcccatttatcccagtggctcaacaacttttttgccctccccttctcctccatggcttcccagcttgacatgtcttccgtggtgggggcaggggaargcagagcccagactcttggagcaggtgttccccctggggactctgtcagaggctccatggaggcctctcaagtccaagtgcctctggaascctctccaat

SEQ ID NO: 10248 - DNA, 201 bp, Homo sapiens; identical to SEQ ID NO: 10235

SEQ ID NO: 10249 - DNA, 201 bp, Homo sapiens
aaacttctgtcacccttgcactctcctgtattctgagtccctggccaatagcacagccttccatgccccgacccccaccccaagcctytccactaggcctytgccaggatctaagcccatgagcacagggactggctatcccaagacctggcagatgtggctgctcaataaacacttgttgaaccatcaaaaaaaaaaaaa

SEQ ID NO: 10250 - DNA, 201 bp, Homo sapiens
aacaacttttttgccctccccttctcctccatggcttcccagcttgacatgtcttccgtggtgggggcaggggaargcagagcccagactcttggagcagktgttccccctggggactctgtcagaggctccatggaggcctctcaagtccaagtgcctctggaascctctccaattacattcccaccaccctgtgcccca

SEQ ID NO: 10251 - DNA, 201 bp, Homo sapiens
tggctgagaggggaaggctaaggcatggctgagattcaagccaccattccaggcctctttgcccaagaaagaaacttctgtcacccttgcactctcctgtrttctgagtccctggccaatagcacagccttccatgccccgacccccaccccaagcctytccactaggcctytgccaggatctaagcccatgagcacaggg

SEQ ID NO: 10252 - DNA, 201 bp, Homo sapiens
ctgagaggggaaggctaaggcatggctgagattcaagccaccattccaggcctctttgcccaagaaagaaacttctgtcacccttgcactctcctgtrttytgagtccctggccaatagcacagccttccatgccccgacccccaccccaagcctytccactaggcctytgccaggatctaagcccatgagcacagggact

SEQ ID NO: 10253 - DNA, 201 bp, Homo sapiens; identical to SEQ ID NO: 10224

SEQ ID NO: 10254 - DNA, 201 bp, Homo sapiens; identical to SEQ ID NO: 10233

SEQ ID NO: 10255 - DNA, 201 bp, Homo sapiens; identical to SEQ ID NO: 10235

SEQ ID NO: 10256 - DNA, 201 bp, Homo sapiens
aaacttctgtcacccttgcactctcctgtgttctgagtccctggccaatagcacagccttccatgccccgacccccaccccaagcctytccactaggcctytgccaggatctaagcccatgagcacagggactggctatcccaagacctggcagatgtggctgctcaataaacacttgttgaaccatcaaaaaaaaaaaaa

SEQ ID NO: 10257 - DNA, 193 bp, Homo sapiens
cacccttgcactctcctgtgttctgagtccctggccaatagcacagccttccatgccccgacccccaccccaagcctytccactaggcctytgccaggatytaagcccatgagcacagggactggctatcccaagacctggcagatgtggctgctcaataaacacttgttgaaccatcaaaaaaaaaaaaaaa

SEQ ID NO: 10258 - DNA, 201 bp, Homo sapiens
tggctgagaggggaaggctaaggcatggctgagattcaagccaccattccaggcctctttgcccaagaaagaaacttctgtcacccttgcactctcctgtrttctgagtccctggccaatagcacagccttccatgccccgacccccaccccaagcctytccactaggcctytgccaggatytaagcccatgagcacaggg

SEQ ID NO: 10259 - DNA, 201 bp, Homo sapiens; identical to SEQ ID NO: 10224

SEQ ID NO: 10260 - DNA, 201 bp, Homo sapiens; identical to SEQ ID NO: 10230

SEQ ID NO: 10261 - DNA, 201 bp, Homo sapiens; identical to SEQ ID NO: 10224

SEQ ID NO: 10262 - DNA, 201 bp, Homo sapiens
ggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcggtgagtggcccagaagttcaggccaggactcctgc

SEQ ID NO: 10263 - DNA, 201 bp, Homo sapiens; identical to SEQ ID NO: 10245

SEQ ID NO: 10264 - DNA, 201 bp, Homo sapiens; identical to SEQ ID NO: 10246

SEQ ID NO: 10265 - DNA, 201 bp, Homo sapiens; identical to SEQ ID NO: 10247

SEQ ID NO: 10266 - DNA, 201 bp, Homo sapiens; identical to SEQ ID NO: 10235

SEQ ID NO: 10267 - DNA, 201 bp, Homo sapiens; identical to SEQ ID NO: 10249

SEQ ID NO: 10268 - DNA, 201 bp, Homo sapiens; identical to SEQ ID NO: 10250

SEQ ID NO: 10269 - DNA, 201 bp, Homo sapiens; identical to SEQ ID NO: 10251

SEQ ID NO: 10270 - DNA, 201 bp, Homo sapiens; identical to SEQ ID NO: 10252

SEQ ID NO: 10271 - DNA, 201 bp, Homo sapiens; identical to SEQ ID NO: 10224

SEQ ID NO: 10272 - DNA, 201 bp, Homo sapiens; identical to SEQ ID NO: 10244

SEQ ID NO: 10273 - DNA, 201 bp, Homo sapiens; identical to SEQ ID NO: 10232

SEQ ID NO: 10274 - DNA, 201 bp, Homo sapiens; identical to SEQ ID NO: 10233

SEQ ID NO: 10275 - DNA, 201 bp, Homo sapiens
ctcctcccatttatcccagtggctcaacaacttttttgccctccccttctcctccatggcttcccagcttgacatgtcttccgtggtgggggcaggggaargcagagcccagactcttggagcagttgttccccctggggactctgtcagaggctccatggaggcctctcaagtccaagtgcctctggaascctctccaat

SEQ ID NO: 10276 - DNA, 201 bp, Homo sapiens; identical to SEQ ID NO: 10235

SEQ ID NO: 10277 - DNA, 201 bp, Homo sapiens; identical to SEQ ID NO: 10256

SEQ ID NO: 10278 - DNA, 201 bp, Homo sapiens
cacccttgcactctcctgtgttctgagtccctggccaatagcacagccttccatgccccgacccccaccccaagcctytccactaggcctytgccaggatytaagcccatgagcacagggactggctatcccaagacctggcagatgtggctgctcaataaacacttgttgaaccatcaaaaaaaaaaaaaaaaaaaaaaa

SEQ ID NO: 10279 - DNA, 201 bp, Homo sapiens; identical to SEQ ID NO: 10250

SEQ ID NO: 10280 - DNA, 201 bp, Homo sapiens; identical to SEQ ID NO: 10258

SEQ ID NO: 10281 - DNA, 201 bp, Homo sapiens; identical to SEQ ID NO: 10224

SEQ ID NO: 10282 - DNA, 201 bp, Homo sapiens; identical to SEQ ID NO: 10244

SEQ ID NO: 10283 - DNA, 201 bp, Homo sapiens; identical to SEQ ID NO: 10232

SEQ ID NO: 10284 - DNA, 201 bp, Homo sapiens; identical to SEQ ID NO: 10233

SEQ ID NO: 10285 - DNA, 201 bp, Homo sapiens; identical to SEQ ID NO: 10275

SEQ ID NO: 10286 - DNA, 201 bp, Homo sapiens; identical to SEQ ID NO: 10235

SEQ ID NO: 10287 - DNA, 201 bp, Homo sapiens; identical to SEQ ID NO: 10256

SEQ ID NO: 10288 - DNA, 193 bp, Homo sapiens; identical to SEQ ID NO: 10257

SEQ ID NO: 10289 - DNA, 201 bp, Homo sapiens; identical to SEQ ID NO: 10250

SEQ ID NO: 10290 - DNA, 201 bp, Homo sapiens; identical to SEQ ID NO: 10258

SEQ ID NO: 10291 - DNA, 201 bp, Homo sapiens; identical to SEQ ID NO: 10224

SEQ ID NO: 10292 - DNA, 201 bp, Homo sapiens; identical to SEQ ID NO: 10230

SEQ ID NO: 10293 - DNA, 201 bp, Homo sapiens; identical to SEQ ID NO: 10224

SEQ ID NO: 10294 - DNA, 201 bp, Homo sapiens
ggcagtctcaccaccccacctggatggaccgcctagccccaggagccccgtcataggaagtgaggtcttcctgcccaacagcaaccacgtggccagtggcrccggggaggcagaggaacgcgttgtggtgatcagcagctcggaagactcagatgccgaaaactcggtgagtggcccagaagttcagcccaggactcctgc

SEQ ID NO: 10295 - DNA, 201 bp, Homo sapiens; identical to SEQ ID NO: 10232

SEQ ID NO: 10296 - DNA, 201 bp, Homo sapiens; identical to SEQ ID NO: 10233

SEQ ID NO: 10297 - DNA, 201 bp, Homo sapiens; identical to SEQ ID NO: 10275

SEQ ID NO: 10298 - DNA, 201 bp, Homo sapiens; identical to SEQ ID NO: 10235

SEQ ID NO: 10299 - DNA, 201 bp, Homo sapiens; identical to SEQ ID NO: 10256

SEQ ID NO: 10300 - DNA, 193 bp, Homo sapiens; identical to SEQ ID NO: 10257

SEQ ID NO: 10301 - DNA, 201 bp, Homo sapiens; identical to SEQ ID NO: 10250

SEQ ID NO: 10302 - DNA, 201 bp, Homo sapiens; identical to SEQ ID NO: 10258

SEQ ID NO: 10303 - DNA, 201 bp, Homo sapiens; identical to SEQ ID NO: 10224

SEQ ID NO: 10304 - DNA, 201 bp, Homo sapiens; identical to SEQ ID NO: 10224

SEQ ID NO: 10305 - DNA, 201 bp, Homo sapiens; identical to SEQ ID NO: 10230

SEQ ID NO: 10306 - DNA, 201 bp, Homo sapiens; identical to SEQ ID NO: 10231

SEQ ID NO: 10307 - DNA, 183 bp, Homo sapiens
gaaatcgcaggactacaagtccctcaatgccacttgcgccggaggcacttccttttccggttgtgctaggcgcctgctcctgycgacgtgttcttccggtggcggagcggcggattagccttcgcggggcaaaatggagctcgaggccatgagcagatataccagcccagtgaacccagctgt

SEQ ID NO: 10308 - DNA, 201 bp, Homo sapiens
  misc_feature (1)...(201): n = A,T,C or G, or insertion/deletion polymorphism (see Tables 1-2)
gccacttgcgccggaggcacttccttttccggttgtgctaggcgcctgctcctgccgacgtgttcttccggtggcggagcggcggattagccttcgcgggncaaaatggagctcgaggccatgagcagatataccagcccagtgaacccagctgtcttcccccatctgaccgtggtgcttttggccattggcatgttcttc

SEQ ID NO: 10309 - DNA, 140 bp, Homo sapiens
  misc_feature (1)...(140): n = A,T,C or G, or insertion/deletion polymorphism (see Tables 1-2)
gttcttccggtggcggagcggcggattagccttcgcgggncaaaatgctcgaggccatgagcagatataccagcccagtgaacccagctgtcttcccccatctgaccgtggtgcttttggccattggcatgttcttcacc

SEQ ID NO: 10310 - DNA, 201 bp, Homo sapiens
gagtccagcaggggccaggaagaagcgagcagcagggcagagtggagtccctggtggagggcaccagcgagagaagagaggatggaccatgcctggcacastgtggtgtggagttggagattctgctgggaactcctcggagctgggggtcttccagggacctgatctctgttgccgggaacatgaccgctgcccacagaa

SEQ ID NO: 10311 - DNA, 201 bp, Homo sapiens
cctcagtttcagctttcctgggcaccagcctggaccttgcccatggctatgccaagccttgggaatctcagcctcccctccgtaggttagactgaagcatrgcagaggctgttgtggacaatcaagaggatgaatggggggatctcaaggcccaaatgctggaccacatctcctgctgttctgggtaaccttgagctatgt

SEQ ID NO: 10312 - DNA, 201 bp, Homo sapiens
ctacggtgctctctgtgctcatgagactgcctggggctccttcatccacacccccggacccgagctgcagagagcactggccactcttcagagtcagtggsaggcatgccgagcgcttgaggagagtccagcaggggccaggaagaagcgagcagcagggcagagtggagtccctggtggagggcaccagcgagagaagag

SEQ ID NO: 10313 - DNA, 201 bp, Homo sapiens
  misc_feature (1)...(201): n = A,T,C or G, or insertion/deletion polymorphism (see Tables 1-2)
cgtccctggcaacccactggggtacctgagcttcctggccaaggatgctcagggactggccctgatccatgcccgctgggatgcgcataggaggctgcagncatgtagctgggaggatgagccggagctcaccgcagcctacggtgctctctgtgctcatgagactgcctggggctccttcatccacacccccggacccga

SEQ ID NO: 10314 - DNA, 201 bp, Homo sapiens
tgggcgtggccttcttcaacgtgctggagatcccctgctttgtgctggaggagcaggaggcgtgtgtggcgtggtactggtggggcgggtgtaggatgtayggcacagtgcccctcgctcgcctgcagcccaggaccttctacaatgcctcctggagctcccgggccacctccccaactcccagctcccggagcccagccc

SEQ ID NO: 10315 - DNA, 201 bp, Homo sapiens
ctccagggcccacagggtggcctaaaacctcagggtgcccgctgggtctgccgcagcttccgccgccacctggaccagtgtgagcaccagattgggccccrggaaatcgagttccagctgctcaacagcgcccaagagcccctcttccactgcaactgcacgcgccgtctggcacgcttcctgaggctccacagcccaccc

SEQ ID NO: 10316 - DNA, 201 bp, Homo sapiens
ccccaactcccagctcccggagcccagcccctcccaagcctcgacagaagcagcaccttcggaaggggccaccacatcagaaagggtccaagcgccccagsaaagccaacaccacagccctccaggaccctatggtctctcccaggcttgatgtggcccccacaggcctccagggcccacagggtggcctaaaacctcagg

SEQ ID NO: 10317 - DNA, 201 bp, Homo sapiens
  misc_feature (1)...(201): n = A,T,C or G, or insertion/deletion polymorphism (see Tables 1-2)
tcacagaaatgtctgtgtctgaatccaggattggggtgggtgttggagagggctttcagctcccctcctcccaggggggcctctttttttaacggctgccntgcccttcctggcccagccctaaacctaaattcaaatctcctccatgcctttgcgcaaaggacctccctcttgcactctaagccttagtttcctcctcta

SEQ ID NO: 10318 - DNA, 201 bp, Homo sapiens
  misc_feature (1)...(201): n = A,T,C or G, or insertion/deletion polymorphism (see Tables 1-2)
ctcctctaaaaaaagggggtctctaaacaggagctacctcatagggttgttgaggattaagtgaaccaatacatatacagtgcttagcacttaataagtantcccccctgcgacacctagctgaactatggtttggtgtctgatcttgagaggttgatgtaaccttttaaaggcctcagttcgctcacctgtgaaatgggt

SEQ ID NO: 10319 - DNA, 201 bp, Homo sapiens
  misc_feature (1)...(201): n = A,T,C or G, or insertion/deletion polymorphism (see Tables 1-2)
tctgaatccaggattggggtgggtgttggagagggctttcagctcccctcctcccaggggggcctctttttttaacggctgccgtgcccttcctggcccanccctaaacctaaattcaaatctcctccatgcctttgcgcaaaggacctccctcttgcactctaagccttagtttcctcctctaaaaaaagggggtctcta

SEQ ID NO: 10320 - DNA, 201 bp, Homo sapiens
  misc_feature (1)...(201): n = A,T,C or G, or insertion/deletion polymorphism (see Tables 1-2)
cttggacactggcatgggtctgggagcagcagctgctgtggctgggattacctgcagtgtggtagaactagtaaacaaattgcgggcacgagcccaagccngcaacttggaccaaagcggcaccaatgtagcaaaggtgatgaaggagtttgtgggtgggaacacacccaatgttcttaccttagttgacaattggtacca

SEQ ID NO: 10321 - DNA, 201 bp, Homo sapiens
tgagaaggccaggaaaagaaagagctgaaaatggagaaaaccagagttagaactgttggatacaggagaagaaacagcagctccactaccgacccccccccaggtttgatgtccttccaagaataaagtctttccctggtgatggtctctcgctctgtctttccagcatccactctcccttgtccttctgggggtgtatca

SEQ ID NO: 10322 - DNA, 201 bp, Homo sapiens
  misc_feature (1)...(201): n = A,T,C or G, or insertion/deletion polymorphism (see Tables 1-2)
ggaaccagcaatgagaaggccaggaaaagaaagagctgaaaatggagaaaaccagagttagaactgttggatacaggagaagaaacagcagctccactacngacccccccccaggtttgatgtccttccaagaataaagtctttccctggtgatggtctctcgctctgtctttccagcatccactctcccttgtccttctg

SEQ ID NO: 10323 - DNA, 201 bp, Homo sapiens
agcaatgagaaggccaggaaaagaaagagctgaaaatggagaaaaccagagttagaactgttggatacaggagaagaaacagcagctccactaccgacccscccccaggtttgatgtccttccaagaataaagtctttccctggtgatggtctctcgctctgtctttccagcatccactctcccttgtccttctgggggtg

SEQ ID NO: 10324 - DNA, 201 bp, Homo sapiens
cccagggatgaggcagatgagctccgtaaagctctgaacaagcttgcaagtcacatggtcatgaaggacaaaaaccgccacgataaagaccagcagcacargcagtggtttttgaaagagtttcctcggttgaaaagggagcttgaggatcacataaggaagctccgtgcccttgcagaggaggttgagcaggtccacaga

SEQ ID NO: 10325 - DNA, 201 bp, Homo sapiens
  misc_feature (1)...(201): n = A,T,C or G, or insertion/deletion polymorphism (see Tables 1-2)
gcatttgtgtagctgagcacagcaagggaggggttaatgcagatggcaagtgcaccaaggagaaggcaggaacactggagcctgcaataagggaggagagnggactggagagtgtggggaatgggaagaagtagtttactttggactaaagaatatattgggcgaagaatagagggggagcttgcaggaaccagcaatgag

SEQ ID NO: 10326 - DNA, 201 bp, Homo sapiens
caattggtaccaagtcacacaagggattgggaggaacatccgtgccatcagacgagccagagccaaccctcagttaggagcgtatgccccacccccgcatytcattgggcgaatctcagctgaaggcggtgaacaggttgagagggttgttgaaggccccgcccaggcaatgagcagaggaaccatgatcgtgggtgcagc

SEQ ID NO: 10327 - DNA, 134 bp, Homo sapiens
atcagacagtaaaacaggggcagagcctggaatygcactgaggcttgagtctgacttctctcccccacctgctgtgcccttaaactgcagagatcggggcgggggttggggggcaagcggctcagatgggttca

SEQ ID NO: 10328 - DNA, 201 bp, Homo sapiens
cgtgggatccacacagctcagaacagttggatcttgctcagtctctgtcagaggaagatcccttggacaagaggaccctgccttggtgtgagagtgagggwagaggaagctggaacgagggttaaggaaaaccttccagtctggacagtgactggagagctccaaggaaagcccctcggtaacccagccgctggcaccatg

SEQ ID NO: 10329 - DNA, 201 bp, Homo sapiens; identical to SEQ ID NO: 10320
  misc_feature (1)...(201): n = A,T,C or G, or insertion/deletion polymorphism (see Tables 1-2)

SEQ ID NO: 10330 - DNA, 201 bp, Homo sapiens; identical to SEQ ID NO: 10321

SEQ ID NO: 10331 - DNA, 201 bp, Homo sapiens; identical to SEQ ID NO: 10322
  misc_feature (1)...(201): n = A,T,C or G, or insertion/deletion polymorphism (see Tables 1-2)

SEQ ID NO: 10332 - DNA, 201 bp, Homo sapiens; identical to SEQ ID NO: 10323

SEQ ID NO: 10333 - DNA, 201 bp, Homo sapiens; identical to SEQ ID NO: 10324

SEQ ID NO: 10334 - DNA, 201 bp, Homo sapiens; identical to SEQ ID NO: 10325
  misc_feature (1)...(201): n = A,T,C or G, or insertion/deletion polymorphism (see Tables 1-2)

SEQ ID NO: 10335 - DNA, 201 bp, Homo sapiens; identical to SEQ ID NO: 10326

SEQ ID NO: 10336 - DNA, 201 bp, Homo sapiens; identical to SEQ ID NO: 10328

SEQ ID NO: 10337 - DNA, 201 bp, Homo sapiens; identical to SEQ ID NO: 10320
  misc_feature (1)...(201): n = A,T,C or G, or insertion/deletion polymorphism (see Tables 1-2)

SEQ ID NO: 10338 - DNA, 201 bp, Homo sapiens; identical to SEQ ID NO: 10321

SEQ ID NO: 10339 - DNA, 201 bp, Homo sapiens; identical to SEQ ID NO: 10322
  misc_feature (1)...(201): n = A,T,C or G, or insertion/deletion polymorphism (see Tables 1-2)

SEQ ID NO: 10340 - DNA, 201 bp, Homo sapiens; identical to SEQ ID NO: 10323

SEQ ID NO: 10341 - DNA, 201 bp, Homo sapiens; identical to SEQ ID NO: 10324

SEQ ID NO: 10342 - DNA, 201 bp, Homo sapiens; identical to SEQ ID NO: 10325
  misc_feature (1)...(201): n = A,T,C or G, or insertion/deletion polymorphism (see Tables 1-2)

SEQ ID NO: 10343 - DNA, 201 bp, Homo sapiens; identical to SEQ ID NO: 10326

SEQ ID NO: 10344 - DNA, 201 bp, Homo sapiens; identical to SEQ ID NO: 10328

SEQ ID NO: 10345 - DNA, 201 bp, Homo sapiens
atggggagaagaagtacccatgccctgaatgtgggagcttcttccgctctaagtcctacttgaacaaacacatccagaaggtgcatgtccgggctctcggrggccccctgggggacctgggccctgcccttggctcacctttctctcctcagcagaacatgtctctcctcgagtcctttgggtttcagattgttcagtcgg

SEQ ID NO: 10346 - DNA, 201 bp, Homo sapiens
acatgtctctcctcgagtcctttgggtttcagattgttcagtcggcatttgcgtcatctttagtagatcctgaggttgaccagcagcccatggggcctgamgggaaatgaggcagctgctgtgtccccacggaaacaaccatctggggactgctgggaaatgctgtgaatgcggagggaagtgatgtttgggttctgtagc

SEQ ID NO: 10347 - DNA, 201 bp, Homo sapiens
agttcctgctgatgaggtcggttatcgagatctgccaggaagtcatcaaacagtccaacgtacagatcctggtaccccctgcccgcgccgatataatgctytttcgcccccctgggacctcggacttgggcttccctttggacatgaccaacggggcagccttggcagccaacagcaatggcatcgccggcagcatgcagc

SEQ ID NO: 10348 - DNA, 201 bp, Homo sapiens; identical to SEQ ID NO: 10345

SEQ ID NO: 10349 - DNA, 201 bp, Homo sapiens; identical to SEQ ID NO: 10346

SEQ ID NO: 10350 - DNA, 201 bp, Homo sapiens; identical to SEQ ID NO: 10347

SEQ ID NO: 10351 - DNA, 201 bp, Homo sapiens; identical to SEQ ID NO: 10345

SEQ ID NO: 10352 - DNA, 201 bp, Homo sapiens; identical to SEQ ID NO: 10346

SEQ ID NO: 10353 - DNA, 201 bp, Homo sapiens; identical to SEQ ID NO: 10347

SEQ ID NO: 10354 - DNA, 201 bp, Homo sapiens; identical to SEQ ID NO: 10345

SEQ ID NO: 10355 - DNA, 201 bp, Homo sapiens
acatgtctctcctcgagtcctttgggtttcagattgttcagtcggcatttgcgtcatctttagtagatcctgaggttgaccagcagcccatggggcctgamgggaaatgaggcagctgctgtgtccccacggaaacaaccatctggggactgctgggaaatgctgtgaatgcggagggaatagggggtttcaatgctgttg

SEQ ID NO: 10356 - DNA, 201 bp, Homo sapiens; identical to SEQ ID NO: 10347

SEQ ID NO: 10357 - DNA, 201 bp, Homo sapiens; identical to SEQ ID NO: 10347

SEQ ID NO: 10358 - DNA, 201 bp, Homo sapiens; identical to SEQ ID NO: 10345

SEQ ID NO: 10359 - DNA, 201 bp, Homo sapiens; identical to SEQ ID NO: 10355

SEQ ID NO: 10360 - DNA, 201 bp, Homo sapiens; identical to SEQ ID NO: 10347

SEQ ID NO: 10361 - DNA, 201 bp, Homo sapiens; identical to SEQ ID NO: 10345

SEQ ID NO: 10362 - DNA, 201 bp, Homo sapiens; identical to SEQ ID NO: 10355

SEQ ID NO: 10363 - DNA, 201 bp, Homo sapiens; identical to SEQ ID NO: 10347

SEQ ID NO: 10364 - DNA, 201 bp, Homo sapiens
tggattttgaggaaattcagtcttatgacgtggatgttgaggctacagatggtggaggcctatcaggaaaatgctctttagtcgtcagggtcctggacgtsaatgacaatgcccctgaactcaccatgtcgttcttcatcagcctcatcccagaaaacttaccagagatcacagtggcagttttcagtgtttcagatgcag

SEQ ID NO: 10365 - DNA, 201 bp, Homo sapiens
ttacttcacttgagggtacttgacaatatgaacaaaaagtaaatttttatttgcataattttaagcttttgaaattaaattatctattcttccccccccccaaaaaaaagtattgtaaatccttaagtaaaattgtatttctagctattggtaagagttgtttcactattgctatgtaggactgtttaaaatgtgagtatc

SEQ ID NO: 10366 - DNA, 201 bp, Homo sapiens
acggccacctgtttgccctcaggtcgctggactacgaggccctgcagtctttcgagttccgcgtgggcgccacagaccgcggctccccggcgttgagcagmgaggcgctggtgcgcttgctggtgctggacgccaacgacaactcgcccttcgtgctgtacccgctgcagaacggctccgcgccctgcaccgagctggtgc

SEQ ID NO: 10367 - DNA, 201 bp, Homo sapiens
tacttcacttgagggtacttgacaatatgaacaaaaagtaaatttttatttgcataattttaagcttttgaaattaaattatctattcttccccccccccaaaaaaaagtattgtaaatccttaagtaaaattgtatttctagctattggtaagagttgtttcactattgctatgtaggactgtttaaaatgtgagtatct

SEQ ID NO: 10368 - DNA, 201 bp, Homo sapiens
aagttgtaagaacgaatttaaaaatctctgcaaagacatccgagagggtcgacggtagatgtggtgattgggagctgaaaaggatttttcttccgtattcrgacataatagacatgatgcaaactaaagtacagaacaagaaaaggcaagtggctttcttcattttattgatgctttggggagaggtgggttctgaatcga

SEQ ID NO: 10369 - DNA, 155 bp, Homo sapiens
taaaaatacagaccacgtttacagctaaagctgagatagatgtgtccgggaaggyagtcgtcgccagacaagttgtaagaacgaatttaaaaatctctgcaaagacatccgagagggtcgacggtagatgtggtgattgggagctgaaaaggatt

SEQ ID NO: 10370 - DNA, 201 bp, Homo sapiens
cacacgatttagacaccggcagcaacggccttcagaggtacacaatcagctccaaccctcacttccacgttctcacccgcaatcgcagcgaaggcaggaarttcccggagctggtgctagacaaaccgttggaccgcgaggagcagccccaactcaggctaacgctgatcgcgctggatggcgggtctccgccccggtcag

SEQ ID NO: 10371 - DNA, 201 bp, Homo sapiens
gcatcaacgcccaggtcacctactcgctgctgccgccccaggacccgcacctgcccctctcttccctggtctccatcaacgcggacaacggccacctgttygccctcaggtcgctggactacgaggccctgcagtctttcgagttccgcgtgggcgccacagaccgcggctccccggcgttgagcagcgaggcgctggtgc

SEQ ID NO: 10372 - DNA, 201 bp, Homo sapiens
gttccgcgtgggcgccacagaccgcggctccccggcgttgagcagcgaggcgctggtgcgcttgctggtgctggacgccaacgacaactcgcccttcgtgytgtacccgctgcagaacggctccgcgccctgcaccgagctggtgccccgggcggccgagccgggctacctggtgaccaaggtggtggcggtggacggcga

SEQ ID NO: 10373 - DNA, 201 bp, Homo sapiens
ctcggccaccgccacgctgcacgtgctcctggtggacggcttctcccagccctacctgcctctccctgaggcggccccggcccaagcccaggccgactctytcaccgtctacctggtggtggcgttggcctcggtgtcgtcgctcttcctcttttcggtgctcctgttcgtggcggtgcggctgtgcaggaggagcagggc

SEQ ID NO: 10374 - DNA, 201 bp, Homo sapiens
caccaaggctgaaaacccagcagagcataactgtgcaggtctccgacgtcaatgacaacgcccccgccttcacccaaacctcctacaccctgttcgtccgsgagaacaacagccccgccctgcacatcggcagcgtcagcgccacagacagagactcaggcatcaacgcccaggtcacctactcgctgctgccgccccagg

SEQ ID NO: 10375 - DNA, 201 bp, Homo sapiens
tcaaggacaatggcgagcctccgcgctcggccaccgccacgctgcacgtgctcctggtggacggcttctcccagccctacctgcctctccctgaggcggcmccggcccaagcccaggccgactctctcaccgtctacctggtggtggcgttggcctcggtgtcgtcgctcttcctcttttcggtgctcctgttcgtggcgg

SEQ ID NO: 10376 - DNA, 201 bp, Homo sapiens
tggaccgcgaggagcagccccaactcaggctaacgctgatcgcgctggatggcgggtctccgccccggtcagggacctccgagattcagatccaggttttsgacatcaatgacaacgtccccgagtttgctcaggagctctatgaagcacaagtccctgagaacaaccccctcggctctctggttattaccgtctcagcca

SEQ ID NO: 10377 - DNA, 201 bp, Homo sapiens
agctgctcaaggccacggagcccggtctgttcggcgtgtgggcgcacaatggcgaggtgcgcaccgccaggctgctgagcgagcgagacgcagccaagcasaggctggtggtgcttgtcaaggacaatggcgagcctccgcgctcggccaccgccacgctgcacgtgctcctggtggacggcttctcccagccctacctgc

SEQ ID NO: 10378 - DNA, 201 bp, Homo sapiens
gcggccgagccgggctacctggtgaccaaggtggtggcggtggacggcgactcgggccagaacgcctggctgtcgtaccagctgctcaaggccacggagcycggtctgttcggcgtgtgggcgcacaatggcgaggtgcgcaccgccaggctgctgagcgagcgagacgcagccaagcagaggctggtggtgcttgtcaag

SEQ ID NO: 10379 - DNA, 201 bp, Homo sapiens
cagctaaagctgagatagatgtgtccgggaaggcagtcgtcgccagacaagttgtaagaacgaatttaaaaatctctgcaaagacatccgagagggtcgasggtagatgtggtgattgggagctgaaaaggatttttcttccgtattcagacataatagacatgatgcaaactaaagtacagaacaagaaaaggcaagtgg

SEQ ID NO: 10380 - DNA, 201 bp, Homo sapiens
accgttggaccgcgaggagcagccccaactcaggctaacgctgatcgcgctggatggcgggtctccgccccggtcagggacctccgagattcagatccagrttttggacatcaatgacaacgtccccgagtttgctcaggagctctatgaagcacaagtccctgagaacaaccccctcggctctctggttattaccgtctc

SEQ ID NO: 10381 - DNA, 201 bp, Homo sapiens
tattaccgtctcagccagagatttagatgcaggatcgtttgggaaggtatcttacgccctgtttcaagtcgatgacgtcaaccaacccttcgaaataaackcaatcacaggagaaattcggctgagaaaggctttggattttgaggaaattcagtcttatgacgtggatgttgaggctacagatggtggaggcctatcagg

SEQ ID NO: 10382 - DNA, 201 bp, Homo sapiens
gaaaaccctccagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccac

SEQ ID NO: 10383 - DNA, 201 bp, Homo sapiens
cctcaactccccaaccccacttcctctgcctgcccctcctcctccttccacgttgtctcctccacctagcagttggttggcaaccccttcctcagtcccckgctgaaaaccctccagtcagcgcttatcccttctgctctctcccctcacccagagaaatacatggagtttgaccttaatggaaatggcgatattggtgag

SEQ ID NO: 10384 - DNA, 201 bp, Homo sapiens
ccccacttcctctgcctgcccctcctcctccttccacgttgtctcctccacctagcagttggttggcaaccccttcctcagtcccctgctgaaaaccctcsagtcagcgcttatcccttctgctctctcccctcacccagagaaatacatggagtttgaccttaatggaaatggcgatattggtgagaaacgggtgatttg

SEQ ID NO: 10385 - DNA, 201 bp, Homo sapiens; identical to SEQ ID NO: 10382

SEQ ID NO: 10386 - DNA, 201 bp, Homo sapiens; identical to SEQ ID NO: 10383

SEQ ID NO: 10387 - DNA, 201 bp, Homo sapiens; identical to SEQ ID NO: 10384

SEQ ID NO: 10388 - DNA, 174 bp, Homo sapiens
aagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcag

SEQ ID NO: 10389 - DNA, 201 bp, Homo sapiens; identical to SEQ ID NO: 10382

SEQ ID NO: 10390 - DNA, 201 bp, Homo sapiens; identical to SEQ ID NO: 10383

SEQ ID NO: 10391 - DNA, 201 bp, Homo sapiens; identical to SEQ ID NO: 10384

SEQ ID NO: 10392 - DNA, 174 bp, Homo sapiens; identical to SEQ ID NO: 10388

SEQ ID NO: 10393 - DNA, 201 bp, Homo sapiens
cctcaactccccaaccccacttcctctgcctgcccctcctcctccttccacgttgtctcctccacctagcagttggttggcaaccccttcctcagtcccckgctgaaaaccctccagtcagcgcttatcccttctgctctctcccctcacccagagaaatacatggagtttgaccttaatggaaatggcgatattgatatc

SEQ ID NO: 10394 - DNA, 201 bp, Homo sapiens
ccccacttcctctgcctgcccctcctcctccttccacgttgtctcctccacctagcagttggttggcaaccccttcctcagtcccctgctgaaaaccctcsagtcagcgcttatcccttctgctctctcccctcacccagagaaatacatggagtttgaccttaatggaaatggcgatattgatatcatgtccctgaaacg

SEQ ID NO: 10395 - DNA, 174 bp, Homo sapiens; identical to SEQ ID NO: 10388

SEQ ID NO: 10396 - DNA, 174 bp, Homo sapiens; identical to SEQ ID NO: 10388

SEQ ID NO: 10397 - DNA, 201 bp, Homo sapiens; identical to SEQ ID NO: 10393

SEQ ID NO: 10398 - DNA, 201 bp, Homo sapiens; identical to SEQ ID NO: 10394

SEQ ID NO: 10399 - DNA, 169 bp, Homo sapiens
aagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaa

SEQ ID NO: 10400 - DNA, 201 bp, Homo sapiens
tgtctcctccacctagcagttggttggcaaccccttcctcagtcccccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccac

SEQ ID NO: 10401 - DNA, 169 bp, Homo sapiens; identical to SEQ ID NO: 10399

SEQ ID NO: 10402 - DNA, 201 bp, Homo sapiens; identical to SEQ ID NO: 10400

SEQ ID NO: 10403 - DNA, 174 bp, Homo sapiens; identical to SEQ ID NO: 10388

SEQ ID NO: 10404 - DNA, 201 bp, Homo sapiens
attgggaagacatccggggagagaagctgctggccgtgtctgagcatcgcatccaagataaagatggcctgttctatgcggaagccaccctggtggtcagraacgcctctgcagagtctgtgtcctgcttggtccacaaccccgtcctcactgaggagaaggggtcggtcatcagcctcccagagaaactccagactgagc

SEQ ID NO: 10405 - DNA, 201 bp, Homo sapiens
tgtgtgcactgcaaggggctggttcccagagccccaggtgtattgggaagacatccggggagagaagctgctggccgtgtctgagcatcgcatccaagatraagatggcctgttctatgcggaagccaccctggtggtcaggaacgcctctgcagagtctgtgtcctgcttggtccacaaccccgtcctcactgaggagaa

SEQ ID NO: 10406 - DNA, 201 bp, Homo sapiens
ccctccgacaatggacaatactggtgccatttccaggatgggaactactgtggagaaacaagcttgctgctcaaagtagcaggtctggggtctgcccctarcatccacatggagggacctggggagagtggagtccagcttgtgtgcactgcaaggggctggttcccagagccccaggtgtattgggaagacatccgggga

SEQ ID NO: 10407 - DNA, 201 bp, Homo sapiens
gctcttcagatgggtggttcccacagccccacgtgccatggagggacatggaaggaaagacgataccatcatcttcccaggccctgactcaaggcagccaygggctgttccacgtgcagacattgctaagggtcacaaacatctccgctgtggacgtcacttgttccatcagcatcccctttttgggcgaggagaaaatcg

SEQ ID NO: 10408 - DNA, 201 bp, Homo sapiens
acgccattgacgagggcagactgaccctgcagatactcagtgccagaccttcggacgacgggcagtaccgctgcctttttgaaaaagatgatgtctaccargaggccagtttggatctgaaggtggtaggtctgggttcttccccactgatcactgtggaggggcaagaagatggagaaatgcagccgatgtgctcttcag

SEQ ID NO: 10409 - DNA, 201 bp, Homo sapiens
gcagatactcagtgccagaccttcggacgacgggcagtaccgctgcctttttgaaaaagatgatgtctaccaggaggccagtttggatctgaaggtggtargtctgggttcttccccactgatcactgtggaggggcaagaagatggagaaatgcagccgatgtgctcttcagatgggtggttcccacagccccacgtgcc

SEQ ID NO: 10410 - DNA, 201 bp, Homo sapiens
ggcaagaagatggagaaatgcagccgatgtgctcttcagatgggtggttcccacagccccacgtgccatggagggacatggaaggaaagacgataccatcmtcttcccaggccctgactcaaggcagccacgggctgttccacgtgcagacattgctaagggtcacaaacatctccgctgtggacgtcacttgttccatca

SEQ ID NO: 10411 - DNA, 201 bp, Homo sapiens
gtctgggttcttccccactgatcactgtggaggggcaagaagatggagaaatgcagccgatgtgctcttcagatgggtggttcccacagccccacgtgccrtggagggacatggaaggaaagacgataccatcatcttcccaggccctgactcaaggcagccacgggctgttccacgtgcagacattgctaagggtcacaa

SEQ ID NO: 10412 - DNA, 201 bp, Homo sapiens
tggttcccagagccccaggtgtattgggaagacatccggggagagaagctgctggccgtgtctgagcatcgcatccaagataaagatggcctgttctatgyggaagccaccctggtggtcaggaacgcctctgcagagtctgtgtcctgcttggtccacaaccccgtcctcactgaggagaaggggtcggtcatcagcctc

SEQ ID NO: 10413 - DNA, 201 bp, Homo sapiens
cctagcatccacatggagggacctggggagagtggagtccagcttgtgtgcactgcaaggggctggttcccagagccccaggtgtattgggaagacatccrgggagagaagctgctggccgtgtctgagcatcgcatccaagataaagatggcctgttctatgcggaagccaccctggtggtcaggaacgcctctgcagag

SEQ ID NO: 10414 - DNA, 201 bp, Homo sapiens
ggtctgggttcttccccactgatcactgtggaggggcaagaagatggagaaatgcagccgatgtgctcttcagatgggtggttcccacagccccacgtgcmatggagggacatggaaggaaagacgataccatcatcttcccaggccctgactcaaggcagccacgggctgttccacgtgcagacattgctaagggtcaca

SEQ ID NO: 10415 - DNA, 201 bp, Homo sapiens
atgtctaccaggaggccagtttggatctgaaggtggtaggtctgggttcttccccactgatcactgtggaggggcaagaagatggagaaatgcagccgatrtgctcttcagatgggtggttcccacagccccacgtgccatggagggacatggaaggaaagacgataccatcatcttcccaggccctgactcaaggcagcc

SEQ ID NO: 10416 - DNA, 201 bp, Homo sapiens
tgctcaaagtagcaggtctggggtctgcccctagcatccacatggagggacctggggagagtggagtccagcttgtgtgcactgcaaggggctggttcccwgagccccaggtgtattgggaagacatccggggagagaagctgctggccgtgtctgagcatcgcatccaagataaagatggcctgttctatgcggaagcca

SEQ ID NO: 10417 - DNA, 201 bp, Homo sapiens
gatgatgtctaccaggaggccagtttggatctgaaggtggtaggtctgggttcttccccactgatcactgtggaggggcaagaagatggagaaatgcagcygatgtgctcttcagatgggtggttcccacagccccacgtgccatggagggacatggaaggaaagacgataccatcatcttcccaggccctgactcaaggc

SEQ ID NO: 10418 - DNA, 201 bp, Homo sapiens
aagactttagagtcattggccctgctcatcctatcctggccggggttggggaagatgccctgttaacctgccagctactccccaagaggaccacaatgcaygtggaggtgaggtggtaccgctcagagcccagcacacctgtgtttgtgcacagggatggagtggaggtgactgagatgcagatggaggagtacagaggct

SEQ ID NO: 10419 - DNA, 201 bp, Homo sapiens
tgaggtgggaccgatcccaccgttaccctgctgtgcatgtgtatatggatggggaccatgtggctggagagcagatggcagagtacagagggaggactgtrctggtgagtgacgccattgacgagggcagactgaccctgcagatactcagtgccagaccttcggacgacgggcagtaccgctgcctttttgaaaaagatg

SEQ ID NO: 10420 - DNA, 201 bp, Homo sapiens
cgtggaggtgaggtggtaccgctcagagcccagcacacctgtgtttgtgcacagggatggagtggaggtgactgagatgcagatggaggagtacagaggcwgggtagagtggatagagaatggcattgcaaagggaaatgtggcactgaagatacacaacatccagccctccgacaatggacaatactggtgccatttcca

SEQ ID NO: 10421 - DNA, 201 bp, Homo sapiens; identical to SEQ ID NO: 10404

SEQ ID NO: 10422 - DNA, 201 bp, Homo sapiens; identical to SEQ ID NO: 10405

SEQ ID NO: 10423 - DNA, 201 bp, Homo sapiens; identical to SEQ ID NO: 10406

SEQ ID NO: 10424 - DNA, 201 bp, Homo sapiens; identical to SEQ ID NO: 10408

SEQ ID NO: 10425 - DNA, 201 bp, Homo sapiens; identical to SEQ ID NO: 10407

SEQ ID NO: 10426 - DNA, 201 bp, Homo sapiens; identical to SEQ ID NO: 10410

SEQ ID NO: 10427 - DNA, 201 bp, Homo sapiens; identical to SEQ ID NO: 10409

SEQ ID NO: 10428 - DNA, 201 bp, Homo sapiens; identical to SEQ ID NO: 10412

SEQ ID NO: 10429 - DNA, 201 bp, Homo sapiens; identical to SEQ ID NO: 10411

SEQ ID NO: 10430 - DNA, 201 bp, Homo sapiens; identical to SEQ ID NO: 10413

SEQ ID NO: 10431 - DNA, 201 bp, Homo sapiens; identical to SEQ ID NO: 10414

SEQ ID NO: 10432 - DNA, 201 bp, Homo sapiens; identical to SEQ ID NO: 10416

SEQ ID NO: 10433 - DNA, 201 bp, Homo sapiens; identical to SEQ ID NO: 10415

SEQ ID NO: 10434 - DNA, 201 bp, Homo sapiens; identical to SEQ ID NO: 10418

SEQ ID NO: 10435 - DNA, 201 bp, Homo sapiens; identical to SEQ ID NO: 10417

SEQ ID NO: 10436 - DNA, 201 bp, Homo sapiens; identical to SEQ ID NO: 10419

SEQ ID NO: 10437 - DNA, 201 bp, Homo sapiens; identical to SEQ ID NO: 10420

SEQ ID NO: 10438 - DNA, 201 bp, Homo sapiens; identical to SEQ ID NO: 10404

SEQ ID NO: 10439 - DNA, 201 bp, Homo sapiens; identical to SEQ ID NO: 10405

SEQ ID NO: 10440 - DNA, 201 bp, Homo sapiens; identical to SEQ ID NO: 10406

SEQ ID NO: 10441 - DNA, 201 bp, Homo sapiens; identical to SEQ ID NO: 10407

SEQ ID NO: 10442 - DNA, 201 bp, Homo sapiens; identical to SEQ ID NO: 10408

SEQ ID NO: 10443 - DNA, 201 bp, Homo sapiens; identical to SEQ ID NO: 10409

SEQ ID NO: 10444 - DNA, 201 bp, Homo sapiens; identical to SEQ ID NO: 10410

SEQ ID NO: 10445 - DNA, 201 bp, Homo sapiens; identical to SEQ ID NO: 10411

SEQ ID NO: 10446 - DNA, 201 bp, Homo sapiens; identical to SEQ ID NO: 10412

SEQ ID NO: 10447 - DNA, 201 bp, Homo sapiens; identical to SEQ ID NO: 10413

SEQ ID NO: 10448 - DNA, 201 bp, Homo sapiens; identical to SEQ ID NO: 10414

SEQ ID NO: 10449 - DNA, 201 bp, Homo sapiens; identical to SEQ ID NO: 10415

SEQ ID NO: 10450 - DNA, 201 bp, Homo sapiens; identical to SEQ ID NO: 10416

SEQ ID NO: 10451 - DNA, 201 bp, Homo sapiens; identical to SEQ ID NO: 10417

SEQ ID NO: 10452 - DNA, 201 bp, Homo sapiens; identical to SEQ ID NO: 10418

SEQ ID NO: 10453 - DNA, 201 bp, Homo sapiens; identical to SEQ ID NO: 10419

SEQ ID NO: 10454 - DNA, 201 bp, Homo sapiens; identical to SEQ ID NO: 10420

SEQ ID NO: 10455 - DNA, 125 bp, Homo sapiens
atgaaaccccagtttgttgggatcktgctcagctccctgctaggggctgccttgggaaaccgaatgcggtgctacaactgtggtggaagccccagcagttcttgcaaagaggccgtgaccacctg

SEQ ID NO: 10456 - DNA, 145 bp, Homo sapiens
tctcttgccaggactgtggagcggatagggggagtaggagtagagaagggaacaagggagcaagggaacaagggacatctgaacatctaatgtgagaagasaaacatccttctgtgagtcattaaaatctatgaaccactctaca

SEQ ID NO: 10457 - DNA, 201 bp, Homo sapiens
agggctgcagatggatccccctgcaatgtcctcctgtgctctgtggtccccagcagacgcatggactctgtgacctggcaggaagggaagggtcccgtgargggccgtgttcagtccttctggggcagtgaggctgccctgctcttggtgtgtcctggggaggggctttctgagcccaggagccgaagaccaagaatcatc

SEQ ID NO: 10458 - DNA, 201 bp, Homo sapiens
ccctggaaaaccaggaagggaatccaggctcagactgctggggaactattctttgtggttggagggatccaaagaggaagatgccgggcggtactggtgcrctgtgctaggtcagcaccacaactaccagaactggagggtgtacgacgtcttggtgctcaaaggatcccagttatctgcaagggctgcagatggatcccc

SEQ ID NO: 10459 - DNA, 201 bp, Homo sapiens
cctggtagcccaagtccaagtgggcaggccagccccagaccctggaaaaccaggaagggaatccaggctcagactgctggggaactattctttgtggttgsagggatccaaagaggaagatgccgggcggtactggtgcgctgtgctaggtcagcaccacaactaccagaactggagggtgtacgacgtcttggtgctcaa

SEQ ID NO: 10460 - DNA, 201 bp, Homo sapiens
atgccttggattctgatgctgctgctcacaatgggccagggagttgtcatcctggccctcagcatcgtgctctggaggcagagggtccgtggggctccagrcagaggaaaccgaatgcggtgctacaactgtggtggaagccccagcagttcttgcaaagaggccgtgaccacctgtggcgagggcagaccccagccaggc

SEQ ID NO: 10461 - DNA, 201 bp, Homo sapiens
cctcctcctgttcctatgtggaactccccaggctgcagacaacatgcaggccatctatgtggccttgggggaggcagtagagctgccatgtccctcaccayctactctacatggggacgaacacctgtcatggttctgcagccctgcagcaggctccttcaccaccctggtagcccaagtccaagtgggcaggccagcccc

SEQ ID NO: 10462 - DNA, 145 bp, Homo sapiens; identical to SEQ ID NO: 10456

SEQ ID NO: 10463 - DNA, 201 bp, Homo sapiens; identical to SEQ ID NO: 10457

SEQ ID NO: 10464 - DNA, 201 bp, Homo sapiens; identical to SEQ ID NO: 10458

SEQ ID NO: 10465 - DNA, 201 bp, Homo sapiens; identical to SEQ ID NO: 10459

SEQ ID NO: 10466 - DNA, 201 bp, Homo sapiens
atgccttggattctgatgctgctgctcacaatgggccagggagttgtcatcctggccctcagcatcgtgctctggaggcagagggtccgtggggctccagrcagagatgcctcgattcctcagttcaaacccgaaatccaggtctatgagaacatccatttggcccgtcttggcccacctgcccacaagcccaggtgattt

SEQ ID NO: 10467 - DNA, 201 bp, Homo sapiens; identical to SEQ ID NO: 10461

SEQ ID NO: 10468 - DNA, 201 bp, Homo sapiens; identical to SEQ ID NO: 10457

SEQ ID NO: 10469 - DNA, 201 bp, Homo sapiens; identical to SEQ ID NO: 10458

SEQ ID NO: 10470 - DNA, 201 bp, Homo sapiens; identical to SEQ ID NO: 10459

SEQ ID NO: 10471 - DNA, 201 bp, Homo sapiens; identical to SEQ ID NO: 10460

SEQ ID NO: 10472 - DNA, 201 bp, Homo sapiens; identical to SEQ ID NO: 10461

SEQ ID NO: 10473 - DNA, 145 bp, Homo sapiens; identical to SEQ ID NO: 10456

SEQ ID NO: 10474 - DNA, 201 bp, Homo sapiens
tctccctcacctccaacctctccagggctcacctggaactgaatgagtcggcctggggccgcctgtggctggaggtcccagattcagcggccccggattcygtggtgatggtgactgtgactgcagggggacgagaagccaacccagtacccccgactcatgctttcctccggctcctggtatcggccccagccccgcagg

SEQ ID NO: 10475 - DNA, 201 bp, Homo sapiens
ggcgcctgcacagggctgcccctcagcctagcactgtagtccctgtccttctggagcttagtggcccctcgggtttcttggccccgggcagcaaagtcccrctcagtctccgcatcgccagcttctcgggccctcaggatcttgaccttaggactttcgtcaaccccagcttctccctcacctccaacctctccagggctc

SEQ ID NO: 10476 - DNA, 201 bp, Homo sapiens
gctcccagccaccgaggggaggcatcaacaaggacagcacatccccaggcttctcccctcaccacatgctgcacctccaggctgcaaaactggcccttctrgcctccatccaggccttcagccttctgcgaagccgcctgggagacagggatttctccaggctgctggacatcaccccagcctccagcctgagctttgtcc

SEQ ID NO: 10477 - DNA, 201 bp, Homo sapiens
tccggagcgaggtctcctcgcagcctcgctgtcgcccacgctgctgtccacccctagacccttctccctggagctgattggccaggacgcagcggggcggygcctgcacagggctgcccctcagcctagcactgtagtccctgtccttctggagcttagtggcccctcgggtttcttggccccgggcagcaaagtcccgct

SEQ ID NO: 10478 - DNA, 201 bp, Homo sapiens
gggtcccagagggtgccgaactaggccaggtgcccttggagcccgtgggacctccggagcgaggtctcctcgcagcctcgctgtcgcccacgctgctgtcmacccctagacccttctccctggagctgattggccaggacgcagcggggcggcgcctgcacagggctgcccctcagcctagcactgtagtccctgtccttc

SEQ ID NO: 10479 - DNA, 151 bp, Homo sapiens
ggtgactgtgactgcagggggacgagaagccaacccagtacccccgactcatgctttcctccggctcctggtatcggccccagccccgcaggtgaggaacyactactttccatcacagggaccggcacaccacccctaccggctcatctga

SEQ ID NO: 10480 - DNA, 201 bp, Homo sapiens
caactgggtggagctgggcgagcagcagccacaccctcacctcctctggccaaggcaggagctccagaacctggcacaagtggccgatcctacctgctccrattgcgaggagttgagctgccccaggaattggctgggcttcacactcctcacctctggctactttggaactcatcccccgaaacctccagggaaatgtag

SEQ ID NO: 10481 - DNA, 201 bp, Homo sapiens
actttggacctggttcttctcggcggttccgagcagccttaggtgaggtgtctcgtgccaatgcagcccaggacttcctgccaacttccaggaatgacccygacctgcactttgatgctgagcgactgggtcagggacgcgcgcgcctggtaggggctctgcgggagaccgtggtggcagccagggcccttgaccacaccc

SEQ ID NO: 10482 - DNA, 201 bp, Homo sapiens
gctcggcgtgagatcttgtcccctctgcgttttgagccatacaaagcagtggccctggcctcaggaggagaggtgatcttcaccaaagaccagcacattcragacgtggcagccattgttggggagagcatggctgccctggtgactcttcccctggaccctcctgttgtggtgcctgggcagccacttgtgttcagcgtg

SEQ ID NO: 10483 - DNA, 201 bp, Homo sapiens
cccccaccctgttgaggccttcctccccctctgctgagcctcggttaattataactctgacctaagtgccctgtgacgtcaagcccgggccagccctgcccaggagacccagcaaccaggtccatgtctcagccatgctccccacggaggtcccccaatcccacccgggcccctcagcgttgcttctgctgcagctgttgc

SEQ ID NO: 10484 - DNA, 201 bp, Homo sapiens
ttaggtgaggtgtctcgtgccaatgcagcccaggacttcctgccaacttccaggaatgaccccgacctgcactttgatgctgagcgactgggtcagggacrcgcgcgcctggtaggggctctgcgggagaccgtggtggcagccagggcccttgaccacaccctggctcgccagcgcctcggggctgcacttcatgccctg

SEQ ID NO: 10485 - DNA, 201 bp, Homo sapiens
gaggtgtctcgtgccaatgcagcccaggacttcctgccaacttccaggaatgaccccgacctgcactttgatgctgagcgactgggtcagggacgcgcgcrcctggtaggggctctgcgggagaccgtggtggcagccagggcccttgaccacaccctggctcgccagcgcctcggggctgcacttcatgccctgcaggat

SEQ ID NO: 10486 - DNA, 201 bp, Homo sapiens
cccttggagcccgtgggacctccggagcgaggtctcctcgcagcctcgctgtcgcccacgctgctgtccacccctagacccttctccctggagctgattgkccaggacgcagcggggcggcgcctgcacagggctgcccctcagcctagcactgtagtccctgtccttctggagcttagtggcccctcgggtttcttggcc

SEQ ID NO: 10487 - DNA, 201 bp, Homo sapiens; identical to SEQ ID NO: 10474

SEQ ID NO: 10488 - DNA, 201 bp, Homo sapiens; identical to SEQ ID NO: 10475

SEQ ID NO: 10489 - DNA, 201 bp, Homo sapiens; identical to SEQ ID NO: 10476

SEQ ID NO: 10490 - DNA, 201 bp, Homo sapiens; identical to SEQ ID NO: 10477

SEQ ID NO: 10491 - DNA, 201 bp, Homo sapiens; identical to SEQ ID NO: 10478

SEQ ID NO: 10492 - DNA, 151 bp, Homo sapiens; identical to SEQ ID NO: 10479

SEQ ID NO: 10493 - DNA, 201 bp, Homo sapiens; identical to SEQ ID NO: 10480

SEQ ID NO: 10494 - DNA, 201 bp, Homo sapiens; identical to SEQ ID NO: 10481

SEQ ID NO: 10495 - DNA, 201 bp, Homo sapiens; identical to SEQ ID NO: 10482

SEQ ID NO: 10496 - DNA, 201 bp, Homo sapiens
cccccaccctgttgaggccttcctccccctctgctgagcctcggttaattataactctgacctaagtgccctgtgacgtcaagcccgggccagccctgcccaggagacccagcaaccagcctgctggctgcccctggctccatcacccaccaagacctaactgaggaggcagcgctcaacgtcaccctgcagctcttcctg

SEQ ID NO: 10497 - DNA, 201 bp, Homo sapiens; identical to SEQ ID NO: 10484

SEQ ID NO: 10498 - DNA, 201 bp, Homo sapiens; identical to SEQ ID NO: 10485

SEQ ID NO: 10499 - DNA, 201 bp, Homo sapiens; identical to SEQ ID NO: 10486

SEQ ID NO: 10500 - DNA, 201 bp, Homo sapiens; identical to SEQ ID NO: 10474

SEQ ID NO: 10501 - DNA, 201 bp, Homo sapiens; identical to SEQ ID NO: 10475

SEQ ID NO: 10502 - DNA, 201 bp, Homo sapiens; identical to SEQ ID NO: 10476

SEQ ID NO: 10503 - DNA, 201 bp, Homo sapiens; identical to SEQ ID NO: 10477

SEQ ID NO: 10504 - DNA, 201 bp, Homo sapiens; identical to SEQ ID NO: 10478

SEQ ID NO: 10505 - DNA, 151 bp, Homo sapiens; identical to SEQ ID NO: 10479

SEQ ID NO: 10506 - DNA, 201 bp, Homo sapiens; identical to SEQ ID NO: 10480

SEQ ID NO: 10507 - DNA, 201 bp, Homo sapiens; identical to SEQ ID NO: 10481

SEQ ID NO: 10508 - DNA, 201 bp, Homo sapiens; identical to SEQ ID NO: 10482

SEQ ID NO: 10509 - DNA, 201 bp, Homo sapiens; identical to SEQ ID NO: 10484

SEQ ID NO: 10510 - DNA, 201 bp, Homo sapiens; identical to SEQ ID NO: 10485

SEQ ID NO: 10511 - DNA, 201 bp, Homo sapiens; identical to SEQ ID NO: 10486

SEQ ID NO: 10512 - DNA, 201 bp, Homo sapiens
actgggaagaacccagcagccggaaggagtctcgagggggcccttcccgccggggtgtggccctgcttcgcccagagcccctgcaccgggggacagcagayaccctcctcaaccgggttaagaagctgccttgtcagatcaccagctacctggtggcgcacaccctagggcgccggatgctgtatccaggctctgtgtacc

SEQ ID NO: 10513 - DNA, 201 bp, Homo sapiens
caactgggactcattatggaagaatggggtgagaggagacatgaggaaagaccctcttatttgtgattctctgtgttcatgttgctgtttatagtttgtgkaaagtgggggaccatcccccttctcaccactgttcctcttgcacgtttcccctcattcatgtggctgtacttaaccttctccaacatacatcctgcatta

SEQ ID NO: 10514 - DNA, 201 bp, Homo sapiens
cctcctcacagctggaggaagcctcaatttatagccgatgggaggtggaagaggactggtgtctgtctgtcctccgctcctaccaggcagaacacgggccygacttcccctggagcgtgggggaggacatgagtgcagatggacggcggcagctggctttgtttctggctcggaagcatctgcacaactttgaggccactc

SEQ ID NO: 10515 - DNA, 108 bp, Homo sapiens
ctcattcatgtggctgtacttaaccttctccaacatacatcctgcattacatgaatggattattcctaataattaataaaaaggtattttttctactatcwggctaat

SEQ ID NO: 10516 - DNA, 175 bp, Homo sapiens
tgtttatagtttgtggaaagtgggggaccatcccccttctcaccactgttcctcttgcacgtttcccctcattcatgtggctgtacttaaccttctccaayatacatcctgcattacatgaatggattattcctaataattaataaaaaggtattttttctactatcaggctaat

SEQ ID NO: 10517 - DNA, 164 bp, Homo sapiens
ctgaaaatgtcgcaactcgcccggaggcggagccggtacgggctgacgtcaagggcacacaacmcctcagaggcagggagggcggggccggcagggggacctgctgctggaagagcagcggcccgagccggggccatggcgaagctgctgagctgcgtcctagg

SEQ ID NO: 10518 - DNA, 201 bp, Homo sapiens
gctggaatcatccaggctttgctggaagcacgggggtgccattcccgcagaatgaggctaatgccatggatgtggtggtccagtttgccatccaccgcctrggcttccagccccaggacatcatcatctacgcctggtccatcggcggcttcactgccacgtgggcagccatgtcctacccagatgttagtgccatgatcc

SEQ ID NO: 10519 - DNA, 201 bp, Homo sapiens; identical to SEQ ID NO: 10512

SEQ ID NO: 10520 - DNA, 201 bp, Homo sapiens; identical to SEQ ID NO: 10513

SEQ ID NO: 10521 - DNA, 201 bp, Homo sapiens; identical to SEQ ID NO: 10514

SEQ ID NO: 10522 - DNA, 108 bp, Homo sapiens; identical to SEQ ID NO: 10515

SEQ ID NO: 10523 - DNA, 175 bp, Homo sapiens; identical to SEQ ID NO: 10516

SEQ ID NO: 10524 - DNA, 164 bp, Homo sapiens; identical to SEQ ID NO: 10517

SEQ ID NO: 10525 - DNA, 201 bp, Homo sapiens; identical to SEQ ID NO: 10518

SEQ ID NO: 10526 - DNA, 201 bp, Homo sapiens; identical to SEQ ID NO: 10512

SEQ ID NO: 10527 - DNA, 201 bp, Homo sapiens; identical to SEQ ID NO: 10513

SEQ ID NO: 10528 - DNA, 201 bp, Homo sapiens; identical to SEQ ID NO: 10514

SEQ ID NO: 10529 - DNA, 108 bp, Homo sapiens; identical to SEQ ID NO: 10515

SEQ ID NO: 10530 - DNA, 175 bp, Homo sapiens; identical to SEQ ID NO: 10516

SEQ ID NO: 10531 - DNA, 201 bp, Homo sapiens; identical to SEQ ID NO: 10518

SEQ ID NO: 10532 - DNA, 201 bp, Homo sapiens
tctgtgtgcttcctgagttaaagtcacgcctacggactggccgcctcctttctttttcgctctttaccgctttctcattccgactgccactctttgttctwtcctctccgcgtccccccgaccctgtgtgtcgtggttcgtgccggtcccagttgagtcttgagtcccgggaagagaccctgcgcggactggggagccgtt

SEQ ID NO: 10533 - DNA, 164 bp, Homo sapiens
tgtttatagtttgtggaaagtgggggaccatcccccttctcaccactgttcctcttgcacgtttcccctcattcatgtggctgtacttaaccttctccaayatacatcctgcattacatgaatggattattcctaataattaataaaaaggtattttttctact

SEQ ID NO: 10534 - DNA, 201 bp, Homo sapiens; identical to SEQ ID NO: 10518

SEQ ID NO: 10535 - DNA, 201 bp, Homo sapiens; identical to SEQ ID NO: 10512

SEQ ID NO: 10536 - DNA, 201 bp, Homo sapiens; identical to SEQ ID NO: 10513

SEQ ID NO: 10537 - DNA, 201 bp, Homo sapiens; identical to SEQ ID NO: 10514

SEQ ID NO: 10538 - DNA, 201 bp, Homo sapiens
gtggccggacaaaattcatccagcctactgacacagtcatgatccgcccattgcctgttaagcccaagaccaaggttaagcagagggtgagggtgaagacmgtgccttctctcttccaggccaagctggacaccttcctgtggtcgtgagaacagtgagtctgaccaatggccagacacatgcctgcaacttgtaggtcaa

SEQ ID NO: 10539 - DNA, 201 bp, Homo sapiens
gtaggtcaaggactgtccaggcaggggttttgtggacagagccccactttcgggaccagcctgaggtgtaagggcagacaaacaggtgagggtgagtgtgrcacccagagactgctcttcctgccctcaccctgccccactcctacgactgggagctgacatgaccagcccactgatcctgtcagcaggtcctgctcctgt

SEQ ID NO: 10540 - DNA, 201 bp, Homo sapiens
cccaggattctctacggcctcggggccgctaagccccgcccatagttccgcccatccgagaatttgtccaatccaggcgaagtattcacgctccgcccaargttttgtgttgtcacttccggcccgctccaggaagtcgtgctgcggagccaaatttgaagcaagcggaggcgcgggggcgcgtctacgaagccggacctg

SEQ ID NO: 10541 - DNA, 201 bp, Homo sapiens; identical to SEQ ID NO: 10539

SEQ ID NO: 10542 - DNA, 201 bp, Homo sapiens; identical to SEQ ID NO: 10538

SEQ ID NO: 10543 - DNA, 201 bp, Homo sapiens; identical to SEQ ID NO: 10538

SEQ ID NO: 10544 - DNA, 201 bp, Homo sapiens
cctgtggtcgtgagaacagtgagtctgaccaatggccagacacatgcctgcaacttgtaggtcaaggactgtccaggcagggtttgtggacagagccctaytttcgggaccagcctgaggtgtaagggcagacaaacaggtgagggtgagtgtgacacccagagactgctcttcctgccctcaccctgccccactcctacg

SEQ ID NO: 10545 - DNA, 201 bp, Homo sapiens
gtaggtcaaggactgtccaggcagggtttgtggacagagccctactttcgggaccagcctgaggtgtaagggcagacaaacaggtgagggtgagtgtgacrcccagagactgctcttcctgccctcaccctgccccactcctacgactgggagctgacatgaccagcccactgatcctgtcagcaggtcctgctctgttgc

SEQ ID NO: 10546 - DNA, 201 bp, Homo sapiens
gaacttacctctgctaatgacgggaggacactgtcccctggcatcctaggcagactgtgtctgaaggagctggtggaagaacagggccgcacagctggctrtgaccccaacctggacaactgtctggtgactgaggatctcctctctgtgctggctgagctgcaagaggctctatggcattggcccgaggacagccaccca

SEQ ID NO: 10547 - DNA, 201 bp, Homo sapiens
ctggctggggcctcagatactggtacaggcggctgcctggttgtacatgttgttagctgtgaggaggagttccagcaacagaagttggacctgctttggcrgaagttggttgacaaggctccactcagacaggccacagaggctccaatacctgggaatgttcacaaagtcatcaactggaaaaaaagcaaaaacccacgg

SEQ ID NO: 10548 - DNA, 201 bp, Homo sapiens; identical to SEQ ID NO: 10546

SEQ ID NO: 10549 - DNA, 201 bp, Homo sapiens
ctggctggggcctcagatactggtacaggcggctgcctggttgtacatgttgttagctgtgaggaggagttccagcaacagaagttggacctgctttggcrgaagttggttgacaaggctccactcagacagaagcacctcatctgtggccctgtgaaagtagctggtgcacctggcactctgatgactgcccctgagtac

SEQ ID NO: 10550 - DNA, 201 bp, Homo sapiens; identical to SEQ ID NO: 10546

SEQ ID NO: 10551 - DNA, 201 bp, Homo sapiens; identical to SEQ ID NO: 10549

SEQ ID NO: 10552 - DNA, 435302 bp, Homo sapiens
  misc_feature (1)...(435302): n = A,T,C or G, or insertion/deletion polymorphism (see Tables 1-2)
ggatcagttgatcccaggagttcgagactgtagtgagctgtgatgatgccactgtactccagcctgggagacagtgcaagaccctgtctcaaaaataaataaataaacaaacaagtaaaataaaataagaaaaataaagagacccagcaggttagtgacttcggcagataacatcaaattggttcagactgcaggttctggagccagacacaaatgggttcaaatcctacctctgctaattactagttgttgggcagagtcagctcktgactggtagaccaggcctgttttactaccactaaatgctctcagtaagattgctaatgtcctgagtcatttttctgatggagaactcagtaaatgagtcatctttccttcccctcttcaccccaatcccaattcccctcccaaagagcacagggcacccaaatatctttttacctgcccagctatgctgcatataccaggggcacccaaggacaaccacctcttgaagaataatttgctgtgactttctacctggcaacctctactggaagtcacatccagtggaggagtctgtgttcatgaataggaaaagggctgtgcttgtgaccggaatgtatgaaaaagagaccatgtgtgacccttagtagctatgtgaccttcggtgccttgtgccttggagtcttttttttttttttttttttttttttaagaaggagtttcactctgtcgcccaggctggagtgcagtggtgcgatctcaattcactgcaatctccatctcccaggttcaagcgattctcctgcctcaacctcctgagtagctgggactacaggcacatgccaccatgcctggctaatttttgtatttttagtagagacggggtttcaccatgttggccaggctggtcttgaactcctggcctcaagtgattcgcctgcctcagactcccaaagtgctgggattacaggcrtcatccaccgtgcctggccatagtcctcattaggaaaaaaaaaaaaaaagcagcattgggggttggtttgatcatcgccaagggcctccacagtttcaagatggcatgcctcaatgatcccaggtaccaggaaacatgacctctctccttagcatccagacatttccctgagacgcttttcccatargcacagactctgacagagtatctgtggagtgaatgatgagacttttgggcactcctggccttgggaagttggcctgacatggtctgacttcagggccatcaaagcactgtcttgagggactgctctgaccagtcacagctgagtgacagagcttaagttggagccagcttccctgtgcaatggtgagtgagcctacaagaaagacatttcctacaggagaggcctggcctcctctggacatggaagctgccctcctatggtgagtgtgagaaggggcacccaatgtgcttcctcttggggtgcagcggtgtggccggcccaggtatgtggaagagctgctccttgttctttcacttagagaagtctttgtcggttctgttagccagggttctctagagggacagaactaataggatagatgtatatataaaggggagtttattttattttattttattttttattttttttgagacggagttttgctcttgttgcctaggctggagtgcagtggaacaatctcagctcactgcaacctccgcctcccaggttcaagtgattttcctgccacagcctcccaagtagctgggattacaggtgtacaccaccatgcctggctaattttttgtatttaatagagctggggtttcaccatgttggtcaggctggtcttgaactcctgacctcaggtgatccacccgtctcggcctcccaaagtgctgggattacaggcatgagccaccgtgcccagactaaaggggagtttattaaggaatattgactcacatgatcacaaggtgaggtttcacaatagacttcaagctgagaagcaaggaagccagtccgagtcccaaagctgaagaacttggagtccgatgttccagggcaggaagcattcagccccaggggaaagatggaggccagaaaactaaaccagtctagtctttccatattctgcctgcttttattctggctgtgctggcagctgattagacggtgcctacccagattgagggtgggtctgccagtccactgactcgaatgttaatctcctttggcaacgccctcacagacacacccaggaacaatactttgcatccttcaatccaatcaagttgatactcagtattaaccatcacagttgatatagctgctatgaagaagtttttcttatcatctgaaactctttgagcagcaaaattctgctcagcatcctaagctgcattgagaattaagcttggcagcatagatggagtaaggctgtcatgatcttatacacgctgtcacagtctctgcatgtatggtgaagttccaggtgcctgacacacgatgtgctccaccctggtgacatgtccaccccagtgcaactccagcctcctgtgcctatgtttagaggcacagtgtcccttccaatgaagggctgccttctttctctattcaaaagaggccatatcagtttgatttatctttctataagtctgatcatgaataacttaaaaccctgaataccagtatttttcaagaaagacaaatccaatttcagggtcagcatcaatttatgagaatagcaagtgcagaggcatcatcagaatcccctatggatctaaaataactgtccgtgcttggccccacacctggagatcctgatggagtagatctagagtgggcataggcatctgtgttttattttctttatttattttttttgggacaaagtctcactctgtcactcaggctggagtgcagcagtgtgaacacttgggttgtcatcatgttgcccaggctggtttcaaattcctgggctctcatcatgttgcccaggctggtttcaaactcctgggctcaagtgatcctcctgccttagcctcccaaagttctgggagtacaggcgtgagccactgcacccagccacatctgtattttaaaaagtcccatagataaaacccacatatccattgcaggagactggatacacaaagtgtggcttatccatgcaatagagagctagctgctcaacaataaaaaataaaaaagctgttgatacatgcaacaacacagaggaatcttctagacatcagggtaagtgaaaaaagccagtcaccaaagaatacatagtgtaaaattccacttatatgaagttcagaaaagggcaaaactaatacatggtattagaaatcaaaattgtagtttacactgaatggggggagtgggattgacaacaaagggacacaagaaaacttcctggtggtgatgaaaatactctgtacctcattttacgtgacggtctatgtggatacacacaatctcaaaagtaacaaactggctgggtgcagtggctcacacctgtaatttcagcctttgggaggccaaggccagaggatttcgtaaagacaagagtttgagaccagcatggacaacatagcaacacccaatggctacaaaaaataaaaaatttgccagatgtggtggcatgtgctaaccaccacaagtcctaactacttgggaagctgaggcagaaggatcacttgagcctaggagttcaagttaatagtgagctacgaccacaccactgcactccagcctgggcaagagtgagaccctgtcaaaaaaacaaaacaaaacaaaacaaaccaacaaaaaaataaaaaaacaccaaaaaaccttcacaaatgaaacccttgagagatatgcattttattgtctataatttataactcatttaaataaaatggcctaacttcccctttagaccccaagccagagtcttgcatgggtgccaaggagtggcctaatcagttcagcccagccatagactcaagaaaggaaacattttcctgttccctgccttatattatacaatcccccattttaatttactttccagcatttccctcacgctttctctgtcttttggattaaaaaaaaaacaaaaacaaaaacccaggaaacccagcatagaacaaccagctcaataatgaatccatttgtctccacacactgtgcccttctcctgtctccatttcagcagccacatccacattcctggaagaagttcccctgcttccaggctacttcaaggtgcatgatgttgattgagcatctactatgtgccagaccttgttgacccctttattaaggctacttccttttcttttcaaaataatcctgagaagtagatgtttttactgccccccatttccagattagtgatcaataaagggaagtaatataatgtccaaaagtgatattttagtttgatccaggtgccatagcaaaacatcatcaacagcagaagtttatttctctcacttcttgaggctgggaggtccaagatgaagcagcagcagactcagtatttggggagggcctagttcctgttcataggccgatgccttcttgattaagtctcacttggtggaaggacctagctgactctctggcatctcttttataagagcacaaatcccattttactctcatgaagccatgaagtcacctcctaaaggccccacctcctaataccatcaccttgggagttaggattttatcctatgaatttgggggtgggaacacacacatttagaccgcagcaggtgacattaggttaagtggaggaggcagggttggaacagtcattgcaaaacctcttagaatttaagacccctttccttccaaggcctgaaaggcagacaggcgttggagatacaggtgaatataaaaggggcagagctcctcccttgaccatgtatttcatgcccagtcgctagaattcaagtcaaccaagccctcacacacccgggccgtcccatgttctctggctcacctcttctggtagcttagaagtggcagcctcagggaggcttctgtttggtagaacttagaaggaagcatgtgggaaatgcagatgtctttgcttttaggattctggctccctgagatcagaggagtgggttcccgtacgggggtggcgaggcacagggagaagcattggagcagactctgtgtgtgtgtgtgtgtgtgtgtgtgtgtgtgtgtgtgtgtcggcgcgcctgtgcgtggagggggataactgtacccagcgcgaggcactgggggaggaggaagcggtagcagagatctgaataattgattcttcagccgcaccagacgcccgggagcgggcggagagcgtggttccaacaccacggacagcagcgcgcgccrccgcaggcgcccccgtcgccagccagccacctatcctggccttatttgccgccgtgcgctctcggaacgggtggccgcgctccgcgtcgccgccgagggactgcggggtctgtctcgacccacctaggagagaggctgcgggcaggagacgctttcgcccgccggagctcgaagcctcttgggcttgagcgggggctactgcgtctcgccggctgagaacaagtccctaagttggtgtggagggcgccgctaccttccttctcctcttcctcggaggcgaccgcagcagaaagacgccccgggaacccggctttgccagtgctgtgaaccagggtgtccaggcgctcaccggactcccgctgggaagtggggagccgaacgcccggcgcggagctggcccagcagcgaagggcccggagggagctgcctttccccgcccgcgcctctctcggccggggaccgcggggatccccggccacacgcgagcgcgctcccacactcacacacacactcgccctcaaacacaccagcccggagctgggttgcggagagggtgctccggcgcgctcagaggaccgggcagttgccgtccggagtggggcaggaagcggagctagggatcttggaggggagctcctagggcttggccggatcatgggaccgggtgagcgctgagaatcgcggccgcagccatcagccctggagatgaccaggagcggccactgctgagaactatgtggagagaggctgcggtgagtgctagcgcgggacgccgggcctgggaggcccccttgggaagggggaggtgggaggcctgaagagggaggaagcggcaggatcacaagagggtcgctgcgtgggaaagatccacctccctcggggaaccgggaccgcgggagcccgcgtccttccctccccmtctcctactgctggctcgtcacaaactcagccagcgcccccccaccctcgttacctcctctttctctccctacctccctcgctcagcagctcccggtcgcacaactcccagcagccggcgctggggaggtggtagggggtgcgggtggaggtgcccagttagcttctcgtgggtggccaacctggggctcccattctcctgtgcaccctggagtggagctcccgctatcagccacaggggctgaggatccgcactgggggcgtcgtgggcatcgggmttcagcttcccccctcttgtctagcccccctgggcgcataggggggcttgtgagcamtgcagactgcagccttcccctcaaccctccctcccctcgttggtgggctgaccctgcctctccttctctcctccgccccgttagagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacaggtacgtcccagagggagatcagggctccttgggccrgggaggagggagactcgaccggagggagagcgggagagggatcaggctagagagggagagggaaagcgggagggagcccagcggcgaagtgcaggaggggcaccagggggcgctgcggctccgcgctccgcggcgcttacccaggaacgtcgaggcctcttggagttcgcctcaacttcccccggctccagcagcgtccgtcccgagaggcgcgcgtcaggrcacgcgtgcacgaccgtgctggtatttgcaggtacgcagggctgtgcacctgccgcagttcatgcgtgtgcaccacctgaggacatgtgaggactccggctggccgtgggcaccgctacagcagtctgaggaagtrcgcagaaaagcgcgcgtgcctatgagcgtgtgcggcccactgcccacgtgcacctaggacttggcaacagcgcccgcagtagaaaggctagggaggggctgtacagtccacgtccgtctgggagcttcttgggagcctacctttccccctacgcacgttctttgccagctcctacgcgctggcccgcggggggacgcgcctactctccagaattcagcattgcacacggcgcgcgtgagagagggtgtgtgtgtgtgaacatgtgtgtgtgcgtgtgtgtgtgcacgtgtgtgtgcacgcgcgcgtgtaggggtgggtgaaggactctccacggccccttggctcgaggtggggcgagccccaagttccccaggcacagcggagcctgggcccaccaggcagcgtcctcactcccaagcacttggggtgtactctgactgagaggagccgggtctgtagttggggctgggcgtagagcaaagtgtgtggtgcacacgacgggctcgtagggggcggggtcagccaactagctgagctctcaagctgggacgcggggtctgggtgccgcctccgcacgccctgcggggtctgtagttcgctccgcgccagcagggggcggggttgataacttggtcctctctatcccaggtgggaggggttggatggagggtttattctgtgcacctaggagcttggtggggtacagaacacgcgcggcgcttagggtctgtggcccgcggcgaacttggggaatgcggtgggggatatggacagagatggggatggggaagtgcctggagacaggggatgaggaagctggatgcgagaaggggctgggggatggagaattagctcgaattggagttgtggatagagttagagatggatcgagggatgtggatggcgtcggggactcggaatggagtccgtgatcccagcagcctatcctgctgctgagttccatgcctggctcctagagcaggaagccaagttggtaatccctttcttctggtcgccttgctcaccgcggccctgcctctcactcttcaccttgcagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggtaaggccggaaactgatgccctgccaggacctgggaagccaccagctgcatggcagctgctgcaggtcttcggacgcccctagaatctgtcttgatgtgaagtgggggtgggggtgggagggtcgtggccactggccctggtgagaaccaggtcttgcctctccaacccagaaatgaatggaaatgccttttgccttgtttctgaaaatggtgtacacaggagcactttggtgtgtgtgtgccaggaagcgctcagaaaactgagaagtaggctgtggggtggtggtggtggcggtggtggcatgtttggagatttacgagtaccatggggcacagaggtgggcccaggagcactggagacatatgcttcctattttcacaatgccagttttacctgattgttttgtgggaaaatgtccattttttcctcttatggtaagtgactaaaactatttctaaaaattattaaatgtgggtaggttctgraagaaaatgcaaagtttttaggtaaagcacaaaagggcagaaaaaatgtcatgcttcctctgactctgcagytagaggaacagaggtggggagtttgagaagccctgggccagaggagcggaggagagacccgttcctcaaggggagtgggtgggagtggaaagaattaactccaaacccagagcatggagggcctggcattttccttacgtgttctttgtctggggctccaaggccctcagatgaaggagttggctcctgaacaaagatgggtcttggtactaaagttggagagtctcaaaatgcaagaaagagtgtacaaaaatcagttggctctgaatgagagggagggtcttttttgtggacagcctgggagctttggtttggagwagaagggagagagatttgaagatttgaaggcgatgttatgacagcctggtttgggaattacacagaagtggagggaaggaagaaggctggaatgaagaagtaaagtgaggaatgagaaaaaagggaaagattggagttgtgtgtgtactgtcctctaagtcctgagaaaagattgggagttcagaaggcgaggaaagagtaagtgtacttgtgtgccatagcctctagccctgagaccttcttggagagtgttccttagatggcaggagatattctagtggagtgagcagacattcactgtagcgctttccttttgatgctctcaaagcacttttatattcatcacatcagcttttgcttctgtttcagcgattcctaccagctcctttggtaaccgtattaattctttcaggtctcctgggctgcagcacattcagctgtagcacacaattgatgcagtgtcttattaaacattcattttaaatgatttgcaggctagcagaattcctgtgtgtagctgagcattttcccagtcacttctcagttttggggggctcctgtctgggaagaagagagtagggactagccatgctctgccaccactgacaatttcagaactggagagcatcttagggtttcttggagcatgctgtaactttcagatgaagtgactgagccataggggagttaagggaatttgccaagaccacatagtggctgatgtagctaggtagctgaatttctgatcccaagstgtgatcttccattccactaaatcaagcccatactttaatgatgtcatccatcttcaggagggacaagggatcagtttcattttgtgggaggggctgagcatggagagctatgatgaatcacagcctagagggcttttgtatgggaggggccaatcttctaaagaaggcattgagggagaagaacagccagtttccagccacgccttggagtatgattttgggatttaaatattaccacggatcccttcttccttcttgagtttttctaaaggagtgatagactggaaacagtaaccatactgaaagtgaaatttctggatccatgagggtttggcacaacccaatggagaaatctgggaaaagctgaattggaaaaggtggtgtgagactgggaggttccgggtaggctttggctcttacttctaagtctcagtcgataggtgtgtggctcaggctgtcatgtgactcattcatccgaacgtaggcagagagaagccggaagagtgtagggtcatggaagggaacccccttgataggcagtgaccctgcctgctagtgaatcttgacccagtgaatggcaggttgtgaccaactagaccagcaactgttcttcccttgaagggggcattagaaagaaagttttgagaagtccagggagtatgggtggaaacattcttctctcctttgggatgaaactgcgttttggggatgtggaccaaaatgtgacctcacttaagagtaagaagagaaaaggaatcaggaaagggcaagaggaagatgagaaaagacatttccagagaaataaagaatagagacttaagaggggttggagagaagaagaatgaaagggtccattggttcaaaaatggaggaggggattcgatactcctgattgttgttgggactttcagagttggtcttggagacattggccactctctgtgattctggtggaactgtagggagatgaggcaagktggcagggaagcaaagagctcagtggaggtaacatcggggtatatgtctggtccccatgtggaacggtgatattgagaggakttgggtgataccaagagaagttggtttaaaaggtcgtattttgagaaactggggatgtatttagaaaggagattgtctgagaggtgaacagcccttccttccattagtaacatatatagatggcttgtgcttctgccacatgtttcatttagagctgaacattgagtttatttgtctccaaagaaacagtcacggtgcattgtttaaaactctgccttgcctcgcttgcaaatggtattatgactacagcctcaaccttcctagattgacaaggcctctgcctcctgttaaaatgatgttgatttggtaaagtcatccagaacacacgtgtgttatatttacttctacattggcaacatgatagtgcccctgctggtaagaatagtagtcaatttggttatcagttaaaatgaacacacacacacacatttttttaactttttttatttttatttttatttttactttaagttctagggtatatgtgcacaacgtgyaggtttgttacatatgtatacatgtgccatgttggtgtgctgcacccattaactcgtcatttacattaggtatatctcctagtgctatccatcccccctccccccaccccatgacaggccccagtgtgtgatgttccccttcctgtgtccaagtgttctcattgttcaattcccacctatgagtgagaacatgcggtgtttggttttttgtccttgcgttagtttgctgagaatgatggtttccagcttcatccgtgtccctacaaaggacatgaactcatccttttttatggctgcatagtattccatggtgtgtatgtgccacattttccttctgtctgtctacttgaccgttgaagaaaataacaaagccttataacaattgaaatgtcatgcaaatgtggtggatttttgtggtgttaatttaatttacaatggaggtgctaatgttttgctcgcatcattgggtagtcttgcaatataactaaattagaggtgaaaataaggctgagcgaggtggttcacacctgtaatcctagcactttgggaggccaaggcgggtggatcacctgaggtcaggagttcaagaccagcctggccaacatgctkaaaccccatctctacaaaaatacaaaaatcagctggatgtggtggcaggcccctgtaatcccagctactcaggaggctgaggcagggagaattgcatgaacctgggaggtggaggttgcagcaagccaacatcatgccactgcgctctagcctgggtgacagagtgagactttgtctcaaaaaaaaaaaaaaaaaaagaaggaaaattaaaatcaataaataagaggtgaaaataatgctcgatgtagatgaagttctaatcttatcttggcttggccattttgaccctgtctaagtgaaatacactccagctgcagtaatagtccctggtaagcccagaatatgggctagatctttacacttctgctcagtgtccttaaccctctcaccccccatcacttctccccatattcctaattgctccatgcaggaaaagacgaggctcagattttagctatatccatccatgccagttatcacttgggtttcgttttctatgttattcctatgcaagcctcatgtcttctgccagagtgtaagtcgtttgagggcagatttttwaaaaaactgtttatctgtatatgtgtatttgacatgacaaatgcttctctcctccgcagacatataaaaataatgccttttcattgtagagcacttaggaaatacattgaaatttaaagaagataaaaatctctctccaaatcctatcaccatgggtaaacattactgacactttggtgtatttccttttatctatttagttgcatgctcaggattttatagtatatatggtttttcttattgtgctttgccctctgtggactttcttagaggattcaagattttctttaattctgganaaaatctcagccgctatctgttggattctttctttccatcattctttctattctctccttctgaatatacatgcatatgtatagtcatgcgttgcttcatggtgggacacgttctgagaaatggatcgttaggtgatttaatcgtgtgaacatcacagagtgcacttacacaaacctaggtggtatagtctgttacacacctaggctatgagctataggctcttgctcctaggctacaagcctctacagcatactctactgtatgaatgctatactaaatattgtaagcaactgtaatacattggtgagtatttgtgtatctaaacatatctaagcacagaaaaggtacagcaaaaacttagaatataatcttatgggaccagcattgtgtacttgtggtccattgttgacctaaacctccttatgcagcacatgactgtactatatatatatrtgtaatttctcartcaattctccatgtatcttgtttttttttttttccagttctctgtttgtgctgtgtttgggaaggtttcttcaattctatactccagttaactacatcatttcatttgtgtctggtctattattttattttagaaagaaacagcatggatggtctattattttgactatctgttgagttatagatttcaacaaggatatactttatttccaagataataattggttcctctttacacctccctgtttttttgtgttataaataatgaaaaactcttctcactttktgcatgtaactccctcccctgtcccttcaaagaytaaaaaatatgtattataaagttcttctctgattgctctagcatctttccttcttcagttgtgaagtccttcatttgtagaatcagttagttggatgttcacatatgttctttaatttttgtttgtgaacttattttcaaggcaactttatgatttcttatgccctgtrtctgtgagggtgtgtattttaagccagagcccatgtcagcagctcaggtttgtactctcttcccattctacgtggcctgtggtacaggcttaggagtccatctcatgtaggtgacttcattttggctccttgacacagatagggtcctgctttttggctgtgactaatggtggatggtgcagatgttccagcaccatccacagctagcagcctgattctaggtccagttcttcccctttttccctggatggacattgacacctctgttctcatggctcatattggacctatcctccatggattatgtggctttgattcctacttgaaaccctagagtcccgtctttcagttcatttatttttagggattactctctatttttgatctgtgattctcttttcttatttgcaagcaatactatgtaaatttaaaaataactaaaggtttctttawaaattctatgtcttaggagcagaaaaggaaggttactgagtgtgttcactcggattttgaccccgttttatttcacaacctgcttttatatatttttttaaacttgattatgtattcttggaattttcctttatcactacatagacttcttaaacttgattttcaatggctgcagagtgttcagttcataccacaattattttaacaatttctctctttttccaccattaataatattcatttgtgctccataggggcatccttttcagtacctcacacttgtcctgccctttgcgtttgttacacggtaaatgtttgttgattgaatgaatctagtcattggctccgatgccagcttgttggagcttccggatgaacatatcacaatatggttcagggcattcgtgcagtgtttgttccctcaatgctgastgatttcataggtgtttgccaatttttctcttctctctagtgggcagataattaccagccatcctgaggattagcataaattggggggttacatacgaaaggcctgtagagaactgctgagtaacagctcatcagcaggaggtggaagttggtgctcttgtaacctggcagctccagagtttggatgcgagtgatgggccttcccattaaacactgagagctctcgaaaagggcagangcacagatcggaatgttggtggagcccactcagctcctgctaaagaggcatcaggtagttcctgggagagtggggagacctatctttagtcttttccatgaggcatgtcagatgcgatcatcaacacctcctcacttaagtcatcagagaccaacaggcgtcctcccggtagcgtgactcacactccaagtagccctcaggggttgctgacaatcgtttgggccctgaagagctgtgrtctggtgggtttgcagcggtgtttatcttctttctcatagcctcagatggaaaatgctactgtaggcagagtgagtggggaaagagagagaaagagggctgtgcagaagagaaacaggaactgaatctctggtttgtaatagagagttggtagcctctgataagtcatcacataaatgagacattataaggttattaattggtgtcttttgtttgtcctgcatcccccacccttgatctttcaacttctaattctttgccaacattttaaagttggaagacatcccattgaaaagaaaatccaaacttcatgctgctttgaaacagtcagaaggcctggccatactggccccgattccccctatggcaacagttggctggagatgaatctcatcccccaaccccacctgccacgatccctgccctcccactgccatcctgggacaggacaggtgcccctcctttcttaaattccccaaagtcacttcacttcacttcacttcactcatttatgttacatacacagtatcctgaaggcacttggctgtgaggcctatgatgtaggtgagggaagtagctcttccaggggctgctcctggataagacggcagatctatggcatgtatgcaaccatggatgccatgttcactgctgccatcattaatctcctataacacctggccctgttgagcccactggccttaaggccttctcaacacagtactccaggcagccatgatgaatcaacttgagttggaagatccaagraaaccttggacaaagagtctgaagaatgaaattcaattttcaaaaatacctgtgtgaccttagaaaaggcccttcacctgtctgaacctctggttctcctgcaaaatgaggatttgggacaaaattatcactaagatctcttccagctctgaaaattttgtgcctcatcaaggaaagactggcaacaaacataccaaaatatgaatagcagttatctttggggtggtagactcatggctgctttaatcttttaaagaatgtcattatcaagtggttaatrtattgtactttgagttagattgcctgaatttaaattcagggattccacctcttactggctgggtgatcatggggaagttcttaatatcttgagcctcaatgtcttcatctctaaaatgggaacaataatagcatccactttgtagagttgtgagatttaaatgacatcatggatattagtccatgtctcagtgcctaccttataataaatgcttattacaggaatgctattgttattgygtctgcattttttagtttttatttttctccagtgtacatgtactttttaataaccagaaagagtgattaaggatgatgtggttacatgagggtatgctctgaaagaaactgggagtgaatcccacagaactgtcagaagtggagggtctaacatgaaatgatttgtattttcttaactgagacaatcagaagcttcctttgcctttgtaggacttgctgagagctntatcctggcaaacggaagctaaatgtggccagcatgaaagtgatcgnaggagaagactatctcattgacctttgcactaaatgactccaccaactggaccatatgtttgcacgaggcttagggatttagagtgtggacatatatagtttctcattttatctctgccaaggattaataactcagtgatagcctgggnaacctggcagctccaanggtatttgtttaaagaatctctattttcagatgaggaaataaaggatctgggagttgcagtaatttgtgcattgttcaaagctgtaactagaacctagggctttgggttcttattcttttgctcttattttattaccctttcaagttaatgactacgaatacatttgatttagggaaggggctcagatgcaagacaaataacagattttgatgttcatattttggttgtcttgactaaaaggattaagatgttggatgatggaattaaaattcaaaacttcagattgaagtgatggagtcactctaaagactgcactggaggttccccccataccgcactcagctttaatgaggttaactgacaaagaaaaattgtatatattaaaggtgtacaacacaatttttttttttttttttttaaagaaaacagtgtttcactctgttgcccaggctggagtgcagtggcatgatcatagttcactgcagcctcaacctcctgggcttaggtgatcctctcatctcagcctcccaagtagctaggaacacaggcgtgtgccaygatatccggctaatttttaaatttttggtagagacgggggtctcaccatgttgcccaggctggtcttgaactcctggactcaagcaatcctcttcccttggcctcccaaagtgctggtattacaggcataagccaccgtccccagccccaaatgatattctgatatacaagtaaatgtgagatgattgtcaccatcaaactaattaacatatccattacctcacatggttacatttattgtgtgatgagattacttaagatgtggtatcttagcaaattgcctgtatacaatatatttttgtattgtcaccatgctatcaccagtcaccatgctatacattaggtctctagaacctatttaccttacaagtggaagttggtgccttttgaccaacctctctcaatagtttgaagaagaattttcactattgcagaaagggggatgtgagactttgcaactcacttagtcataatgtggctgcctctgttccaactatcacatccaactcacttgggaatggtttttgcaagggtcatgaaccggtgtactgcacgctgaatctggctcatagatgcattttgtttcaccagtacagcatttttaaatgcttgaattttaatgtctttagacagcatgcattttcaaawtcactacagctgtccccactctgttatcccatatctagggtgattcatacatttatgttaatgatatggtttctgtgagtatttgagatcatggtgctcaaatacagactttttatttgtttgtttgtttattttgtattgaccagaagctcagcagatcctaagtggggatatgtggaggccacatatctagaaatatatgtggaggccacatacgttgtggccttataaaaagtggaggccacatttatagaaatataatgtttaaatcaagggaggtgatagctccattatacctcttctgttgtttggagtgctttcaggtgcaagtaacagagtctttgaccaacagtgtcttaaaccattaaagacattcagttttttgcttagtaaggagcctcagatctagcttagtgacttaatgtcacattgaggactcagatccttcccattcttctactttgccttcctcagctgctggtttatctgagtcacaatatggctgcttctgttccagccatcacaccttcacctcctagcattcaaaactggaaaaaaagggagagaaaaataagccttcttctagggcctctatcctttcattggagtagacttcctcttacatgtcagtggccagaactgggtcacattcccactgctcaaacaacaatgatagagatccaggattcctctctgagaatgggtaattgccactgagcaaaattgcttctgttagcaagggtgtggggtgatgcttcagtggtacaactggtgatgtctccagcaacactaacaccattatatgtagcattgcacttagttccgaggagtgatatctaaagatggacgttgaaaaattgcaatgcatgcagaaaaagggcctttaggattgcgtagactctaaatgaaatatattaagagtttcagaagaagtatttagggatgtttagcctggagaagggaaatctcagaggggatatgggagaagtgttcagatactccatgggctgttacaaggtagaaggttaagtcttaattttgttattgttctggggacagacataagagtgaaattattattattattattattattattattattattattattattgttattatttgagacagagttttgctcttgtcgcccaggctggagttcaatggcacgatcttggtttactgcaacctctgccgcctgggttcaagtgatgctcctgcctcagcctcctgagtagctgggattacaggcacctgccaccaccatcagctaactttgtatttttagtagagatggggttttaccatgttggccaggctggtcttgaactcctgacctcaggtgatccacccgctttggcctcctaaagtgctggactacaggcgttagccacggcacctggccaagagtgaaactataaggagtaaagtttcatcttgatatgaggaataagcttcggcaattaggtctctaacagaagactgtgaggattcatggaataggaaggctatatcaggatatgattgagctaacagtgactgtctgtccctcaggaatgaggtggaaaattgggcttgcaaggttgggttgggtcacctctgaggctctttcttattcaaacactctgtacctctcaaatccttgatttttaaaaaaagatctccaagccttggtgctttaggccaagcatttggctgaaaaccaacatcctcactttttccaagtgtgtgagtaattcagtataaatttgcctggcatggaggaggaatttataatccctgcatcatcacctcaagttcccaaaagactttacattatcctgaaggtagaagatatttgaaaagcagacaacctatgtatatatcaactcacacacacatatataaataaaaacataagtaggtcagccggcctcatatttactagtgaaaatgtttttggctaagaagctcatctacagaagacaatgtttagaataattgccaatgatctcgaaatggggtgtttttgcacttgtatcaggttaatcattattacttaataaagtatattcagcttgttttgcacatcttactgtagtaatatgtttgtattctaaagagccagccagactcctctctggtttttcagttgycaaattattctttttagtcagttgtattctcctgcatttggaacatctgcttatggcagaaaatactctagatactattctgttgtttatccacttctcctattcccccacatccccccaaagaaaaacgaacctgaaattgctttccaaatgctttcactttctgttcaaattttggaactttccatgggatggcaattgatatattgtctccattttttaaactttgaaatagatgttgatgtacagagcgaaaaaacctaaataatacaatagagcattcagagaaagaatatttgctccattaatgcatcgtagatcttcgaactcaggttcccttccatggaggtggctatgttacccatttcaggagggaaaatattaattggaatggaaatttctttctgtttgtgatttttttttgctgaagtcggcatatggaaaggatcttctcttaaactacaatccctgacttgaaaactacaatccctgacttgaaaaagsttaattgtttccattggtccctaacagtgactcttttgccaaaacaaaaataaactcactctaaaatgtaagttgtgatttccaaaaatcactgacaccttgaagcttggctcacaaactcactcaaagaatttaagataatttggggtgattttggggggagttggggaccactttaaaatctaatgaaggctacggacccttccagaggagtgcgtgttcataaacatgcagtcaaaattatgtgcaatttcaggggatcacagaccctctgaaaccctttcatagacttccttggatttgatttatttattggtttattaaacacagttgatccttgaataatgcaggcgctasttgcattaacccccatgcagtttaaaatccatgtataacttttgattcccataaactatagcccactgttgatcagaagccttaccaataacatagacagtcaattaatacaaattttctatgctatatgtattatatagtagattcttaagtaagccatagaaaagaagatcataaggaaaatcgtaaggaagaaaatatgtttgctattcaagtggatgtgggtcatcataaaggtcttcatccttgtctttacattgaggaggctgaggaggaggaggaagaggaggggttggtcttgctgcctcaggggttggcagagggagaagaaatttgcgtataggtagacgcatgcagtgtgttgttcacaggtcaaatgtatgttcattcttcatacatttcttggctttgtccttggaccaaaatgctttgtggatgcatctgttatcaatttgtttcagaatctagctggagagactcataatgcaagtgcagtatgattgtattcacgggaccatgggaatgcagaggagggayagcttcatccacaggtctgagggtagggatctggggtcaaattggagagctggtctggaagaggcttgtgtcctgggtgcctgccmctacaggttgtcatcccccacagctgaagatgagctgtagagggaaggctggctcatggaggagcagaattgagttcacaatctaagccttcctctcctcttaacctgttcctcaaggctgccagtcttgagtggtcttgaaagcttccaaattctcctctggatggcatttcttaccatcaaacattgagctttttgcagatttccgttttgttgtcacaaatggctgaatgtctcctgctctatcttgtctcttcaaattaggaatacctgcccaggaagagtgagtggcatttgaaatccatatcgtcttgctagtctgctgtcctaggggtgaaagaaaaagacatattttcctggcgaattgttttaatgctaagatatctgtaggactgaggaaatgtagtattaactgacttgggtgagtagactcagaacgatgtgaagaagctgtggagctgtggaaaaaggcaggcttgctgtagttctggtgttagggtgtgtgcatggcttccatgaatgggattttgaaaatggcaggccttgggtgaagaccttcatggtcaaatttgcactttagttaaaaacaaatttgctattggttttgccttggttaattgatactagtttttcctcttctcttctcctctcttctttttctcttccctcccctcccttctccactcctctcttctcttctcctctcccctcccctcctttctcccctcccctcctttctcccctcccctcctttctcccctcccctcccctcccctctcctcttctctctctctctgtctctgtctctctcctgtttagcagcattgaaagaaatatttttatcatggacccactgctggatcattttaaagcaaatccaagacatcattgtgttcatcagtaaatatgtcagtatatatatatacatatatatatatatatgtatatatatatcaaaaatataagaactttaagaactgttgaaaaaaatcacagctaatatacaagtaatctatacatatgtattttagaggattttgtgagaatcagggcagtataaagaaaataaaaatcacctttactctcagcatccacagacaactgctattaacattttggtttatttccctctagtctgttttcctataccttatttacaaatacacactatataattttatagatagcttttaatttgcttaacattttatcatgaggctttcagattacttgtaaacatttttatcttctatgttttctattctgtggatatctcatgatttacttgataatttagattttccccaattttttgccatgaaaaccaataccttgtttaacatctttgtaatgaaatgtctacatcacagattattggcttttaatagaatccattactgaaattaaagaattttaaaactatcaatacagaaccaattaaggttccgttaatttgttcccagaaagattgaatcactggacacttctaataactatgtcttaaagtatctctgtcacttaactctggctggctcttgaaacagaaatttttctgattggctagacaaaaatattaactcattgttataatttgcatctcttttaagacacctgccatggaatatattttaatttaagcatcgcttttatattccctaggtattgcatattttaactgctttgatatttctcattgtgtaaatggaaaacctcagacaatgatggcttccaatataacatacagtggagtaatttgaatttctaaaaaataataaatattttgaagcctggcggggagttctatgattattcattcttcatcaccaggcattgctcacccattgtctctgtatcagtgttgtttcaatcattgctttaatatgtaaaatttctcagcagaaaatcattctgtgggaccccactgttatgatttgccaggagtctaggtagagactcacgtccaattgggctggagtcatgttcgtgtcccaggctttgtggggaacggtagggatgggaagcccttgtttgttcctttctctaaaaaagcagaggcagggtgaggttttgcggggtccgtcccgcagaccctgacccaatgacagatgaataaagttccctgacgcacagatattctgctttgccagtctagctgagtgtccgtgccacttacagacaccaaggaaggttctgtacagagtcagtggccacggcctcgacttgccagtgagactcacatttattcagtaaatattaattgacaaaggttgtgagtaaacacattggtgggtaattaacctggttgcccctaccccggagagagccatcatgcactcaagaatgatcaaatattggtcttaagaccacgtgagtaaacaagctagttagataaactgctctgccttcctttgtacccacttcaagctatttacttaaggtaaggattaggttgccttaagccataaacttattctcagacttttgcaaaaaccttcaggccttccaagaaggtttgtggctattctctataaccaaaatttttcccaccagtctgattgaatccccacaaggttgtaacaagaactgccttgtgataggaaagggatattgcccaggtggcagggggcagtaaaatgagttttaaacaaaagtgggagagatttatgtttgatattaacagctgtgaggaatactcaaaatatttaaccactacagcattatcacagctgaatcagaatagacactcactttgtagaattctggagcacctgttatgtgaggtgttaatcctttagtrgctggttatggggaggtagggggttcccaagggaggggctgagtggcagggggcacttggggttcctggaagatgtggctattcacaagcaaaacggaagcatttcagcctttaaataaccagttctgctgcaccagtgcacaccagccaggatatcagcgagatctcacgtgtcatttatgccaacgtgtatgcagaagttttctcagggaactgtttagaaaaggacacaggatggctgtctcctctgccatatattaaccatgccctgaaaaagggaggtagggctgagagcattttgaagatctctttcctaaaatatgaaaacagaaatgtgcttccttctaaccttccaccttctgagcctggtgctttggcttgtctcttgtgggttaattttctagctgtctatcataagcctgcctttctcccatgaaaagcacaggagctgaagccagctgtccatgccaccgcccactccccactcccatgttccctgtcttctagggcaagagattcccaaacaattcctgttttcattggggttgaatgaagagggctgttttagtctctggttttggggtgtgatgtgctcatttgcagaagcataaaaataatcttttaactcaccaaaaaatactccacagcctaaattaactttgttaaagatcaactttcaaaagagagccttggatgtgccttcgtgggatcatgtgcttagtttacttgtagagtctgtggcttccttccctcctccgaaataggaaatcctccatccctgtcctggttcatggaggttttcaaatgggcttcaggagaaagaagcacgtctctggtttcatccgagggtaggagaaccctctgatatgttgtttattgttgagaatgcactgaattgtatctccctaaaagtcatatattgggtcctaacccctagtatctctgaatgtgacactttggagctggagtctttaagagtaattatggtaaaatgagggcatataggtaagccttaacccaacatgactggtgtccttataagaacaggaaattaagacacaacataaacacacaaagggaggaccatgtgaagacacagggagaggatggccatctgtatgccaaggagacagttttcagaggagcaatcctgcagctcccttgtcttagacttctagctttgagaactgtgaacaaattacatttctgttgtttaaaccatctttgctgtaataaagactgtgatcctttgttacagcagcctgggaaaatgaatacagagaggttgggaggtagttagagcttaattccaaggcttctcctcactcctcttctgtaactgagcctcagtggagtcaagacacctcagctcagaaccsagacctccacctgctctaacactgactttgttcttctcatgtgggctccctttctggacactaggctcctgctttgaggaactgagtccctgtcttagaatccttcctaaaacccttctaggacttctaggttcaatgcttctcaggaatttttactcaaatagtcctagggggtgtggtaggcagaatcatgtccccaccaccccctcttccccacccaaagayatccacattctaattcctggaacctgtgaatactaaccttatatggctaaagggactttgcaaatataattaaattaaggatcttgaaatggagagactgttctggattagcctaggtgagtccaatttataatcattccttatgaaagggaggcagggaggtgagagtcagagaagcagatgtggcaacagaagcagagattggagtgatgcactttgaagatggaggaaggggctgtaatccaaggaatgccagcatcctccagaagctggagaaggcaaggagataggtcctcctctagggcctctggaaggaatgccaccctgccagctgcttgacccacttcagactttggacctctggagccataagagaaagaatctgtgctgcttagagccactaaattggtggtaatttgttagaacagcaataggaagccaatacagggacagcgtctgataaacacacgctctgcacatcaggctgtgccctttgtggccttttctctgaatttgatcttaaaaattcatgcagattttggttcctacctcataatgtaactatgttggtactaaggcgaaataatttaaaatgacttaaaagataagtgtgtccatttttcccttcatcaaatagttaagttgtattagttcgttctcacactgctaatgaagacntacccaagwctgggtaatttataaaggaaaaaggtttaattgactcacagttcagtgtggctgggaggcctccggaaatttacaatcatggcagaaggggaagccaacatgtacttcttcatatggcagcagcaaggagaagtgtgagcaaaagggggaaaagcccctaataagaccatcagatcttgtgagaactcactcactatcatgagaacagcatgggggtaaccattctcatgattaaattacctcccaccaggtccctcccacaacacgtgaggatgatgggaactacaattcaagatgagatttntgtggggacacagccaaaccatatcacaagtaaaagcaatgctctaggaagttctactgtatttgtgctctgcacgtgtgttctgctgggctgtgtgtgcctctgtttgagaaccctggggtggtatgcactttgaaacccgaaaccccaaaacctggctccacgaacgtgcctctgcgaaattcttcccaagcaaagtttccttatcatttttgtgcctggaggggagaagagacaagaaattcaggatagctggagaatacagaaggaggaagagcaaattaacagtgagctttctgttcgattgagcatttgtccacaatatattgagatcaagttttgtttcttaaacaaatctgttaacttttacggtcaatttggggcggtgcaaccggttagaagaattcattaaaacagccaaaatctctggctccgctgaatgtgggaaagtctctgatgccctccaagcagttgtatgaaaaagatgaatcatcaacaatgcagagatgacatgagagatgcagatggggctttgatccttcttgttaccaaaatcctacttagaatgtgttgtcatgaggtccccacttcatgctgccatatcgtggttcctaaagccaggtctggggtacttgctggggtggaatttagaagctagaaacgaacttgctcaagtctacawcccatccacagttcacatgcccttggtccacgcccacttgtgctgtgtgctcctgttctcttggtttggggagaccatatcccgcttgtattgatgacttcatcattctatacttccagcactcagaacattgttttgagggagagtaggtacttagtagatgttcaaacaaaatagtgagttaggagaaggggctaggtccaggattgtattagtttactacagctgctgtaataaattatcatcacaaacatggtggctgaaggaaacgcacttttaccctcttacagccctggagggcagaagtctgaaatcaggttccctgcaccaaaatgaaggtgtcagcaaagctgtgctccctctggagactctggggaagantctgtttcctttcctttactagcttccagaactgcattccttgacttgcggcaaactctgaaattcagtttctcctgcaagtaagaaagttgggctaaatgctcttacagctttaatatctggccttctttgggtgggttccacataatgagaacgatagtttgtattgcaaaaatgtggagctttgagttaggcgatctgggatggaatttgagctttcatattctctctcacaaagaataatatatttgtgtatcatttagctatctataaaataatatatattatctatctaaaataatacctttatagtgtatcttcttccttcctctctcccttctggaccttacctttcctcatctgtaaaatgggattgggctaaggtccactccttgacagactccgctgcttsttggaagtcaggagtcactccagcctcattgatgatgatctgccttttgcatgcttgggggacctacacctctgtacaggcgagagccctccaagcatcccatcagctcctcttctctagatatagtccttagtagttggagctttgcagatgcctccacaatctacagttgtagcctcaacctcttgccctgggttcctgacctgttnccctaggtgcttggtgggcttctctccttgacatggccatgggtgcctcanactgaacctgcccaggcctgtcctctttgattcatgcttattctggatttcttctctctgtcaatggtattcctgttgtccaagccttccttgcttggaaggaacanganggacggatgtatattgagctccctgatgtgcaggcagagtgttgcaggcagggatccgaggaccaccaccctcattgtagagaggaggaaagtgaagcccagggaatcacagaagcttatttttggtgacactgctggtaggcaggtaacagagctgggccctgractcaggtctcctgactccacaacctctgtttttttgatcagaagaatttcttaagttttgttyccttccatggcaccttcacaacattttggccactttgactaattttttattgtgatataatacacataacatagaatctgccattctaaacattttaaagtgaacaattcagtggcgtttagtacgttcacaatgttgtgtgaccagcacctccatctaggtccagaacatcatcactccaaaaggagaccagtaaccatcaagcagttacgatctatttccccacccctccagctcctggaaacctttaatctgctttctgtatctgtggatttactcrttctagatgggatgggatcgtctgttatgtgaccttttgcatctggcatctttcacttagcataatgttttcaaggtccatccatgtcgtagcatgaatcagtactttattccttttcatggytgaataatattccattgtatggatatactatatttaatttatctattcaaccattgatgggcatttgtgctgtttccatctgttagctattgtgaatggtgctgctataaacatttatgtacaagtttttgtttgaacacctgttttcaattcttttggatttatacccaagagtgaaactgctgggtcacatggtaatactatgcttgacttattgaggatagatatccccctactcccaccaccagaatacttttctttacatcttaaaataaaatgatgccagatacagtggctcacgcctgtaatcctagcactttgggaggctgagacgggtggatctcttgagcccaggagtctgggactagcctcggcaatatggtggaatcctgtctctacaaaaaatatgaaaattagccgggtgtgttggcacatgcctgtggtcccagctgctcgagaggctgaagtagtaggatcacctgagcccaggaggttgaggctgcagtgggctgtgattgggccactgtactccagccttggtgacagagtgagatcctgtctcaaaaaataaataaataaataaataaaaataaatatagtttaaaagagaatggtatatcactgccaataatgaaaaccagtttcacttaygataagcagaagataacagcaaactaacaatcaaataaacaaacaaaatcttgccactagtaaaaaaaccaaaaataaagattacagtagtaatattaaaatataacaaactactgttcctgccaagtctcacttagcatatgatatggtttggctctgtgtcctcatccaaatctcatctcgaattgcaatccccaagtgttgaagaagggaagtgattgatcgtgggggctgtttcccccatgctgttctcatgatagtgagtgagtgaattctcatgagatctgatagttttatagatggtagtctttcctgcatgctcacactctttcctgtctccccgtgaagaaggtatttgcttccycttcatcttctgccatgattgtaagttttctgaggcctccccagccatgcagaactgtgagtcaattaaacctcttcctctataaattacccgtctctggtagtatttttatagcagtgtgagaatggactaatacagtatattattgtctcctttaaataattagcaagtgttagaaaggtgttgaagacctattagcaccaagatgagacttcctcactgactaattagaaggattgaaagataatcagagttttatcctgcatacttttaatattattttgtgtctcatctaagtaagacataaaacaatctctgacactatacctggccctctggtgttttccattcttccactgcccaactcttggttcgtctccatccctggcacctggtccttatcaccttccacctgarctttgattccagtcttctgagtttcctgcttatacgggaagctctcctactcaaggggcgcattggacatgttactctccactcttaaagctttggtgatatcaacattatattcagggtaaattctaaacccttagccaggcatccaagaatcacctcagtctgccccccatcaccaccaggctctgtctcccacagtgcacccatcaggtgaattagataacttgttctttctttcacgtgcccatagttctagctccatcgctgagttcttcctcccacctccatctttacttttggaaagcacagttgaaatctacctctcagggttcttattaggatcgaatgaartaaggtgtatgaaaaccctsaaaactgtaagaagaaatacaagtgtgaaacatgtcattgttagtcccgctttgcctttaagtcctttaagttttaagtgtcaagttctccaaggtgccttttccatttcttaggcttgaagcaatcgccttctgcctcctatgcactcagtctttttttatgccagaagacagacagaatggcctccccacatgactgtgaatttattcctcttctatacccttgctgtagccattttcatcttcctcccctcagtgcccagtatacgtgggttgaaagagcaaatctgtgcctacttgcaggagaaaccatcttgtcgtcaatcagaagtggagaaagctatagccacactgcctctgtcaaacatactttctttccttatttctcttccctcattagttgcatcttggaatgtgctttgtctaataggaagtgacagtttaatcgtttgggtttttaaaatttatattctgctacacagctgaccacatgcgatgatcaggcagcccagcattatggcatgagtccattccacttttgcatcagaagatttgggtggagccatgaaatggctgacctcatgcatagcaagagagttgaaaatcactgtgggggacaggagctcttctagggagaaagaagtcaggtatgcgtgcaggtgcagagngggcagatgggcaggaagcctgacagttttcctggaccctgggctagatcacccttttcatcgtccagggtccctcctaccacttaaantggatttctgtgcrattatttattcttgccccttcttttgaagtcctttgagcctttgaacttgatatggtttggctgtgtccccacctaaatctcaccttgaattgtagcttccataatcctcatgtgtcctgggagggattcagtgggaggtaattgaatcatgggggcaggtctttcccgtgctgttttcgtgatagtgaataagtctcacaagatctgatggttttataaatgggagttcccctgcacatgctctcttgccatgtaagatgtgaccttgcttctcatttgccttctgccatgattgtgaggcctccccagccatgtggaactgtgagtccattaaacctctttcccttataagttaccagtctccgatatgtctttattatcagtgtgagaacagactaatacagagctctttcagtggaaaagatartacattaaatcgttataccaaacnttataatcatggatggtattgcagtcacattatctgccaggagaattggcagggactgtagaagggatgtccactatttaacttgaaccatcatacagatgtgaaatatgaggctcagagaggctcagggacttgctgagggacacactgcttcctgagtaccagtcccatgggtctcctggcccatcagatgttgattactggtgctgatgaaaagaccaacaaggatattcattttctgtgatgggggatggtaataaaacttcttcctgcaaactcaccatgtgcactgcattgccttcagataaaatgtaaactcctggctgcacaaatccctgatttctgacccctgctgaccttttgagcttcaactcagttctctcctcattttgcantttgctctagactttcccaaagagggctctgaggaatatgaccctacagaaaaaagtttaagccaaaataaatttaagagatgctgtacatcatgggatcctcagatatttacaatgcacatgagcctcttcaaagctctgagaagtcctgcgctacaganacggtttaaacttatttcctgctgtttgaacgaatgtttcccaaatctatttgatcagaagactccccttntgttttttatacaacacttgttcttgttggcttgataaaatatgacaaaaaccattgccctgattgctaaaatataacaaaaacccacattgctytaaatgtgcctctttcacattttctggcacttgtctgtgctgctatttctgtctgtctcatatccttcaaaactcatctcagaagccatgccctctgagaaaccttggactgctgtcccccacaggattaggtgccgttcctatacttttgtagctcctgcattctgataatttatttgttgatttagcttcccagctgtcctcagtgaggacaggaacagtgtcttatgtgttaatgtgttcagtgagtcattccataaacatgtactgagcctcctctacccaggcacacagttcagggcactgaggatgctgggggaacaatgtccctgcccttatcaaacttatattccaggggatggggacaaaatataaacacggtaaatatataatgttagattgcattaagtgccacaggcaargcagggtaaagagactgaaagtgacaggagatgccctttaagatagggtttcaggaaagctggatcagctaggatggatgaggccctgctgcacaaacagcccctgtatcttaatggcttataacaataaaggcttatttctcgttcatgcaacgtgcccaccgagggttggctacgacttctgcgccatatcgcctcacttgtgggnccagatggagcatggctggttgttgtggtgtaggtggggagggggatgtggtgagtcatacgctggctcttaagggcttcagctcacatttgattgccacaactgattcaaggggccaggaaagggctctcctgccatgtgcctggaacgagaggaaaactggactgtggggtggacagcattaatgaatgcacaggaaccctctctgacatgaggacttttgcacagagaccttaatgcagaaaggaggggagccttgtgaatacgtgggaggagggtggaggaaacagcacttgcgaagaccccgatgcccctccagcattcagcacggggtttgacatgaagtaggtgaccaggcagtgtttgttgaatgaatatcttgaattccaggacatgctgcattaaggagatctttccgtctcagttgtccaagtggcaggtctagatgaggtgagtgttcatttgtaagagtggaaaattctaaccagcccaaacaaagattgtttggtattggagtctcaattataggacttagagtcagtatactgaacttagctctggctacaaaatttattttgacttgtcctctgactcaaggccaggatcttatgttctagcacaagaaacaaggcagaaatatgtaaaatcaccctaactatagtasagtgtttagaaaaatgtttataaaatacctataaaaatgaaaattagcttttctccttgtgtatacctgatgggtttatcatatttgaaatgactycatcactgtccagattccctgctaaactccacctgggcaggagcatatccccttcrtagagtccccccagcacctagatactgcctggcaagtgatggatggccaatatatccagtacttgtggactggttggcagagggagggaaagctatgcagcatttttcagactttatttttaagagcagtcttaggttcacagcaaaattgaacagaatgtacagagatatcccaaataccccctgccctacacatgaatagccatccctgtgatccacatnccccaccagaatagtaccaacttgtaacaayattaattgttacaactgataggcctacatggacacaaaattatcgcctaaagtccatagtatacattaaaattcacccttggtgttgtacattctatgggtttgaacaaatgcataatgacttgtatccaccactatagtgacatacagagtaatttcatgaaaaaaaatcatctatgttctacctatttattcttccctaagcccctacctcctggcaaccactgatcttttcactgtctccatagttttgccttttccagaatgtcatatagttggaatcatacagtatgtaaccttttcagattggcttctttcacttagaaatntgcatttaaggtccctcaatgtcttttcacggcttgatgtcacacttcctttttgcgttgaataatattctattgtctggatgtaccatcttttagggtatggctatggggagagttctgacctcagcactattgcttgtcaagaaggtgacatggatttaactagcggaagagtgggtttatcawtaaaggcaatggtgaactgaacatgaaaccaagaagggtgatcaagctagagaaaaatcagctgaggctcctggagaatgaaccaggtcagagtgagtgatggttggggggraaacggactggactcagtggatgtatagaatwtcaatagtggagctgggggaagattggcacatgggatccatggagttgaaccatcattatgtccacgttaaatgctaactttggcaaaaataaaccatttccatgagcttctccagccggagaaaacagcatgaataaagacacgtaggtggccaagtacatggtgcgtatggacagccatatgcagatcgctttggttggagcatggggtgtttgtattttaaccctgactcttcctaactttgatgctaattttgagcaaatggaaatggcactagccacattcttggatctgtctggtatctggatttttgggttacactgcttgatttttttgcgcagtcctaggtcctcccttactgagaccactattgtactggcttccctggtggctgctgccaggggcagggtgtctgagatgggctccttcaggcacactgtgtctccttctcaggacgaaggacaagagcagcatctctgtagacatggtgctaagtcagcagaaggttctgattgtgcagattcagcatttctcttcctgctggtttgaatgaatatctcacctgcagctgccttgggaaaagctgtagtgtcagatgaggagggtcggaggtcagacagaggctgggctgttttggtgactcagattctttcgtttataacacgntggtaattccacttggggagcctttaatgcctcgaactcggaggccttggtagagactaagttaatggatttgaaatttctttgaaaagctgaaattactggacaaacacaagatggtagtggttgttatagtaattatgataaaaatgagaggaaacttttaattttccagcctgatatgatttgaaggatgcaaaaattgaatctgatgttggtcaagcattgatcttgcagaaaatgtcctgttttcctatagcaaagagatgtcctaaaaatggccctgtaacttttgaattgagtccctagggaaccatggagttttagggtaatatgtttgcaccttgaaggaacatttgattttcatgccccattgtttcccatcgcttcatgcttcaatgccttggtgcaagttgttacctctgtctagaatgcacctccccacctaactggcaatgtcagaaacagttcttcacttgtaagcaccagacacattctctggctagctaaagttgaaaaggaaaagagggggaactcacaaacttgagaggttgaggggactaggcaggactctgagggcatgctactcaaaattaaaaagcctgttggacacagcttgcatgttgcatctcagctctcgatcaagcaagtgcatttaatagactcatcaagatggcggacaggaagagtgagcattccccgagggcattgatggcagtagtggttgctatgcagccaaagaaattaacacatgcctgtttcatcattgtttagtccccagctcaacagtcatctcctcgggaaactttctttgacttcttctgggtagggtcattcaacatgcatgatattcaacagatatattagtatctaccatgtgtcaggcatgttcagggcacaggttgcagccataaacaagatggacatgatctctaccatcaggaagtttacctttcagagaagcaagatgataaacagaatgaagaagcatataagttaattttaggtagtgttaagtactagacagggaaataaagcagggagaggtaagacagagagtgctgtggatggataaaggtggagtatttaagagaggctgagcaggaaaggtctctctgaggaggtgaggaagtgagccgtgtggagtataggcagcaggtgactgcaagtgtctagacgctgggtgggtaggggagggtgggcttgccatgtctggggaatagtaagaagactaggatggctgcaggagagtgatcagataggaagtgggaggaaacaggttctgagaggtagagagagggcagctctcatgggacttggccatgaaaagactttaaaaacaaatagatcttaaaatagacctggttttgtttttctcctgaaaacaggagataccaggtcaagaaggttccttctactctaacccttataaaaaataacctgaagcccttgttcccaccttataaaacccactgctatttcctagtgggatttgaaaccaaatagtgacagagtgatgccagtgcctaaagttttggtcagtctctcaactgagaggttgatcaaaagggggaattattaagtttagcgaaaagctgcctctttacatactttaaaggtttctccataagtagtgaactgcaacctaactggatgtgtaaacagactgtaacccactgttgtccaaacaacygagtttcagccaatcaagggggaccaactgttcaaactgggctcaagtagggcaaatgccaagctgtaatggatccagctgtttctgcacctcgcttccattttctgtctgccactttccttctctgtccataaattttctttgtggtagaaatggagcctcttcacacctgttctggttcgagatctstacaattcttgaatcattctttgttcaattaaacacaattaaactttttaaaagagcagtttgggttttatttcaactgtgatggaaaaccactggaggggtctgaacaaaggattgacctaactttatttatgtctttaaaaaatactactctggatgctgcatggatagtaggagttctggagtgaggaggggatagggggcaccagggaggccagttaggaggatattacaataatccaggtggagacaggacaggatggttacttgggtgaggaggtactggtggaggtggtgaaactgaccagtttggggatgtgcttggaaagtggactgctctgtacttgctgatggatttgatgtgnggagtaacagaaagaaaagaatgagagagaaagaatgattcttagggcttttatttaatcaactttaaaatttgaggataattttagagttgtagaaaagttgcaaaattagtacagagaatttcagtatatgcttcacccaggttgccccactgggcaaagtcctaganttctttcttaaatttttaaaattgttaattattgtgcatacatagtaggtgtatatatttgttaggtatatgggatattttgacagaggcatgcaaatgtgctataatcatatcagggtaaatgtgatatccatcacctcaagcatttgtcctttgtgtgacaaacaatccaattatactcttttacttacttaaaaatatacaattaagttgttattaactacagtcactctcttgtgcattcaaataccatatcttattcgttctttctattttttgaacccattaaccatccctattccctgccctcacacccccaataccctttccagcctctggtaaccattgcactactctctctgtctgtgggttcaactgttttcatttttagctcccacagatgggtgagaacatgtgaagtttgtctatctgtgtctggctttttccacttaacgtcatgacttccagttctatccatgttgttccaaatgacaggatcttattctttttatggctgattagtactccattgtgtatatataccacattttctttattcatctgttggtagacacttaggttgtttccaaattttggctattgtgaatagtgctgcaataaacataggagtgcagatatctctttgatatactgatttcctttcttttggatatgtgcctagcagtaggattgctgggtcatatgttagctttatttttagttagagttttaatatggtatagttaacgtgctggatggagttgacatttgttgagatggggaagacgcagagaagagggagatatctctagctctgctctggccatgtcagcaaatcatttcacattcaagtggaagcagatatcaaacaggttggctagatctgtgaacacggagctcaggagagagcctgggttgtgggtgcagctgtcggcatttagatagtatttaaggtcacagaatgctccactcttttatatttggtaattttcgtaataaaaaattcatttaaaatggagtcagtttaaggaaatatgattaactgataacttaggtcatacttttctacaaatggccagtagaaaatgttttaggctttgcaggccataggatctgttgcaactactcaactctgccgttttagcacaaaaggagctctagataatgcatcaatgaatgggcatggctgggttataatgaaactctatgtacaaaaactgggtggtggactggatttggctcacaggctgtagtttgccaattcctgggctctacaatgttgagaggttgggaaggtgatgacaaaccatcaaggaggctgacagggagcaaccagtagggtagcaagaaaaccagggcagtgggaagctcaggaaggcaagtccaggaaaggaattctccattatgtctgatgctggtaggacaaggaatgagaattgtcctgtggatttgacaacacagaggttgcaggatacctttcagtagcaccgtcgtggccacacctgaccagagttcgnagaggaaagaatagcacagaagtaggcagggtggttatagccaactctctagatcatttttgctataaaagggaacagagagamatggagaattatctacagagggacacgaggtcacataagggttttcatttctgtttttaaggtagaagctaygcttgtattttggggtgatcctcctcatgattttgctatggttggaccctgtatacacttcttcttcttcttctttttttttttttttgagacagggcctcactgtgttacccaggctggagagcagyggtgcaatctcagctcactgcaagctctgccctaccaggctcaagagatcctcccacctcaggctcctgagtagctggggccacaggtgtgyaccaccatgcctgcatgcctggctattttttttttttttttttttttttgtatttttagtagagacggtgtttcaccatgttgcccwrgsctggtctcgaactcctgagctcaaatgatctgcttacctcggcctcccaaagtgctgggattacagtacacttctacaattaattctttcacattatcatttctttaaaatctgtgtcttcttttagcagggtttctcagtctttgaacgtgacgttatgggccagacaattatttgctggggggagggcaaaattgctgctcgttaagctcctagagtgtgggactagatttactcttcttgttctccctggtctttaatactatgcctggcatacacagggggtgccataagtattttgctgagtgagttggtgaatagawgtgttcctttacaaagtactgttttgatcatctcataagaaagtcacatggtacctgggtggcctgagggaaaagcaaggcaggtctccagggttgagtttagcatgcctgatctttgctgagattcaggatttccaattgcactggagaggattgtgtaggtagtagcaagagggtggctacatttagctgacgtttctcatgcggcttctggactatcaaggtctcttgcttcatgcctcctcatctgcttgggaatgttgcttatgtagtttctccaaaagcaagtggacatgagggatggggaagctctttatctcaagcatgattattacacgtggattccattatttaggcaaatgctgtctacagacgctccaggagccacctcccaacacctgtctttcacctcttgccagagactcaaagatgagtgggctttcagagtcataacaataataatattaatagctgtcactctgaaatagacatggcaatttatactctgtgggggagtctttagtccctcactggctaagcacagtggaagggcacctgtatgtgaggtgatctcagtgggagatgaagatggtgaggaataggctaagtacctccctccccttgtaccaccctctgatgcaaacatgacctccacctttaggggattctataaaatgttgttgaatgggctgggcgtggtggctcatgcactgtgggaggccgaggtgggcggatcacctgaggtcaggagtttgagaccagcctggccaacatggtaaaaccctgtgtctgctaaaaatataaaaattagtcgggcgtggtagcacacgcctgtaatcccagctactcaggaggctgaggcaggagaattgcttgaacccgggaggtggaggtngcagtgagccgagatcgcaccactgcactccagtctgggcgacagagcgagactccatctcaaaaaaaaaatgttgaataaatggatgagtggatatgcatccgtgctcccatcttgttcctgtcttccttttatttgtgtttctacctggcaccaagggtgtcctatagctgtctctgagtaagactgaattcataagaatttattaatttctctaaagagaggagactcagggtcccagtaactgaatgctgttcttmtttcagtctttcctgtatcaccttcctggattttgccatatcaaggtatcacctactttasggatctataaactatggcctgccacctgtctttgtaaataaagttttattagaacagaattgcacccatctgtagatgtgctttctatgggtgctttcgtattacaacagcggagttaagcagttgctatggcgaccatatggctcacaaatcctaaaacatttactatctggccctttacagaaaagcatgctggcccttgaagtacattattatttaatcaatttttctttaaattgactcagtttcagaataaacttattgctatggagattagcaaacatacaagaatagagagaatgtgtaatgaacactcatgtaccctcaattcagcttcaactcatggtcaattttttttttttaaaaacagctscattgacatctaaataatattaaaaactgcgtgtgtttaatatacataatttgatgagtttggatgtatgcatgtgcctgtgaaaccatggccacaatcaaggtaatagatatatctttcacttcaacagtttccttgtgtctctttgttttgtttttgttgttgttgtagtgagaacacctgagatgagatctctcttaagaacattttaagggcagaatacagtttgttaactatagacactatgttgtccagcagatctccagaacttattcatcctgcataactaaaactttattgaacagcagctccccatttccctatgcccccaacccttggcaaccaccattctattctctgcttctatgagtctattttagatatcctgtatgggtggaatcatgcagtttttgtcctctgtaatggtcttatttcacatagcagaatggtccaggtttttccatgttactgcaaatagcggacttttttttctttttttttttaggttgaacaattttccattgtataaatatgtcacattttctttattcattcatctctcttttttttttttttttttttttttgagacagggtcttgctctgtcgcccaggctggagtgcagtggcacgatctcagctcactgcagtctccgcctcctgggtacaagcaattctcccacctcagcctcctgagtagttgggattacaggggtgtgccaccacacctggctcatttttgcacttttagtagagaccaggtttcaccatgttggccaggctccattcatctcttgatggacatttaggttatttccgtatcttggctgttctgaataatgctgcaatgaaacttctgcgaagcaaaggaaacaatcaacagaatgaaaaggtatcctatagaatgggagaaaatatttgcaaattatatatctgataaggggctaatatccaaaatatataagaaattcctatgactcagtagtgaaaattattaaatggacaattaaaaaatggacaaaggacttgaaatatatgattcttcaaagaagacatgcaaatggccaacaggcattaaaaaggttctcaacatcattaatcatcagggagatgcaacacaaaaccacaacgagtgactgtgaaattatctcacacctgttaggatggctattataaaaatgaccaaagataacaagtgttggcaaggatgtggggacattggaacccttgtacactgttggtgctaatgtaaaataatgcagctgatatgaaaaacagtatggcggctcctcgaaaaatttttaaatttttattatcggttggtgcaaaagtaattgtggtttttgcaattaaaagtaatagcaccarcstaatggaactatcttatgatccagcaatcccacttctgggtacatatcccaaagaattgaaatcaggatctcaaagaaatatctgtaccctcatgttcactcatgttcattatggcattatccaagagagccatgttggggacaatcttatttaaaaaaaaaatttttttttgagacagagtctcactctgttgcccaggctggaatacagtggcgtgatagtggctcactgtaacctccatctcctgagctcaagcaatcctcctgcctcagcctccctagtagttggtactacaggtgtgtgccaccatgcctggctcatttttgtgtttttctgtagagatggggtttcaccattttgcccaggctggtctcaaactcctgggctcaagagatccacttgccttggtctcccaaaatgctgagattaaaggcatgagccatcgcaccctgcccaatctkgttttcttaatactccctcctccctaataccttaccaaccccctgattattttaatgcaaatctcagaacttatatcattttaatttaaagtttcagtaagtatattaaaagaactcctgtattgactataaatacaattttattattcctcttaattaataattccttaatatcatcaactatccttaaataactcaaggtttttaaacataaatacctacttaagcttcatttcaagcaataatttgcttgaaattatggttcagatatgctatttatattttttaatatagtagaatggctcctgaatttttgaaaatttaagaggaaaatgtatccctgcaccatctaaaatgatcttgtacaccatcagtataccacacmctggaatacaccacgttaaggaggcccttagcggaaggcgttgtccactttcttctttgaawggtatgaaaggtcttacagtgtccttgttttcacaacccagacagagttagtcagtgcctggagcaaacaccagcgacatgcataccaaccatgaaatctgaaggaacaacaacttcatagtcatcttcaccagctcaacacaatttatagtacaattaagaccggcaaatctaattggataaacagaaaatagaattaaggtaatctatcctaagtataccaaattcctataatgagttgctttcagcagttgtggaaacatataattaccaaacaaattacatgttatttttatctaagaagctaattaagtgttctgtgtaaattattatgtggtggcaccaggatcagagttgtattaaatacctaattggaaaagggatgagacccgagaattttacatgggaatgtgactgagagagatcatagcaagagggtctgattcagagacagggacttgagagaagctaggtggaaatgggagagggttagggtgtctttggttggtttaaatttgtttgtgtttttagagacagagtcttgctctattgcccatactagagtacagtggcatgatctcagctcactgcagccttgaactcctgggctcaagcaatcttccctcttcagcctcctgagtagcagagactatactcaccaccgcacaccaccatgcccgggtaatttttaaatgttttgtagagacagggtcttgctgtgttgcccaggctggtcttgaacttgtggccttgatcctcctgccttgacctcccaaagtgttgggattacaggcatgagccactatgcctggtcactttcgttggtttaacttgagcctggatggttgaggttaagtcagggctctgacgtgtatggagccttagtctttttaatttatctgttctttaaacttattcgtctccctaaatgtaagctgcaagtctctgtgtgctgcagctaaccttaaccctgggttttttgagtgtgtgtgtgtgtgacccttatataacttccttactttgctctcatttcctcatttccctgtggctcagtaaatcttccaatatcttcttgtgggttcgtgctcttttgyaccctggaatggtaggacatgggcgctttgggatatttcctataactcagaacaggtagcctggaagaattttgcaatgaagctttgagctggcatcagcctcaagaaacatatccctgttgagtgtgataggagaggcagaggcttctcctaagttgaggcaggtgaggattgaagttgctgcatttccaccaggttagacatagtgctgtggtggaaagcactctcagctggagtcataagaccagatttattgtccctgtcctgctgttggtgagcagtgtgacctttggcaatgcatcattcccttctgagctctggtatctcatttgtaaaatgtggaaaatagcccttggcctatttacctcacagaggtgccctgaggatggcatgccatagtgtaaatgaacatcatctgtaaaatctcaatttttacaacagaaatatatgaaaaggtctggcattatggttgtttttaaccaatggcagctgtaggaagtcagacaaggtgggtgatgtaactgaaaagagcaggaatcttccagcctggctagatccaggtgtcatttggatttggtctctcctgcttttccccttgattcttctctgtattcattgtgtttttattttattttatttcatttttttagatggagtctcgctctgttgcccaggctggagtgcagcggcatgatctcggctcactgcaacctctgcctcccgggctcaagcaatacttttgccttagcctcctgagtagctgggactacaggcacataccaccatgcctggctatttttgtatttttattagagacagggtttcaccatatttgccacgttggtctcgaactcctgacctcatgatccgcccaccttatcctcccaaagtgctgggattacaggagtgagccactgtgcctggcctattttttatttttttgagacagtgtcttgctctgtctcctaagatggagtgcagtggcacgatctggctcactccagcctcaccctccggggttcaagcgatcctcccacctcagcctcctgagtagcttggactacaggtgcataccaccatgcctggttgcttatttttatttttgaagagatggggtctcactatgttgcccaggctggtctcaaactcctgggctcaagcagtcctcccaccttggcctccaaaatttctgggattacaggcaggagccaccacacccagcctgtaytgactttattcagggaatgtctccccaccccaactcccagtgtggcaagacagtcactagcagaagtgttgcatctttattctgtcagttaagtgacttaggggaaacagagtgcagagtccacttcctggtcgcttcatcrgaagtcccagggctaactctgattggactcctcttcctcacttgcccataaatcaaccaatcacattgttcaggataggaatacactgactgaccaggctggtcatgtgcatatcctgagagctggagatgctgaagttgccccacttgagctacatggaatgaaaagtggggacagttggttccccaaaagtgccagaagaaagagtgttttctggactagagaaaaccaaagatctcattctcccataggctacctatttgaattataatagaaaaatttactagattgagagtcagggaagacttggattctagtcttgactgtgtcactatcactccgaccctggatgtgtcaactctctttttgggaacccagtttccaaatctttgaaagagatttgggcctgaattcttctgaagttcctcaccttttcttcaccagggactcttcttatcctgcggctttttatcgtcatggtatactgtgtgttttgccggcaaaacaaaatacattaattaagtactaatcgattttatttaaaaaaatgaattaacagcatacaatcaattgccacttagaaatgcagatcaacagaacataaggtaaccagtggaactacactgagttatatatattccagcccaaagcaaataaacttaaatatttctttaatcttgcctgtgttgcctgggacagcctgattacagggcagaatttgaattatgccaggccttatgaaatgttcagcagggctatagattcctatttctcatttactggatctcaggtgcctgtaatcccagctactctggagactgaggcatgaggatcactttaacctgggaggcggaggttgcagggagccaagattgcgccactgtgctccagcctgggggatagagtgagactcccttcaaaaaaaaaaaattatttatctcatctctctgggttctgcacatatttgaatttgctgcacctgatacagaccaaatcagtgtttcctaaacctctctgatattaaaaataacctgtgagctctttaaacttacaacctcttgggtattccccccaccccactttgattcagtatgtttgggtaaggttgcatacttgcctttttaacaaggtatccccaggtgattcttatcgtaaagaaagtctggaaacactggactaagtaacatccaaggccttactactctaagtgtgagcagccacatctgtatcccctgggatgtcttgtttaaattgcacaggccaaaccctacagacagacaactggaatctggattttaacaatggaagcagattggcttttgtttttaattggcttttaatttgatctattttctgttttcattgtaatgaggctttcagctgcccctcttgccctaggcctcttcagaagagacatttccctctcctctccctgcctccccacagggtataataaacacctgttggggtttggtggggaagctcaccctgacctcccatcactgagacacgaggtgcaaaagtgttctgcacacagcctgagatcttgcctctcaaagcagacttgacccccaagcttccacccctaggtctcaggaagaaatggcctcagcagattccaggcctccagggctgtctgtttcatgctctcaatttttacttggcttgatccgtgctgtctccatccggtgttctgaggcatttcacacacgactggtcttcggcaactgggccaagcytgttctgttctttttcagttttcttaattgcaaggctttttgtttccccactggagaactcccataccaagaattctgaaatctaggtactcagaccttagtggatgatgttctctcagcacttaattcactcatcattcaataaactatcctcaagcaattctatattcaaaacattctgataatgatggcatagtaataatgataatgataatagttggcatgtattgaaattttattatgtgcaagaaactatgccaggtactttaaatatctcatttaatcctcacagtaagtctgggatgctggcactattcttacccctgcttgacagatgggaaaactgrggctcatagaaggaaacagagtgcacagtgtctctgatatggtttggctctgcgtccccacccaaatctcatctcaaattgtaatccccacgtgtcagggaggggcctggtgggaggtgattggataacgggggcggattttccccttgctgttctcgtgatagtaagcgagttctcacgagatctgatggtttaaaagtgtgtgtcaattgcttcttttctacccatccccatccttccgctgtgtgagatgttcctcgcttcstcttcgtcttccaccatgattgtaagtttcctgaggtctccttccccagccatgccaagcggtgagtcaattaaacctctgttccttataaattacccagtctcagatagttctttacattgtgaaaatgaaccaatacagtctcacagttgaatagtgatcgaatgtggtttcaaactcagccckctctgacttctgagtcttcagtgttaaccatctcacacacttatatgatttaggcttgatggaaacagcccacttttcatgaagcattatctacagagcctttaatttctactaatgccaagaggaaagtgccatgcccaccttggtgatgacagaactagggtctaggagtggattcatatggtcagagtctcatggccagggattggtaaaatccaaatttggaatctggcttctggctataagcccaaggttctttctgtcatcccagactgtacagcccattatctcaaggagctggcccctcagaggcagagagatcatgttcagtatctaggagtttatgacaagtactatgtggtgcatcccaggctctgaggataaagtcatgactcttgggtgagctcataatgcgggcttgcattgcttcagcccttactttgtgctaagcatgtcacactctctcatttaatgctcttaaccctacaattacccccattttacagaggaggaaactatagtgtctcncacagaataggtgcacagtgaatttttattgaaaagaagaaaaatggcacgtgagttgaattaaggaaatgtaggccagggctggggcaggaaggcatacagtggccatacagccagctgacgggaataatcgagtgcctgaatatggagtttgaacttcgtcctccgttttgtaagtagctaaggaagggaaatgaaattgtccatagtgtgcaggaaggactggaggcaggtgaaagcattaggtcattgcagacctccaggtgtgggtgatatggctcaaactaagatggagaaaataggaacacctgtcagcatgtgtagggggcangaatgtgactttagagtcaggcctgctttcaatccagcctcctcatttaagcaagttactttatcttctctgagcctcatttttgttctccttttaaatgagggtggtaccacctacttattagggttatgtagcatgtgctgttggggctttcccatatgcccccagtccttgcctccatatactgaagcttgctcactgtgaacccctccgactctgtcttttctggctttggaagcaggtttagcccacctgcagggggagtgaaggtgctggaagcagccaacggtagggatttgtggataagcactccagtcckttgtcttgtaggcaggataactgtgatgtagagtagatatttcatgctatatcccagatgtctctagtgatcttaaggcccagttgccttaagcagtcacttaatttaaaatttaccatttattgtttccttttacttccctgtctcacttctctttcctcttaccagtgtttcctgggatcatttctcaaaccactgggagctcaaattctttttcagggcctcaggtcataataatgataaaacgaaacattgtntgttaagtgcttagcacagtcgtgaggcccaaggtcagttscccsataaatggtagctgctataaacatcatcatcattaccatccttgtgaaggtggagtgaacttattctttcaagacatttccactgacagataaattcatccaaaatatgaagaaaaatgggggaggaaaaggtcacctagaatatgcagagcaaaatattgcaatgatttctttttttaatgagatagtttattaattattaatcagtatctttaacctttagtccttgtttaacaccatggataacaggtctacaattgagtataattagccaaatgcctcttgcatcctaaattggctattctgagttacacagtttgattttcttggaaggaggacctggtttcattagmacctagttgcaaatgaatctcctccttgaagttyttgttgctatttgagcttgtttttagctggagatttactcttggattttagttgttttcgccttcatctgttgaagaggtggsatgatattgcgtgtgtgtgtgtttgtgtgtgctggaagttatgcttccaatatttacaatattggctttccaaagcagaagatgatgggctttctgggagggtggttcaataggaaaccttcagaaccagtggggttggatggtggagcagagkgtaaaagggagagtgatgaaaagtagagtgattgaaaggataagcgcatctgcttttagacttgctcacttaacttatatgtgcttatctggaccttggccccaggggaggagatagaggaatgcgtgagaagctgtcttgagtgttagggacggagtatgatgaatgcaacaactgtcagttctgtgtcaacttggatggggctacagtctgtactcagtcaaactctaatgtaggtgggttgtgaaggtgttttgtaggtgtgattaaagcttataatcagttgactttaagggaggttatcttagataatctgggtgggcctgattcaatcagtcagatgccttaagagtagagctgaggcttctctgaagagtaaattccacctgaggagagaaggtttagctcatgcccagaarttccagcctgccctgtggatattggacttacctacccattccccacaatcatgtaagccaattccttgtcatgtatttcttaatatatgtctcccgctcatctgttcctttaattgaaccctcaataatacagattttggtgccaagaatagggctctgttgtaacaaataccttaaaaagtggcagtggycttggaattgtgtgttgggcagaggctagaataatttggagacacatcagagaaaaagactagacatccttcaacagactgtgagtggaaatacgaatgctaacagttctgtttctggggactcagaagtaagaaacatgttagagaaggcatacatcattttagagactacctaaatcatcatgaacagacttttggtggaaatatggacgttaaaagcattaccagggagggctacctacgaaggaaatgttattgaaaactggaggaaaggacatccttgttatatagtggcagagcatttatctgaattatatgctacagttgtgtggaaatctgaacttgcaagcaatgaacttggtaaagtgttgaaggggcagcctggtttcttcttgctccttttagtaaaatgtgagaggaaagagattgaagcaagaactgttaagcaaaaagmaagcaagatttgatgacttgggaaattctcagcctatctggattgcaaaagatgctaaaattaggagatttactatcaggaaagcatgttaggaaagggtatggctgaacagttttttttgctagttcgttggaaagataaaaagtcccagtattcagccacacagagtgctctttgaagagattaggtatgagactcatgtaccccttggccatcaaatcagaagcaaagaatagatattaggattatctaggaaagaactgtgaagaaccattttttgtctgatggagtgaatccccatgacatactcaggagacccataaggtttttgaaatttcctaccagcataaacattggcaatttggacagaagggaacagagaagataaaatgaaggaaggccattacactccctaaattytttttttattattattatactcgaagttctagggtacatgtgcacaatgtgcaggtttgttacataggtatacatgtcccctgttggtttgctgcacccatcaactcatcatttacattaagtatttctcctaatgctatccctcccccagccccctaccccctgacaggccccggtgtgtgatattccccgccttctgtccaagtgttctcattgttcaattatcacctatgatatactccccaaattctacaggcaggaaatgacggttaaaactcttaggctggaaacacatattacccttcatgagaaaggactggttactcagagggtagagcctcaagctcaaaggacagagatgggagaggattatttctaggctttgaagcctaatgtttgcctaactgaatctctcctctcctttttttttttttttttttttctggaaacagtgtctcaccctgaaggccagactggagtgtggtgatgtgatcactcactgcaccttcgacttcctggtctcaagtgattctcccacctcagcctcctgagtaggttggactacaggcatgcaccaccatacccagctaatctgtttttgtattttttttttctttttyagaggtggggtttcaccacgttgtccaggttggtctccaatgtctgggctcaagcattccaaccaccttggcctcccatagtgttaggattacagggattagccactgcatccggactgcctaactgaattccaaaattgtttggatgtggtaacttgttttttcttttcawtgattccttttttgatcaaaaacccctgtaactgatatcccatgcctgttccacaattgcatctggggagcagataatccgttttctagttttacaggtccacagttggagagaaactttgacccaggagggatcatgctcagattcttataagtacttgacttaggtgattgagataagattttagacatctgagctcatgagatttatttatttatttataattattattttttttgagactgaatctcactctgtcaacccaggctggagtgcagtggcatgatattggctcactgcaacctccacctcccgggttcaagcgcttctcgtgcctcagccttcagagtagctgggattatgggtgcacagcaccgtgcctggctaatttttgtatttttagtagagactggtttcatcatgttggccaggctggtctcgaactcctgacctcaggtgatccacccgccttggcctcccaaaatgctgggattacaggcatgagtcactgtgcctggtctgatgagattttgatgaaaattttggactttgacactatcgtgagttagttttggggagatggagtgaatctttsggagcaagatggtggcctggcaggcagaactacgacctctcaaagatgttcaccttctaaactctgactcctgtataaatgttatgatttatggcaaaagggattttgaagatgtgattaagttatggatccrtcttgagatgagagcctcatccaaaattatctggtgggcccaatataattgtgactgtacttataagaggcgggcatggaagagtcagagaaggrgatgtgaccatggaaacagagttagagtgatgtggccatgagctaaggaatgtgggcagactctacaaactggaaaaggtaagaaatggattctcctctaaagccttagaaggaagcactaggaaggcctgctggtccattttaggtttctgacctccaggactttaatacattttacatcactctaagccactaactttatggcaatttgttacagcagcaatgggaaacttataatctgttaagtgccaggtcttctgctacactgcttagacgtattattttgcttctttctgcagtcctttaggacatacgtactaaattcccattttgtggttgtggaaaccgaggcaatgaaagttcagatagcttgcttaaaatgacagatctagttagtggtggctctgggatttaaccccatgcccgaatgattccaatgcctatggactagctcttgcatgataaatgtcaagggacatgaggagttaggtcagaaagccatcacgacatagctcaatgtgtggctttacatttgacgtaggatgacctagtggtaagtggtatagcacctgtttaggtgcactggagacatgttgcatggccccaaatccagctttgccacccattactggctgagtttactttggacaagttatttcacatcttttttttttttttttttgagacggtgtcttgttctgctcattctgttgcccaggctggagtgcagtggcacaatctcagctcgctgcaacctctgcctcccggkttcaagcrattctcctgcctcaggttcctgagtagctaggattacaggcatgcaccaccacgcccggctaatttttgtatttttagaagagatgggatttcactatgttggccaggstggccttgaattcctgacttcaagtgatctgcctgcctgagtctcccaaagtgctgggattacaggcgcgagccaccaagcccagactatttcacatctctgaacctcagtttccttacttataaatggggattataatacttttttttagggatatggagcttagaggagaataatggtggtaaaatgcttagtgcagtgcctgacacatcataagcgctcataagtaaaataataacagtagtagtaataataacartaataacatgctaataataatggcgaattactcttcctgttttgccactctaggcagagggatattagtgaagagaatacaagatccatggtgggtcaggggcacaagtgtgttacaagcaaaaagaacagcaggcactcaggccattgcctatgaaatgttcttccccacctcttaaactggctaatcccattcaaaagccatgtctcccaggaagtcttccctgaccttcttggctgaaacagacgccctttctctgagggcctatcacagaaggtactttcctactctagtcttgtcaatgcatttgaagcctctctcagtagcctggaaactccgagagcagaggtgctctctgtccctctcttatttattgttataccctgagcattaaaaaaaaaaaaaatgggataagtggtgagaagagactggagcggcaggccttggccatgctaggagggaccctttagcttccaacttcccgatgaatttscccccgagttggtttgctttgtctttgtaactgagaacagcctagggagaagcatggacatgggggacctgcaggcatgagactggttgsttagcatctccatggcccctcactactacagcccactctacatgctgttctgggcctcattaaaacctgttctccactagcctcggtgtttaatatttatckatcacccacagcatgcaagctggtcaataagtgttttcagaagcctcactccatgccatcttgatcagcccctgccgctattttccatcatgccagctcttgaaatcttgtggatgtgccttgaattttttaagtgcttttctaacaaaagtcccgactgcagagatgcagaagcttaagttccatttcatttgcctcctgaaccttgagggcactggtttttatattgctgcctctgtccctcttagtcctcagtccccacacttctcaggatagctgaagagatgagtctgtgtttggctctgagttccagctccctggcagctatggattatatgttagcacaatccattttactcccccagctgtttactttcctggggacctgcttgagtcaggctgctcccgaactcccttaatgaagacatgacagtgggtggctggagacgagaagttgcaggagaagcgagaaggagagagagagtcccctgggttatatccctgttactcaacattgttgaattagatcctcaacattccatcatgtgatgtttggatgctgggaggggagttaaatatagaattcctccttttggcatttcagaaggtttatataatgtcctgttccttttgacagtggggagaaagtgaataggatggcttggaagatgggtctgtgtccggagctccatttaaagtctactcagcagcctgacccatctgcctactcaggggatgttcggtgaatcatgtttgcaaaggcacagatgcccttttgagcccaaagatctgctcagctcgaaaattctattaattctaagattctacaagtagccttcacaagagtggatgctgaaaatagatcagccacgtggtatgccctgaatttgcctggattactgatttgattttcccctcaatgtttccctgaacctggcctggaaattcagcttgctttaccatttgaaccctgccgtggagtcccagggaccagcgttccaagtctgcctctaycatttcccagccatgtaaccttgaatgagtctcttggcttttctgagtctcattgtctttagcatgtccccatacctatctctccttcttactttcttgtcttagtaaatgacctcattttccatctagctgttcaaactacaaacctacaagtcacctttgatttctctctccctcttacctgctatgtagaaaccatcagcaagggcttctagctctgcccttaacacagatccatgaaamatgcttctaccttcactgcaactccttatgaaatctgcattcagtgacagcagcatcttctaaactggtatcttcttccagctttgacatcctatgatcaatgcatgacctcgctggtcgagtgagtaagaacgatgacaaaacccatatcttgaatcacatgcatctttattaaaatcttcctccagctttccattttacctagaattaaartcaattgcttgctgtggcctagaaggagcaccataatctcctgcttatatctcagaccaaatcctgctctcttttcccttggtcctttatctttctggaacattcctcacactcacctttgcacmtgttgttccgtttgcttgggaatttcttcccctggacctttctgtggttgtcttgttctcaccattcaagtttcgtctcaaacattgctgactgtgacaggctgttcatgatcatccaagttcaagtagcctccactctagccattagcccattactcagcttcattttctcctatagcttagctctatctaagtattatatggttagtgttttgttttttttaatcaaactcctcccattaaagcatgtgtcctttgaaagcagggacattagtcatttctatatcttaagagagttatcaccagcctgggcaacacagagagactttgtctctactaaaaactaaaatgacttcaccaggtgtcatggcttacacctgcagtcccagctacataggaagctgaggtaggacgatcacttgagcccagaaatttgaggctgcagtgagctctgatcgtgccactgcattccagcctgggcaacagagcgagaccctgttttaaaaaagtaagtcacgcacgtagtaggtgcttaaaaaaaaaagtgatgcacatagtaggtgcttaataaatatctgttaaatgaataaagattggttacggggatgaaataagagcgtgctcaggtatgcacagacacactcatgcacatatgtgcattgaaactgccatggtaagaaatactattgttaatagctgggagccagaatttctatgactctccagttgcatcaggcctcccttgactgtattatgctcctaagaaacttttcttgccttttgttgaattaaaattctttaacttctcagctatctcatggatctttgcatctgttttgcatctgtttcttagcagcctagcttggckcatggtgctttatagagacatttagcatgtaaagatatttataaaggagggattctcttctatttttgcccagtcatctgttggagagagggggagcagcaagcaggcacacatgattcatgctcttgcctggagggtgctgcccacctctagcctagaagagtggggtggcaggagccctctgcattccaaggctggttccagtgaatggagcatctacagtggtggtttggccaatctcaacattctgtaatggcctcttctttacagttcacacttcccagataggttaatattacagctccttccatcagaatgtccttaagtgtgtagctgcaaagttgaggggtacagttcataaaacgatcatttctgacatcacttggaagattgagggctgccaagaccacccttatctttgataattcactggaaactcacaaaactcgctgcaagctgttgcacccacggctatggcttgttatagctgaaggatacagactaaaatcagccaaaagagggacacataggcagaatcatgaaaggtccaaccgtgagctgccagtggtgatcttcctayggaatcatggacagtgccaccttctcagcaacaacggatgaaaataagcatggrackttgccaacaagggaagctcactgagccttggcgtgcagagtcttttttggggtctgctgttgagttcttrtatgggtgaccttggcttccaggtcctctggaggttgagctcatgctatgtgattctaagcccccactctaaatcacactgttagactctctggtgtgacccaaggcccccacaagcaaaaaaacactcctatccaggcatgacattcccagggcttagtaagacaccaagggtaaagaccagacttctttttgggcgaggtttaattctttactatggaagagctcaacttgatactcttggtatggatgacttacgtagatagcggtggtgctggcccttttcttgcttccagtgcctgaattcatccatcaattccacaaatatttattgattgtgagctaggtgccaggctctgtgctagttsctagggatacagtggtgaaggacatagttcatgctataaaaaggctggggagacagataaacaggcaattattcttatatataaatataccatgatgctagaaatgatactaaaggctcttggtgcacaagggtgcctggcacagttgctggtgaagacrtcccagggcggtggtagttaggctaagattggaaaaatgattagaagttggccaaccagggtggagtatgggggtagggaggtagtgtttaggtggaggaatatcacatgcagaggttgagtggtgagaaagttcttgaggatggtaaggagctccacattttcatggatgccacagctcacaggtgattcatcttgaacatacagccaataaacacccaaagactttcccatcttgtaccaaggcaggtggatttttttttttttcaagactkaatctctgttgccaggctggagtgsagtggcacratctctgctcactgcaatctctacctcccaggttcaagcgtttctcccaaggcaagtggattttgaaatcaagaaaatgggkttcatgagagaaattcttggcccctgttgctgtcaggaaggcttttagactaaaaagaatggagctaatgaaagcagttggatagggcaagcgtatgagcattggctttcactggcttagggcagctccaactcccccagaaaaggctctttgtttatggtgaggtcaggacttcagagtgtgactcagaaggtcctcagagctggtaaaaagtgtagactggtgctgtaggccaaaagacaaggtttataaaagcagaaggatttctgagacatcttggacatgtgagcaggtgactcacagacgttctagaaaccatatttcaaagacaatatttttggcagaatcayatggttgctttgtggtcgtttcagggagttccagcaataacataaagaaaattaacagaaaccaacaaatggtagggaaaaacgttggtgatacgtgccaaagggttactatctttaacgcacaaagatgacttacaaattaagaaaaagacaaaacaccctaaaagaaaaatggaagagaaatgagtaacatgtgattagagaataaaaactcaatggctaatagatgcccaagaaaatagtaaaccctgccaatactgcaaaatatttgaaatacggtaatgaaactggctgggcactggctcttgcctctatttctagtgctttgggaggcagtggcaggagtgttgcttgaggccaggagtttgagaccagtctgggtaacatagcgagacccccctctctacaaaaaataatttttttaaatgagccaggtgtggtggtgcacgcctgtagtctgtttcttggaagcctgaggcaggaggatcacttgagcctaggaatttgaggctgcagtgagctctgattgtgccactgcattccagcctgggcgacagagcgagatcctatctcaaaaaaaaaawatawawawatataaagaaatccatcaactcacacaaaaatgttgttgatgggactttgcattattcttataattaagaaaagcaaaatgaaaattcagtaagcaaaacagtgcagttggaaggagctctaagcctccctacttcattctggtgaaggcagggagtcaggaaggagtctggggctcctcctgtctgtgtcctcattttgtctcccacctcctggcccccagttttcctgcaggtgtgagtgtgtcagacctccttctgctctgagtgggagagaactcgctgtactctagggagctgagtttggggaaagactggcccttaagcatcctcccacccagcctttacccccagctctctctccctgtaggacgcctgattttcttggcagaggaagaagctaccctccatccactttcccagggtaggcaaggcagcctcttcccctgggccatccagcctcctgtaggcctggggcttagcaaaacagccagggagggggagactcggaacagtctttttttttttttttttcctcccaccatgagcagtatgaggatgatgccttagctccattgctttgctctcagccttcagacttgctgtaggagaatctctgctgtaccctgtcatgtcttagatttgtgtaattgagggaggcctcccaggcaatttaagtagggatttacttattccttgggagtgctgagcttgtagtggaggaatggtctactcactagtgtatttactcgacttctcctaacaagggtctttccacttggggttgttctgtccagcatcccttgggacttccagggaaagccaaatattctttgctgcccctgcttcttcgacaataaatgcaaaaagtttgaaaaaatcccgtactggtgttgtgtcaccagggtcaaagaccttgaatctctagtaagaagtagaaggcgtcaagaggtcaagttctgactccatagtttcaggacattgtgggacttgattgctgcagtgtgaaatttatggttttgtaagacagatttaaaaccctttcatggcatcttgtagcctttggaataaaatncaacatcctcaccatggcctatgaagagaccctgcatgatttgggcactaggtgcttttttggggctttgtttgctgtcattttcctccttgttctttccaaccctaggggctttgtcctcatggttccctatgcctggaatgctcttcccactattctgcactggttgacgargacttcttcacaacttggcttttggggcatttcctttgagagggcttcstgacagtcctgctaaccttttccataggagccctcatgtcattagctgtaccacaactttaacttgtatgtgttcatttacatgtttctgtctcttctgtgaaatggttgctccttgagagtggggcctctgctctgtcttgtacaacacctgacacacgggccaacttataaatatcatgaatgaatgaatgaatggatagctctctagttatcaattgtgactgtatctttccctgccatctcccagctccgtctcacctggaccacctggaaaaacctcttgtaccccataatttcagtgcccctgtctgtatctgaggctatggaaaagctctctacccaagcaccaaggaatcctgcccttttccgcttgcccggataaacaaagagttatcaaggctaagttgccagttatgttggcttcttctcctgtttgctcttgggaggataggattttgattacaagcataacagcctccagttattgagcatctactgcatacagggcaggcactttgcatacatgatccctgatcttcatagtatccctacatggtaggttttattatcccaatgttgtaagtaagcaaacgaaggatctcacaggtcagtttgctccctgggccacctgacctgtgctcttttttccctatacatcgtggcctaggttttggaacacacaagggcacgcacacggcccttctcagactatgacaatatagtgcactgcaagacctcgcttttttaacaacctaagctgatgggttgagttgtgagagtcagaagcttgcaatttcacttcatctgtctctggagactattctggctttctactgcctggaaagaaggtgggaacaagggctctgtgagggatgattacaccagggcagaaacagctcacctcttgagtgctcatgtgccatacactgtgccgagtgatttatacatatagctttctgtaacccacggagcagctctatttgtactgttattttgagcactattctgcaaatgtggaagctgaggcacacagtaagaaagggtaaacagtggaggctggatgcaaacccaggtagtctgattacagagtttgaaagctcagccaycaggtacctaccaaccagctaaacagatctcatcattcaaagtgtggtccatgcaccagcagctttgacatcctctgggarcctgaatgyagaatctcaggtcccatccagactgaccgagctagaatctgcctcttaacaagatccctcggcgattcacgtgcatgttaaagtttgagaagaactgccccagaaattctatgaatataaagtaagtgccattttcctgaagtcaaaagctggagatttagagcatcagtgttcttagaaacaacgtgcgacttcagtatcttgcaaactatggcatcaacgaggagctgttcctttgcttgagggaattagtgatgacaaatgaatttagtattttcaacaaaaataaaagcaagttgagcttgcatagttgatccaaggctttaaaaaaaagaggctgcttcagcctgcaggatgttgttgacatagtattacatctaagtacgcagggagccccgagccagggttgctggagtgtccctattgcaagkgaagttttggcaaacacaatctagggattgaaaaggtaactccttcattagatctgcctggaatttacacatctgcaaatgtgagaggacaaaaaggacttttgatccaagagagatcggccccatctccctgtgctgggaaaaaactttgattttcttctttgatgtgaaacattgccattgctagctatatatttgatcatagtcactggacaacttattcagctctagttctttattaggtcctcatggctgctttcttagacatcggaatccttaaaaaagagaattttattttattttttaacctttcccagcttataaatgccccagggacctggaaatgtccacgtgggctttaccaatgatgtatgtcgttctgtttgagtcaaaataatgagtggttgcatagacgatgattgatattgtgtatttccgagtcgcctcattttggggaaggaatatgctgatcgtgcgtcaatttccctcaggttggctctccagcagggggcccaagaaggtctgcacccttttcatgtttctttgctgcttcctttcatcttgccaagttacatttagcaggatattcatctaattccttttttaaaattttaatgctccccattttttkggggggtkggggacaaaaagagccttttaggaaataagcatcaggaactaactaatcaaagygaaactttctgggagasatctgacagccgcatgcctctaatgaccttcaaaaagatcacrtgctccaggcaattacaggatttgggagaaaatagctcattctgaatagccgaacctgctgcaatgttcatcactttgcagccgtgcccctacctccccgcttttgtagcttccttaccccgaagcctcctgaaagagagttcacttggattaaaactcctccagctttaacaaactgcaaaggggacagctgatgctaaaaaaggggatcttgtgcacagtgccaggtttctcctgtagccagagtttttttggctctggctacagaaggtgcctaatacattctgactcatggccaaatattatcaggggactttgttggtcaagctcttgaatatgggtgcagctggaaaaataacctatttgtcaataggttaccagtttcacagctggtagtgcccagaakkgygctgaataaacttcagtgggatccctgctgcttggtgcttgaagttcatctgacgtgaagcctttgtgaaaagagtattcaggaacccagtagcaatcttttcctttattttaattagacnatgcttctctcttgtttgcagggttttttgagattttatgcaaacttttaatgtttttgcctgtcagtgtttccattatttgaaatctttcatattaagtaaaattagccacggccagtgctatattaaagtatcaaaacttttagcatttgctcaccctcctttcctgggragaacaggtttctctacacgattgcctgtatgctttgctatgagtcatagtttagagaaaacccccacgttcctgtgcaatgaaagaagcagcataatgatctcaactcaggcagaatggcctggaaastcacgatatgtggctgcacccagtcggtacctttgctttgcttgtgttggaggtctcttgcattagtgttgtgaaaatagatgatgagctcgtgcctctgtgactttgtttcttgagacctgcctgatttccatggtcacaagaacacagagaaagatgtgtgggctcccgggggctctgcctgacactgttgagagcgattccagaggagaaggtatctgtggggtaatctttggatgttattctgaaaagccccaacatcttcctcataacagcttctaagcttgaggaccaagagttatcctctaaaaaggtgtccccaaacaaggtaggtgactttcccccagtrtttccaggggtgtgagccaagacatggggcaaaatgattaggggacctcctgggtcttggaagtggtttaatccttcctgtagctcaatgtarctgtctgtggttgatgtcactcggagtcaggggtaggagtgtgtgtgatacagtgtagcagagatgccaatctttgtggttgccccrcccttcttgctgtggattgctgctttgaccaagagtgttggaccgatgaaagtatatccagtcctcagtctgaaatttgacgtctgtggctgggtttgaaaggatgagcttraatgtgggcttttgaattagaaatagaataggatttttcagttagcatcgtggatacaggggctgaaaagatgccacaatgagctgaagttaggaaggawcaggggacagctgtgggaggaggacagtgtggggatgactggaggggagtggaaataggggaccatggggcaggggagtggggagagaatatgaaggcttctggtagcaatctgcatgtgtccttacaataaacagtttctcttgaactaactggagtgggtctctttccttgaccatgcggaagacctaatataagaaaggaaacaaagagattgcaggtgtcttccagagagaagatctgttttcctgtgtgttttaatgtggagtctctttctggtctgcttacccactccttgccccctgcatccaccccccttgtatatttttcccttaatgaaaagaaaatagagatcattttaatacagaggtaaanttctagggcctccccagaaaactgtttcatgaatgaggaagctaagaaaaagggccactggctttaaagcccagtaggttaaataggagaayggagaaagttataaaatgattaattggtcaagttgggatgggaaccttaggttataatatcaagntttaaccttggcactatggacattttgagcaggagaattctttgctgtgggaggggctgttctgtgcattgtaagatatatagcaacatccctggactctacccactaaatgcaggtagcagtccatagttgtgacaacaaatgtctccagccatagacaaacatttcctggtggtaaaaatctcccccagttgmatgtaaatttgttcagccattgtggaaagcagtgtgatgattcctaaaagaacttaaaacagaattaycaatcaacccagcartctcattatggagtatatccccaaaggaatataaataattatataaagatatatgcatacatatgtattctgcagccctattcacaatagcaaatacatggaatccacctaaacgcccatcagtggtagactggataaagaaaatctggtacatatacagcatggagtactacacagccataaaaagaatgaactcatgtacttcacagcaacatggatggagccagaggccagtatccttagcaaactaacgcaggaacagaaaaccaaatactacatgttcttacttataagtgggagctaaacagtgcgaacacagggacatagggaggggaacaacagacaaatagttctaatcgagggcggagggtgggaggagggagaggataaaaaactacctgtcaggtactatgtgcatattacctgtgtgacaaaataatctgtaccaaatgtgggtaccaaatccctgtgacacacagtttacctatataacctgcacatgtacccctgaacctaaaatgaaagttaaaaaataatctttccctgttgagaaccatggggctagacaaaaagccgccttccttcctttcttgaatgaagcttttgtttgtttgaatctgctgtttatgaagggctgtggaggctacagagatgactaaggcacagtctcttacctgtatgaattaacagatttctggaaaatattaagctgatatttatttatcaatttattcatcaaataaagctggaaaataccttcctcttggctttgagtaacagcaaagatatccacctgtgtcaaatgggtaacgctcattctaagtgtaatgaggatctaacctgaggttcccacccaacttgattactttataactttctccatcttcctcctcctactgaactctgctgggttttaaagccaatgggctttttttnncttagcttcgtaattcaaaggataatggtagatgctataacaaataagccctcaaatatcagtggtataacatagtagaagtttgcttcctgctgatgtaatggtgttcctggttggtgaacagctttcctatggccatgcagtgattcagggacctagatttctgccatattgtggctcttccagtcccctaaatctcactgtcttttctttccaatcagcagaaaaataagtgaggagaaaacacgcccctttctnaagagtcctggcctgaatgtgactttgtttatgctgatcttccattagaaaggacaattggactactgatgatttccgatcaagtagaataaatcaatattgaatggctcatcttggctaaaattctgtgacagtctctggttatgaaaatttaccatcaggatcctgttcacataggacactttattcagcagtggggagagtttagcagaattctctttctgcacagtttaagatggagctgggaaaagaacccaagtttttagatacagcagtctntctgctacttgaatcttttcttctccgccataccaggactggaagacatagattgtgcccaatttctatatcctaattacctaccagaggattgggcatgtaaaatattttcagaggggatgaatggatgagaaatattgttcacaggcttagaggtatacactcaaggaagattttacttgttaacctgaaaattgcaaaacaggtgcttgtagagctgtacccacagcagtacattgatgtcgcaagtatcsgggcgggaaaaactacaattgctgcgtggggtggggtgggggtgaccatagttccctttattagccagagatataagtgacaggagtctaaatgagaacctgaagccaaacaggaacatttatttgatcaggtaactaaaaagttcagggtatctggcttccagcacggctgaatacagatatataacaatgtcttcgagaacgtcttcctgtacctgggctccgctttcctctgtcagactcagtctttggcagattctccttaagtgatggcaaagataacaccagccacaacagatgttcatccttcaacttggccacctcagaaggaagaggggctccagagaatgccccaagattatcattggctggtccagtgccatgtgctcatctctgcacccatcaccagggtctccctctcattgttcagaccaagtcacttgtgcaccattagcacaaggggtgcccagtccacagggataaaggggcaagcagggacaattcttcagtaaaaaactagaatggatgcttgatgaggaaagatattctatgtccactatatttctattgtcattatggaatgaacctgtgtattttttatcttaacactcatttccattcttctggtaattgtatgtaatcaatctctgttaagccctctccccagctgtagcccstgagctttttgtagagattcctcctggtgcagagatggagcatatggttcagtgctggaacaatgyggtcattatatgctcctggtccctgtgaacagttcggggatggttatctggtccaggaagacccagtgaggtgaaatgagactttacctcaaacttgagtaaaagagattcttttttcaaaattaactttttattatgatgattttccaaaatgcatgaaaatagaggtaactctaatcataagcagagataactctcctatactcaccatccagcttcagcatttatcaactcatggacaatcttaattcattttatygccacccacagtagattattttggagcaaattcccaacatcctatcatttcatctctatacttttcaatatgcgtctctaaagataagagctcctgggggaaaagacttggtattttctattaaaagtgaacctgaaaagatgtagggaataaaatcactgctaccatcttgcttccacttggagccaasaattggagccaacaactagagccaactgtgtggcagcagaacagcaagaaggaggaacacgaaatccagatgacagattttgggtcctgaattcacctgtgcatggagtaagcttagctactttttttttttttttcagtcacttgagctagaatattccctgtagctatgttgttgatgccccactcatatcctcttggcccaccctgagggtcacctgaagcttagatggacagttcccaacacagtgatggcttctcacctcaagcacaggcatctctctgcctaagaatgttctctggccatacgattgtgtttggctcctgcrtatggcagacctgaagtggcaggggataaataaatgccccccagaactgtctttaatgatgagggatagaagttggcataccctggcttctttgctgctcagggagacagtamtgaggtgtgtcctacactgttattggagggcccttgtggggttaaatccctgttatccccagaagtaaccttcccatgaatttccctgctgctggcttcttttcctttcctgtcttatttttctacttcctcaccacacttcctgtgatcacctyccaactaaaccatgtccccccagtttcttgctttagcatctgctctaaagtaaaacttaactgaagtaattcccctttgcttcattttgcttaagcttccatggttctatttcctttttaaaaatttctatttaattttaagttctgggatacatgtacagaacataggtttgttacctaggtagacatttgccatartggattgctgcacctctcaacctatcacctaggtattaagccccatatgcattagctatttatcctgatgctctcccttccccaccaccaacagactctggtgtgtgttcccctccctgtgtccatgtgttctcattgttcagctctcacttatgagtgagaacatgtggtttttggttttctgttcctgtgttggtttgttgaggatgatggcttccagcttcatccatgtccctgcaaaggacgtgatctcattcctttttatggctggatagtattccataatatgtatgtaccacattttctttatccagtctatcattgatgggcatttgggttaattccatgtctttgctattgtggatagtgctaaaataaacatacgtgtgcatgtatctttatgacggaatggtttatattcctttaagtatataccctgtaacgggattgctgggtcaaatggtatttctggttctagatcttagaagaatcactacactgtcttccacaatggttgaactaatttacattcccaccaaaagtgttcatggttctatttctggtcattcttaaaacaaaaaaaaagtcctgagtaattatgctccatatttccatccccagtatttgcttgagaaatgaaataatgaaggcttctgagaaacagtgtccccacgcccccataccccattcacacaaaatgttttcagcttgagaatacagttgcggaagccaagttgggtctcaggaatatctggtttgcactaaatttcacctgcagaattataaaattcaggtgctgttgccttgggcacaactgctgggctctgataagtagagtgggtgtcccagcagcctgtcctgttggttcagataatgatttatgggggggcgcaggccccagggtgtgcacatggatggatgctctgcttatcctcctccagataggtttctggcatctaagacaagagaggagtggggtcaacaaggagagcttctgtctcttcctgtttaagcatctctcctactacctacaaatgaaaacatacaaatactatgttgatggtatagcaagtaactttaaagaaggcccccagaaatacttcactaattggagaccagttctccagcattttgaaaccataaggaaattacaaagtaagctgaaaaaaaaaaacttagatcatgcaaaagagtggtcaacaaagtccatgtattctacacaaaggagagccgtcttaagactgtctctccaggctagtttacttttactttatacacaattgcaacagagcattgaaagcagcacattttaagcagggaaggaacatgcacagcaagggctgcaaactcaaaaaattaaatgaaccagagaataattttaaacaagtgaaagaggccagttgatggattaatgccatgtggggacgtgggtccagtgttgacagttcttccatgttttcaggaagaaactgaaaattggaattttaagtgaaataaccttagttttacatagaaaatatctaaacaaaaaatttttaaaacagcatgcagacctggcacatcgggggcgtgactttgccccattaaatgaagcataaattctctattttgccagtgttcctatttggctcatataggacactttaatttgtgattctttggttattagatcactagctttttaagcacaggctttgggctctgtttgccttcttgggaaatactgtcagaaatcagtgggttcataaccttttgaagaagtcactcttattttggttgagtgggcagtgttcttagctacccaaaacaaactagctattcacttcctgggatcgctgggaccggtgcctgcgggtttctggggacacagaagatacatcttcctcctccctctcctgtgtttacacaatctgctttgaaaggttatgattcttctgtgggcgactggcctacagcatctgcctgctttgcttgatttggttcatttcacccaggctggcatcttcgagtctggggtccttttggctttacccgcacataatctcttgggtggatcaaaacctcttcaactctctcttgagtttccaagcaggctcccctgtggggcttttctaagagtgtttagcattggcattgctgcagagcacagtctcactgtgtggttttatgaaggatttgttttttaaaatttattttctatttttgtgtctttagaggcagggtcttgctctgttgcccaggctggagtgcagtggcatgatcatagctcactgcagcgttgaactcaggctcaggcaatttttcttgcctcagcctccagagtagctggcactacaggcacacaccaccatgcatggctaattaaatctttttttttcttttttttttaagaacgagggtctttgttatccaggttggtcttgaactctgccctagccttctgagtagctgggattacatgtgtgagccaccatgcccaactaaggttaaaaatcttaagatgcccttcaagactctactcctcaaggtcatgaaatagtcttttaaatttgttaaaaataatgctgagtgtattttattttcaactcaataacgctgtcacacatattaaacaataatggcattttcccatttatttccttctgcatatatatgtgtgcattgatgtgcatgtgtatgtatgtatctgtatttatacaagtacataagatataaatatatccatacctatttgtaattgcacacaatttatacatgcagtagtgtataagctgcatgtttcacttactatcaaaatctctgtaagcataatttttatttattctgattatttaatacacagtgatgtaactgtgatcccaaaatgtgcaaagttaaagccttcaactgcagctgaggagagggcaggaatggtatatggggacggtggtgagtcacgaatgatgggcaggcggccatgagcagggcagcctcctccccggggccagggacaggggaatggcctaaggagccaggacccaagggtagcccaggaccggggaagggggcagagacctccncttggcctaggtcaggagctcagaagtgccacatggctgagggggcagcggcccgggaagagccagaggcagagccaggaaagcaccatttcctgggggggctgggggcagggaggtaccctacaggagaagccaggtggggcctcctgtccctggggtgggggccatgctggagcatgctgcagcaagaaagacctgaggcaggcgcagggcctgagagcctggctggctgggctggggggcgcccccaggcagcctggcccagggagcaggcccgactctgtaggggatgctcagcgaggggctgcagagccctcaggacctctcctcctctctccctggaaaggagctggggaacccgtagtgcaaatctgtggaccactcagttatggagagaggttgtgcccgaaggtggacactggggtatgctccctccaccacctcatcctccactgctatcctcagtacagctgcttctggtaagcgtgcaggccatggacgccaccctcgatctgggctgacatggtccacttctcaaatttgagctctyctgagtacatcatggagccatgctggttactcgctatgaggtagggcacaaacttctgaatggaccctttgtcctggatggaggccgagacaccctgcacaatattcaccttttccccctcgctgaagtatcgtttctggctgctgctgctcttctccatggcatctagcgagcccatgccccagtacttcttgagctgcaccctgtctgagaagaagtactcgcygctgggcctccgtggtggtggccagcagggagcccatcatcactgtggaggctccaagggccagggccttgaccacgtgccccacggtctggatgccacatcggctatgatggacacaccaaagtgctgagcgtacttggccaccttgtacacagcagtgccctggggctgaccgcaggccatcacttcctgggtgatgcagatagagctgyagcccataactacatgcagtccatccacaccagtgtcartcaggttcttagcctgggctgctgtcaccacattcctcccaatcacctggaggtggaggtacttctgtttgatgtaatgcaccatggtgatttgatacaccgagttcccttgggaggagtccaagactatgacgttgatgcctacccaggtgagcaggtccaggcagtatttktcatcctcatgggtgcccacagctgccctgcacagcagctgcttgtgggaatccttgraggccagaatgtagtctcgattcttcttcaggttggtgtgggagacgatggccactagctcatggcgatcattgaccaraggcagcttcccytgctaggctgaaggatctcatttgcctstttcaatgtcatgcctgctggagccaccatcagcttgatccttggcgtcatcacctcactgaggagggtggtgtggtccttctcagcaagaaagttgatgtctcgggaggagatgatgcccaccaacttgctscccatggtgcccatctcagtgatgaggatgcaagagaagccatgccggatcttggcctccagcacatcacccacagtgtgtgaggggctcagcaccacggggtccgtgatgaagccctgttcaaacttcttgaccttatgcacctcgttggcctggaactctggggtgcagttgtggtgaatgaaaccaatacctcccatcagagccatygcgatggccatgtcggcctctgtctcagtgtccataggggaagagatcagtggtgtcttcagcatgatcttccgggtcagggctgaagttaggtctacctcatcagctatgaaatctatgaaccatgggagaatcaggaagttgttgtgggtgcggcagttggcgccgaggaagagctgctgcacggtgagccagtcctggggcacgtagccggtgccgccactgatcagatggtncgccatgctgccgcaaggccccgcgaagcgacaaacacccgcgcggccgcctgccgctgctgccgctgctgctgacgctgtgggcctgggaactgtaagcataatttttaatgcccatagtggtggttatttaaccacttagtgttgggtgccttggtcattttcatggaaacttttgctaatataaatgccactgataaacatctctgtgcataaacctttatatttactgttattttctcagtatagattccttttagaaatggaattgaacaaatcccttgaaagcctccaaactgtctcatttcaatcagttcttttaagagctgaagtaagagtattcttagctccacttaattggtcgagctgatatactagctttttcttgatttttgtctgaagtaattaggttaagaaaagttagtttaacacatacatccctgaatagcagaaactgaatccaccacagatgtacttcttactcgtctgaagtcraatgtggatgtttgtattcagagggcggccctctgacaagtgacgattcaggggctcagctcctttcatcttttggttctgccaccttcaacatatggcttctaaggccactgacatcatctgtgttgagctgtgaaaggagtggagcctgggaagttttttatggactaaatattcccaggaggaaaacggagtaggatttatgatcacttatccagaacctgctacaagatttctccttatctcatacttgcagtctgtcagcaaatcctgttggttttatctttgaaatatcccttgacttacccacttttctcccttgcccatgcaccccccagtcctggctggcgccatcactcccctggatcactccaatagcttcctcattggtatctctcttccactttgcccccttgccacttgcttctccatattctgttaagaaatctttattaaaacaaacagttccacgacattccccaggtaaaaaccatgtaatagcgtccattagaatttattaaaaaatccaaactatttaccttgatgaggtcctgtgtgatctagccttgtctattctccagtctcatccattaccacgttcccctaactcgttaaatgctattccaaatggtttccattcaacttttcaaatttgccaagctctttcttaccctgtagcctctgcgtgtgccactccctttgcccagaactttcttgttgttcttcacttgacaggttatttctgtttttatttaaaattctttttatttaataacaatgagaacacatggacacaggaaggggaacatcacactctggggactgttgtggggtggggggatgggggagggatagcattaggagatatagctaatgctagatgacgagttaatggatgcagcacaccagcatggcacatgtatacatatgtaactaacctgcacattgtgcacatgtaccctaaaacttaaagtataataataataaaattaaaaaaaawtttattttttttgtgggtacatagtaggtgtatatatttatggggtacatgagatgttttaatacaggcatgcaatgtgaaataatcacatcatggaaaatgaggtctccatccccttgagcatttatcctttgtgttacaaacgatccaattatatattttttgttatttaaaaatgttcaattattgactatagtcaccctgttgtgctatttattaaatggtaggtcttattcattcttcctattttttttttttttgtaatctgattatttcttgttctttggatttcagcctaccttcatggtgtgaacgtacttggttataatgcattgccttttgttacatttttctatttgatctgctcatattttgtggggcacttttgcatgtatgtttgcgaggaaggttggtctagagtttccttataatggcttcctctggttttggaatcagggtaatactatcctcataacatgaattgggaagtattgccttctgaacactagtttctgaaataatttgtgtaggactcttttttttttttccttaaatgttttatagagtgcagcagagaagacatctgggcctgaagtttactttgtgggagggttttaaactatgggttcaatttctttaattgatacagggttggtgaaggtttctatttctttttgaaaaagctttggtaatttgtatctttccaggaatttgtccatttcatctaggttgtcaaatttataggcataagggttttttaatccttttaatatctgaaagtctgtagtaatgcaccagactttatttctgatagtctcttttcttcttgatcagtctacctaggtttatcaattttgtttttttttktttttttaaagagaatcagctttgggtttcattagttttctctgttatttcttaattagcttctcagcctaaatgttttctcagaaaggatgtttcctgaccattctacctaaggtggcttcacctttctcttgccttctcctctgattatttgttttctacctcaggtctatgtgtaattattttatgtgttatgtgctttttttgcttctatgttacttgcagataytgcagaatagtaataagtctgcctaacatggtaatgtgcttggtgaatttccaagaacatatatggtggtttccaagtatgctagcacagcagtatctatagtggttaagagactagggtctagagttggctcatctcagctttaaccccggctacatcgtacactaagtgtgtgaccctgaacacgtgtaaccgtgaacacaaattctgattccttctgagatgagggttgtgcaacatggcagctgtgatcaggaggcctggggtttgagttctggctctgttacctgtcagctgtgtgattcttgaggcaattacttctctgagacccaatgatatggtttggctgtgtccccactcaaatctcatcttgaattttaactcccacaattcccacatgttgtgggagggacccagtgggaggtaactgaatcatgggggtggatctttcttatgctgttctcacaatagtgaataaggtctcatgagatccaatggtttcaaaaagaggaattctcctgcacaagctctctgtctttgcctgctgccatccatgtaagacttgacttgcaccttcttgctttccaccatgattgtgaggccttcccagccatgtggaactgtaagtccattaaacctctttttcttcccagtttcagttatgtctttatcagcagcatgaaaatggactaatacactcaattttctcttctttaaaatgatttgatgcaaggagtacctaatcttgggattattgggaggaactggatgagacatacatgagtaggatctagcccagggttggccttttgcatatgaggcattccctcaaactgtactttcccagaacttcagctctccccaccagagggtaagcatcactgtagcaggcactttgcacgttttgtgcacctctgtacccncactgccttgatcagtgtggtcagacaggcactgaaaaatgcctgtgaaatggattcttctttttgttgcttatgaaatctgcaactgtgagttgagtgtcctgaagctcagcagggcaacgatggcttcaacaatctggcccttgcttgtctcaggtgagctgctcctttccctttcaggaatcttctaaactgctgggattcccagggggaggacgggacctttagggatcttgcaaaycccagcagaatatcagttttcttcacagaagcrtgtctaacttccttcagccctggtctgcaaattccagacatgaaactgtgctatttgctagcttggcctggcaggtatttattcaaaggctgcaggactccatgatagagagtagcaacagagccagcaggatcctgtaagtactcctcatgcaactacctgcagtggatttaaagtcagctcagggcagtttcaacaccagagttggaggaaagaggttgtgtgtacattgtcntctggggactgctgctgtttatgcctngtggtttcctttgggggagacagatccaccctgctttcctcatccatcttcctacatggatatatcttgttatctagtgctgaaatggcatggacacaggggctgggactagtgctgagatcttccgcttagctcttccaaatacagaaagaacttccctgtgtatggttaggattgaagtacatgtgcttggttcaacattccttcaatcagcaggaaatccagtcatcatcctagccctccatttcattctttgtcttgcttcatgatgtcccttaggggtaaagatttctgaattcaaagccagctgagctgggttcaaatctccacatgtccatttatgagatgaacatcatgtcttctgtctgattcatttgtcttagtttcttcctctgaaaatggaggtaatggcaatgtctattctggcatgttctcgggaggctgaaataacacccaggcttgctgcttattgcacagcccagcttccctgccttccttctctcccttcatgaatccctccatgtcctgctctacctgttgcctttctgttcataagagtattttgaattcctgccttattctccttttttctctagaagtgaaggagccaacttccccaaagtccgtggaatgccattttactttgttaggaaaaaaatcactttttcttatgtgcattctcatctatccattcaacagacgtcatcggagtgccttctgggggtcaggccacttccaggtaccagggattcagagacaaactagtcacgctccctatcttcaagggacttagaatcatccccagagaaggatgctgtgaacaacctcacgtgtgatggtgtggccactttggttgtactagagtggtgggatttgggagktttttcttatttttatttatttattgtaaatttttttaaattaaaacaattttaaatagagacagggtctcaatatattgcccaggttggtctcgaattcctggtctcaagcagtcctccctctcagtctcccaaagtgctaggattacagawgtgagccactgtgccagaccactttttcttatgtgtaaattaaaaaagaatttgaacaggaatgaaagataaaaagaaaaaaaaaaacacttccccaaacaaaaaaaaaaaactctttcacttataagaatggtcatcatcttggctatttcagatggggaagtacgcatgcctcatyttatccaagtttctcacagttctrtaagtcttttttcacacacagttccatacacaaaaggtrgctttgcaaaaaayttcttttaacatagctggcaggctatactgtacatatatctatacacatgtatgcatgtatgtgcwtatayatatacctttgcatatatatgtttatgcatacattttattttgctttatttaraattattatttttggagatagagtcttgccttgtcaccgaggctggcgtgcagtggcacgatcttagctgtctgcaacccccacctcctgggttcaagccattctcctgcctcagcctcccaagtagctgggattacgtgtgcgcaccaccatgcccagctaatttttgtatttttagcagagatggggtttcaccgtgttggccaggctgatctcaaactcctaacctcaggagatctgcccacctcaactcagcctccttaagcgctggaattacaagcatgaaccaccatgcccagccttatttagaatttcatagggaattcttatgttattaaaactaagggttataanggctnccaaatcgctgtcatatggctggtctcaaatgcatttaaacaccccctcccccattgattttttttttttacatggttttcttatgtttgaaaatttgtagtttctctattaaacattgggtcagctgattctactgcccaggagacccaggcaacacctcaaaagtccacaactctcttggccagatgtgactgttctatttcccagctcatttttctgtgtctgcagaaagacacagtgcaaactgttaaatttggaggtttttggcagcttcattaaagggcaaggattttcctctttgggggtgggcttyatgttttaatggtcgtggtcagcattgctgggtgaggatccttaggctttttgtcaggggttcagggccttctggcttccccaggcttctccaggcttctccggcttccrtctctagagaagactcgggatgaactctgaattcttctagaccccagctaccagttcggctccagacccagagtggcactgctttaatctyggcaaagaagactaaagacttttttgtgtaacgaattaaaagtttgcttcagncttcttttattttatgcctctgctgcactctcgtaacatttagcacctccccctgttgtcatatcatttatcatatcgtggagtttcaggtgtcttattttggttttcctgtcaatcttcctcctacactctgcgctcacaagggacatggaaacctgtcctgtttctcctcataccctgccgtcgactgcggcccctgcacacagtggggtytacgawgttsatgggagccaagggattgttgtactgattttttaaggctggatatttatttttcggtatsctttgcactttttgcctagggaatcaggactcagtacagaaacttgtctytgtcatgtgcgcaccctggagaatccaatcattggaaaaaataaaaatacacatagagaacaccattccttcccataaccacgtaaaattgtgctcgtgcaagctttccatatgcaagagtgcttttgatctaatcagatggaaagccagaagcagaggggaatgaatgtaacttacatactgattattaagtcattcattctagtagtatttattggactcctatgatattccttcttcaaactggtcctcctccagggcatggcaccaccatcctcccagatgcccaggctcaacttsttgctgccaccatttccctcacacccctcnccctgtgactacaccttctacatagtrttcatatccatccacttttctcttttctctgctggccagaatcctctaatcttttaccttgaaaggttcaataacagatgaatgaacagatgacagaatgaatacgtcgaatagtttcttcaaactggtttgtgttaagagaaatagcatttatatttttatttagtcctagagaaaaaataacaaccctttgcctctgcctactctcgttttcacagtcccttcacaaatattgtatcttcggttatgctcatgtgtgagttctgtattttaagaaggacattgataamctgagctygttaaaaggaacatgactaagggaggtacaggctgctggaagtggttcctgaataacatcaacaaaaggataaatgtttgcatttctgagagtggagagaaatgaggaagtgagaggggtgagtagattgctatacccaattatttgaagggctttcatcttgaacatagagcagatacattccatggtgctctagaatctaagggaagaagtagagcccatagagacaaaatctacctccaaaaagtatgtggaagagctatgagctggctaattaagtctagagttctgtcactggaggtagtcagcagagtaaacatgtcaggggcagggattccggcatacatatggactctcttgttttgtagattttctgaggttattaggacttctggcgatattcttatctatagataggtattgcttcagctgcctaaacccatatctccctgtacccccaaaacactcaagagccatagccataaaacttcaagaagatgaaatattttgggngttagtaatacccttgatggttagagttatatgtggctgagattcttcttgtatctattctggtctcatttaagatggctgaaatgattgatcactgcccttcagagactcatatattttctgctctgcaaaatgtctgcaaattgcatcccagcttgtgcaaggagagccactcccccatccccaagtgtgttgtttctttcagtgatggtgattcagaggctgtgatacatcggcttagctgttttgggtttcagctttctcatgactagatgtatgtntttggacaagtttacattttcccatatttactttctttgtccttaaaaaaaaagttgctgttgctgctgatagtatctattcctcatagttgcgagtgggtctcctattagagaaaataaaaggaattgctatattagtatctttccagctagtctttgagcttcttgatgtcaaggatcattcattcttttcgtcccagtgcctaccataggggatggcacagagcagacaatagatgcttgttaaatgatgcagcaaccgaggcatccactccatgtctgtgagtgggatacgtctctcagagcaagagtgccccagtgcaagagtgatctagaacagtggaggaagggaggataaatgtagtctttgattttggagagacctaagtttgaatcctagctctacctcttgctagctctgtggtcttagacaagttacctaacctctctgagcccatgttagtccattcttgtgttgctataaagaaacacccaaggcagcctggcatggtggtgcgtgcctgtaatcccagctacttgggaggctgaggcacaagaattgcttgaacctaggaggcgaaggttgcagtgagcagagatcacaacactgcactacagcctgggcaatagagtgagactctgtcccccccaataaaaaagaaaagaaaaaaaagaaaaaaagaagaaagaaatacccaacattaggtaatttgtaaagaagagaggtttaattggctcacggttctgcaggctatacaggaagcatggtgctggcttcagcttggcttctggtgaggcctcaggaggcttccaatcatggtggaaggtgaaaggggggtagcatatcgcatggtgaaagacagagcaagagagaaaggggatcrgtgccacactcttttaaacaaccaaatctcatgtgaactaagagcgagagctcactcattaccagggttatggtgctaggcygttcatgagggatctgcccccatgatctaatggcctcccgccaggccctacctccaacactggaggtgacatttcaacatgagtttggagggaacaaacacccaaaccatatcagaacctctgtgtccttattgaaatagttggtgaaaatagcaccaatgtctaggagttcgtgtgatgattagatgagctgattctgtaaaaaatacccctctcaatctacaaacatactcattgctccataaatactgctattactattatctctaggattaccaccatgttttcagcttttcctgtcacccttgcctacacaaaagtggctcgatgttctagaaattgagactaaactaaactttgaatagattttcccaaacctgccaaaatatcccccaaattatagcaataaccattccctcctagagtggggctatctctccagcggaagatctgaaggttgtgtgagggatgctttttctcttgtctccctctactttcttgtagcctgagatatatagcaatttccaaggcagggattggtaaagtagactgacagcccaggttttccttgctgggagattaggctcttgtcccaagtttataattggtatcccaaataatggattgagaggtgttggccagaggggagaagaactggcaacatcaccacctaaatgaccccagggattctggccaaaagcagygagcaatctttctcgaagccccaacatctgctgttgctcagaaagcttcctggcagtttgagccaacttaatcagactgttctcttccacggcgctcggaggttttcatcctttgggacaagagatagctctgagttacttaacttacctggttcttgtatacgcttcatgttgtggcttttagtttctnttctctccaaggtgagccagttggatcttccaggaaacagatgctgagatggagttaggggcacaagaagtttattgagagggcataagtacctgggaaaaaataaaatagggaaggcaggaagtagaattgtgcaagggagagcttcagaccaccatgcagaccagacagtctctgccaacctaacagaaagctttggagaagaggttgcccatgaaaggagccccatgttgggcagaagttgccnggccccatgtccccctcatgccctgtcactggctgaggactgctctggcagaatgtgacctcagntcaaaagyggaagtgaatcctgagggctctgaagccagaggatgtcagtaacctgcacccccagtggctgaatgacacattcttttttgaaggcagatcggatccaagtgtctcctccatggaagtcacacctggagaatcacaccttgaaaaacattggccagcacgtctgtgatggattaactccagtggttagggagcctggctgagtgccaccatctgggccattcaaatcagttttctccacaaatatttacttacactttctgggcgctaatcatcctggtgggagaactgattgttataaagtgaatccagcaggggggcactatgccttcaaataacataaagctgcacagatggagtgaacagtgtggacagacaatcatttaaaaagatgtgaactgaaaagcatcttacaagagttacaaagatcatcactataacaacgactatcgtttattgaatcatcaggatgtgccaggtgctttctacatgccatctcatttcactgggaggtgagtgggcttattactcccagtttacagatgaggaaatggaggtgcagaaagaagtaacttgaccaacatcagtcgaaatacatctccccatttccatcaccagctctgtgatccaacactcaacatctcttgccaggactaccaaaggtcttcgaattactctcctttgcacaagcatctttgcttcttgctcaaaatctatcctctctactgaagccagtgggatctttcaaaatgcaaacccgatcatgttgtttctctgctgaaaacggtttcatggcttcccgttgctatggtgataggaataaaatttgtctctgtggccttccaagcacttcatggctgacctcggctacctctggagccccacctctcacctgctccttgcaaaagtaatattggccttcttgcagttgccctcatgtccccccttcacctgtctgacatgggccctttgcacctgctgttcattctgctgatacttcttgactagtaaattgttttcatgtacttaaatagcactcgctacaatttgtgatgttgctttacttttgtgattattgactaactcctgcctccctgagctccctcaatgaagctccgtaagaatggagaattatccatcttcactgttatatccccagcactcggcacctcaggaacttcacggaatgagcagacgtttcagtactggtgtttggaataacaaacattctgacttcaataccatgttgaaaaagcagagttccttctatttgggagtgaaggagggtcctgaaggtatcttctaggaagtagcatttgaatctagcctttgaagtgagttanctttattctgtttctgactccagtaaacaagccagcaaatcaaacccttagagatggcaagactaccttaacagagcaggtgcagatctcttctgacccgtcctactctcagaggacagcagctccagatagtatcatccttgtgaaaaaccaccaacttccacattttctttgagccaggggaacactagttagctgaggaagggggtgcaagggagggagacaggatggcattctctttccttctctcagttatttgcttctcccagtgctgaatctaggcactccagagacagggccctgaattctgagctctggtgatttgcatttaattactaagaatgttttatttttctcttgtaaaattgtaatgctgcttgcagcattaaaaggagtttcttctggaatgaaaacaccaagcttttgagtaagtatcttttatgctgaacatggggagtcatccaaaatagggagttgattttcataatggttttgcagttactcataatgatgccctttgtaagcctttaaggtcaaggaaaaaaatcataggtcagatgcacaaggtatggggaatgttagaaatttctttgctgtgatctaaattcctctagatgagtggtttttttgagcattttctaaattatttttaacaactatttggagaacacaaactgaaataacccaaatcaatactagttttatttatttatttttccttttctaaaatttccataggtttttttttggggggggaggggggacagtwggtatttggttacatgagtagttcagtgatgatttctgagattttggtgcacccatcacccgagcagtatacatttaatccaatttgtagtcttttattcctcaccaccctttcccctgaatttccagcgtccattgtgtcattcttatgcctttgcattctcatagcttagctctcacttacaagtgagaacatacaatgtttggttctccattcctgagttactttacttagaataatagtcttcagttccattcaggttggtgcagatgccattaattcattcctttttaaggctgagttttattccatcgtgtatatatacataccacaatttgtttagccacttgtcgattaatgggcatttgggctgattccatatttttgcatttgtgaattgtgctgctgtaaacatgtgtgtgcaaatgtctttttggtataatgacttcttttcctctgggtagatacccagtagtgggattgctgtgccaaatggtagttctccttttagttatttaagctatctccacactgttttccatagtggttgtactagtttacattcccaccagcagtgcagaagtgtttccttttcaccacatccatgccaatgtctatttttttaattttttgattatggccattcttgcaggaataaagtggtattgcattgtggtttgatttgcatttccctgatcattactgatgttgagcatttgttcatatgtttgttggccatttgtacgtcttcttttgagaactatctgttcatgcccttagcccacttttgtttgggcttgctaatttgtttgctaattgtttttttttcttgctaatttgtttgagttccttgtagattctagatattagtcctttggatgtatggttgtgaagattttctcacactctgtgggttgtgtatttagtctgctgactgttcttttggctgtgcagaagctctttagtttaattaagtaccgcctatttgtctttgtttttgttgcatttgctttgggttcttggtcatgaaatctttgcctaatccaatgtctagaagggattttcccgtgttaccttctagaatttttatggttttaggtcttagatttaagtccttgatccaccttgagttgatttttgcttaaggtgagagatgaggatccactttagttctcctacatgttagatgaagggtcttaagaaagaaagtgcaggagggtcggatgcagtttagggatctgcccacatttatcagccatccctgtccccaccactgcccacctctggctcactaggatctaggatatgccaatagctgcagatttggttaggatccctttccagtccctgggtttcaggaaggcttagggaccaggaggaagagcaaaagtgttctctgccagcccctctaatgaaactgctgatccaatctcactggagactccattcctttcctgttgcttcatagatgagatcatggtaggatgcagtctccaagacaccaaaatgatatatgtagggtgaagatttcacagggaagaagcccgggtcctcattctctgttttccaacttcaaacatctctacgattatttgtttagtgtgtgctttaaaccacttgcattttaatttaagcacatttatttttaaaaagcaacttggcatcacagccagaaatggaaaaccagtatcacttcccacaaatagaaagtaagttgcaaaaatatataccacgaagaccaaacagctcagagactgctgcctaaggctcagagcctgaggcctgatctcgctgttaaaaagggagattagcgagtgttgtagggtgtttgggactttttccctgatgttttcagaagagttgaaacagacttgaaagggagcaacttttgcaccatgtgacttgatgttatttaattcagtctccttgtaccacctaaaaattatcacagctaacacccgtgctatagcctcacacctgggaaagggatctggtctttttcagtaaattgttaattccacattggttcttagtctcctgggcaggctcagagaatgtggcttgagagtgatggagaggacaggttagtctcaaggagttagttgtggttgtagcaggtctatgtgtgggggactgaccagtaggggaagtacaaggagaatggggtatgtggcacaggtaaggaggagggcagggaaatgagaccaccagcaagaaagaactgatagttagaacagtggagtaaaatccacactttcactgttgtgtctggactttgccccttggaagacatttgggaaaggtgatgtggggctggaagtctatgctgaccggccaagagagtaaaktgtgtgtgtgtgtgtgtgtgtgtgtgtgtgtgtgtgtgtgtgtgtgtgttttaccacaatttaaaaaaaattgaaaaagaagaacactattagttacctgagaatcaatatagaccatggttctcacactttagtgaacatcagaaaccccgagatgcctgattaaagcacaggttgccggtacaccaccgaagtgtcagattcagtaggtctgggtgaggcccaagaatctgcatttgttacaagtctccgggtggttaggtgctgctgctggttgggaactgctgtaaaccatttactttggtacccacaggtccagagaatgtcagaatgtcactatcctctgagtcccgtaggggctgtcaacctaggaggcacattagaatcacccaaggagcctaaaaaacaaacatagaaacaaaaacatggatgcctgggccctaaacccccagtgaatctgattttattagtctggggtggggcttgggctcatatgttttttaaactgtatatgcatttagatatattttctttttttaactttttatttcaggggtacatgtgcaggtttgttacacaggtaaacttgtgtcatgagtagatatattttcaagcttacagaaaagttgaaagaatagtagaaagaactcctatattctctttattcagattcaccagttgcttacattttgccctatttctttcacactttttttttgtaggaatatcactgaagtgatattgtgtccttcttggtgcattgtatcaagagatgatgtccgttggtcttgatattggtgatattaattttgactccgtggttaaggtagtatctgcagtctctactgtaaagttgctatttcctctttgtaattaacaagtaacttgtagggagttctgatgctgggttctgatgcttcctgcttagaaacctgcactaggaagacgggatacactttcaatgtagctcctatattattaggcagatacattgagactatataaatatcctattccttatcatgtttttactcaccagctttagcatccattgatgttttctaactccatcattccttctctttactagtgttctgctataaggaagaacatttatttttacttttatactttatattagcatgggctcaagattcttaattttacagtgggttataatccattactgtcgttatttatatttatgcttaaattgtctcagattttatcggtcagcacctcaacctggctcttgtattcttttgacacattcttgtcttagtgagctcaggcttccatgacaaaatatcatagactgggtgtcttaaacaacaaaaatttatttttttcatggttctaaaagctggaagtccaagatcagggagctggcgtggttgggtttgagtaagggctctcttactggtttgcagacagctgtcttctctctgtgtgctcatatggccttttctcagtgcatgctggtggagagagagagagagagaaatctctcttcttcctctacttacaagttcaccagtcctatcaaactggggtcctactcttatgacctcatttaaccttagttacctcctaaaagccctatctccaaatatagtcaatggcaggttaaggcttcaatatatgaatttgtaggggacaaaattccatccctagaagtcctcattttttttttttttttttttttttggtgcacattcccttactttctggaacaataagatgctcttggttcattttatacttttcctgcttcaaccctggaatcagcaatcagtcatttctccaagggtctgggttcctcttttaaaaaatgctttctgggccaggcacagtggctcatgcctataatcccagcactttgggaggttgaggcgggcagatmactggaggtaaggagtttgagaccagcctggccaacgtggtgaaaccctgtctctactaaaaatacaaaaatcagccaggcattgtggtgggtgcctgtactcccagctactcaggaggctgaggcaggagaatcgcttgaacccaagaggtggaggttgcagtgagctgagattgtgccattgcaccccagcctgggcaataagagcgagattccatctcaaaaaaaaaaaactgttttcttggtgagaataatatgcagtcagaactgagaactagagttctaaaaaaatcccctcatgtatacccacattctatagatgaagaagctgttattaagagatagggaatgaccagctcaaagtcacacagcaggcgagtggcagaactgagcctgtaactctcacctttcctcagtccagcactttttaaaaattacagcctcctgagccctcaccattttgtttgcaagtgtcttgttgattmactccattacagatttaggacattataaccagggacccagtcattttccttattggtatctcctctgtacacgtggcttagtgctgagcagagagtaactgctccatgaaaccttggggcctcagattatttttctgacagccaggttctgatgcttcctgtttagaaacctggagtaggaggacaggagacatgggtttcactgtagctcctatattcactcactgggtgatgcatcagttctctttgggtttcattctcattgatacaaggagagaaaccacactacgtgggctctctggtgatgtcttgggcagagtttcccagacaatctcttccctacggtcttagacaccctgggcaaaagccaaaaccggcacactggcacgtctccctcacgtaattggccaaactaagtcacgtgatcaaactcaaagtcaagaggtgaggaactgtatcctggttcttaagtggcagggaccacagaatcacgtgacagtgacatgtttccagtaagagatgaagaattgggccagttgtgcaatcatgcaatctactgcaaaaggttttttgtttttttttttcactttgttgcccgggtattccctaaaacacccagagactstagctcttaaatataaggctgattaaagctgatcgatgccacctgactataatactgtcacttgagtgaaggtgccaatgctacgcagcaaatgtaggagagatgctgtagattaactgtatgtttttagaagctatggaggcccagcccctcctacaagtcagggctgaacctagtggtctagtaagatggggaggcctgatgagaagcaggacacacacctgggatgtgcctatgatgattgagatcttctgacagaggctgctccttttggagctaggcaagataaaatgacacaatttcctttgggacctgcaggctgcaagagcaatggtacctaccccatctgttattatgacatacggaccctgcctgcagtgctgagcaactgtgactctgagccccacttgctcttctttcttctgggtttcagaaaggttggccgggcgtggggctcatgcctgtaatcagagcactttgggaggctgaggcgggtggatcacttgagccaggagtttgaggccagcctggccaacatggcgaaaccccacctctactaaaaatacaaaaagttagccaggcatggtggtgggtgcctgtaatcccagctacttgggaggctgaggcaggagaattgcttgaacccaggaggcagaggctgcagtgagccaagattgtggcattgcactccagcctgttaaaaaaaaaaaaaaaagcaacttttcatgctgccttttaccttatcttttatgtataccttgagatttaatgcctctgagtacatgagatggagggcttaagagaagggacttgagttaccgtttagtttgaatcccgtctctactagcttgctgtgtgatcttggacaagtcacttaacccatctgtgctctagtttrcttatttgttaaaagggayaaaatagaactgacctcatagagttgttatgagcattaaattagttaatatattttatatgtttgaaacagggcatgtcacatagtaaggagtctataagagttacttattataaaaggcaaaatcattgagagaaaaaaataatgcttaattttccttctattcttgagaagagagaaattcaaactcttgaagacaccctgatctctttccactgcaccctcagacctctggaggcaaaggaggtgatgctgtcccctgtattccgactgctaacgtgggaagacctcacacaacattgcatgtctgctgaaatgttaatttataattcagtgtagagactgattttccttggactgtaagaagactccttttctagaacagaaaagatgaaaagtatgtgcatgtaattatggtgtttatgccactctaaaaaaattattcctaaatrttgtttgggtagaattatttagagaatgaggctagaaccattccaatcccaaagactcctcatttgactaaactcttctattctttgttgaaaggactagactggaggtatatcaaggcatgcagatgactaaactattgtgtgggctgttagaggattaattattttaatacctttattgatatataatttacttatcataaaatgcactcattgtaaatacataatccaatgatttttaaagtaaagttacagattttgcaaccatcaccccaaataaattttagaacattttcaccagccctaaaaaaattatctcaggcctgtcaatcattgctcctaaccccagccccaagcaagcactgatccactttctgtctctatagattttccttttctggaaatttaatgtaaatggaatcatacaatatatagtctcttgagtctggcttctttcacttagcataatgtctttgaggttaattcatgttgtcacatgtatcagtgttttctacatttctatttccaaataacattccattatctggatatataacattttgtttattttttatttttttgagatggggcctattccccaggctgtggctcactgcagcctctgcctccgaggctcaagcaatcctcccacctcagcctcacgagtagctgggactacaggtatacactaccacacccagctaattttgtgtgtttgtgtgtgtgtgtgtgtgtgtgtgtgtgtgtgtgtatacacacacatacatacgtatttggtagagatggggtttccatgttgcccaggttgatctcaaactcctggctcaagtgatcacctacctcagcctccaaagttatagatgtgatccactgcgcccagccaacattttgtttatttaccagctcatgggtatttgggttatttctacttcttgtctgttagggataatactcctgtgaatatctatatgccagtctgtgtggatgtatatcttaatttctcttgggttgatacctataagtggaattgctgggccatatagtaagtttacgttttaagtttttaaaaaattgccaaactgttttcacaggtagttgcaccatatcacattgccatcagcaatgtacaagggtttcagtttctgtgaatccttgccaacacttggtgttgtccatattttccattatagtcattctagtgtgtatatggaagtggaatctcattgtggttttaatgttcatttccataatgactaatgatgtttaactccttttcatttcttattggccatgtgtatttcatctttgatgaaataactattgagtatagagttttttagctcatcttatttttgagctgtttgttttattattgagttgtaggagttctttatatatttttgatacagttctttatcatatgtatgatttgcaaatgttttctcctagtctggcttgtctttttattcttaatggtgtctttggagtgcaaaagttttaaattttaatggagatgaatttgcctattttttcatttatgtctagtaaaagaataatgaatggttttgtgtctaagagctttcygcttaacccaaggacatgatggttttctctaatttttttttcaaggagccttatagttttagttgttatatttaggtctaagatctattttgagttaatttttgtgtggtttggagataaggatttaagttcactttttcacatattgatatcaaattttcccagcatcatgtgttgaaaagactatctttttcctatcaaattatcctgtcatgtttgtcaaaaatcaattgacagtgtcagagcttatttctaaacgttcagttttgttccagtgatttgtctctttcccttaataccacactctcttgatttytgtagctttgtaatatgtttgaaatgagggtaatgtaagtccttcaccattgtttttctatttcaaaattattttgcctgggtctattttttttttggctactggaaacccctccctcttgggtctgacagggttggagatagatatggtaaaatagagtataggggacagagaccagtagactgtgtcttggtcaccgttgtgtctttagcacctcatataatgcctggtaggtcctaaatactaaaaaagctgtaaaataaatggataaatgtatcttaagatttttttttatcacatggtatcatctatgtcttgggattagggaaaatttccatgtcaaactaaagagtaaaaattcaccaaggttttgatatgctctgatatgatcactactacttgarcctccccctcatcggttttatttcccacccatcatagctcctggaggaggatggaattaatttcaaggggatttgggaagtaattgtcttgttgttagttataaatttttgagagatgatggaaccttatcaagayagcttgctgttgaaatcttatagtttcccgtttagacctctgttattattatctgattatttgattattattatcaagggttttatatgtctaacagtgttagatattgagaggaccttcctacatgttgcctcttctgtctgaaacagagcccctcaaccctcccggaaagaagcacacataccccaaactctctcataattcttagacattctccagacctcaacctcatcattactccttagaaaaatcgttcctaaaccataacctgtatcaactgccctcctggaacccaccatatgcttctcgttggtaacacttatggtggttacatatttaacattcattgttgtgcttattttataaagctttgaggtatagttgacatacaaaaaattgcacatatttactgtaaacgtttcaatgaatctagacatatgcatacatctgtgataccatcaccaaaatcaaggagtactgaatatatctttaacctccagggtatgtgattaatgtatatttctcctcggggatcatcngcttcgtaggggcaggaactgtattagttttcactcaccgttttgtccctattgattactacagtagttgacaaagtacaactaacattttaccgagcacttactttgtgccaggcattatttaaatgctatggatatattaatatacttaataactacagtggcctcttgggttgttcttattgtcatcccattttttagataaaaaaactgaggcatgaggagagacattatgtaacttgctcaacgtcatacagacaatatgtaatggggcatagagaagggtgtcaataattatttgttaaacaaatgaatggatgaataagagaaagaaagggtgaatgaagctcttcccttgatcctagttggaagcatgtcctctacaagagtgctgacttatcttttcttgcgagatggatgggaatacaaggctatggggatgcccaggagactgttttggactccagtgctgctgactctggagagaggaaaaggtgggggttgggatagtctaggaaatgctggcttcgcacaacacagccgagtgggtgggagccaaaaatagccagtcctttgagtagaaactcctctagggaggaaacwtttctttgaaattggacacacaaattagctaatgatatccagacactaaagaactgcatgttccccagacagcccgcggccccaggatcagacgctgatcttgtggagcacagattaagagatgccgcaggtctygggtgggtatagattgttgtgtctgccatcctcactcacagccctgagcacagaggtgaggacgcagccaggggccagcactctccttccatgtgtgccaatccctgcctccctgtatgtcctgggctgtttgtccaggatggaaagtggcactgtggcatttttacctgtttgtgctcagtgacagttgacatgacacagagtctatgttggcagtatttccaggccgaagcttaggaaatcgactttaggatgaatttttcaatctgggagactctaacagaggctctgagcctgggatgtgcaaactacctgcacttatcttcaaaattgtgtccaaatgtgcgtttctcaagggagagggtccaaaggtttcatgagtaaacaacaacaaaagctttcaacaaggtatgggatgtctccaaaagggtgagaayccatgatgatgatactgataatagcaataataaagtaacttttctgagtgcttagaatttgctaaggccaggcgtggtggctcacacctgtaatcctagcactttgggaggccgaggtgggcagattgcttgagcccaggagttcgagaccagcctgggcaacgtggtgaaacccwgtctcaaaaaaaaaaaaaaaaaaaaaattagctgggcatggtggtgcatgcctatagtcccagctacttggaaagctgaggtgggaggatcacttgagcccmgatggaggctgcaatgagctgagatcatgctactgcactccagcctgggtcgcagagtaagaccctgttccccaaccctgcccaaaaataaataaaaaagaaaatgccagatatgcattaagtctcttatatagatgatataatttaactgttgtatcagtcagtttaagcaggttcatgctacagtaataagctactgagattttggagttgtttatgaaagttgatttcttgttccagttatatgaggttagttgcagctctgcttcatgtcttagatgcaagagtcagactgacggagggctcctttctaggtcattgctaatctcatggaagagggaaaagagaaggatgtagatgaagagatggatcttaaagattctcctgsaagtggcactgtcactcccacttacattccgctggctcccagcccaacattggcgaggattccaattgtccagtagggaggagtcctgtagagaggagggacagcagatatttgaacaataacataatctattacattccttataaaaaccaatgcggtagatatagtagtgattattatcattgtccctttcttacagatgtggaaactgaggctcagagaggttaactttctccccagtgctgtgtatttattaagtgagaggttcaagatttgcatggacttggtcagactctcgagcctacagctttagccactgcattcatcgacttccattgttatagcaggagcttctcctccactccttgttcctcctccccaattcatggtaatccacacacaccagttttcttaaaacttcattcatgctcaagagaaaaccatgtccctatctggatcctgtgtttgcatagtccccagcctctgggctcattctggatcatccagctaggtaggcatttgtttggcaggattcctgcccactaagagcttaccatgagtgtcatggtgggaatgagctgggtatttttagagctyggcagcctagcactgcsgcttgctcttccccgaggtctgtggattagcctaggggtagcatatgcctacgctttgcttgcctggtcctggtacatggtcctgtgtactgttaagaaaacagattgtcccaggtagatatgtagccagatatttttttctctgtttcctttttttttttttttttttttggagctgctccaccccctggtatggtgcagcttctcctggggctcctctgtaaytttacagcagcttctgagctagtgaagaaggcgggatttgctcacttgcagttaagtctggccagacagctgttagttgttgccacaaacatcttatgtgtttgcaatcttgcctgtcctcctgggtaggcagaatgcacaatctctcctcaggggaagtgagaagatctagaaggcccaaggaanaattatttttggcatcattgctcctccatactcattatccacatctgttgagcattcctgtggcccagaagctgatggcagtgtcactgtggcaccctagctttgatgtacttattgtcagaagctctggatagggaccaccaacaatgcactttgctgcataggtgctgtgagtctccatgggaaggaaagctggagatttgcataaaaaagtatttagaatgtccagaagcacaaactcaggtgtcatccaattcaacaaacactttctgagtgcctactgtgtgcaggacataggattttgcttcatgtagaggttataacattcaagaggacacccgtggagcacacaggcacatcccccaatatggccccaggcattacagaatgtgacagacgtgacattttttgtttgttaattaactaattcattctagtgttgtggttaagcgcataaactttggggccagactggttggtttgaatcctagaaataaaaataaaatcctaaaccaccccaactaattaaatggaaccccttcttggccagggggatcccagagaaaccttgaaaactgagttcctagcyataaccagacaggagctcagacttaccacattatatcctctcccttgctaaccatcatttggctttctttcctaagggttaaacagaaacaggccatctcaaaagacttgttccatcactgtttccaaccaaccacctgactctgcccctcgctttatacaggtttgacacggccaaccaagcaacattccttcctgataagatttgcacacccagaactagcttctgtttgcatgaagtggttctggtcagtttacgggggctgcacactgagtgccttcatgtcctctaattcaccttttgacacatggggccaaattatagtatacttaaatgttatgttttcaccccaaaatgaacatggcatgtatatgacattcatattaatttactgtgcatttgcgtgcccttcttttgtgaatattcatagctcctcctataacttgagtatgtatacttagccattctgttagcataaattcctgtctcaccttgcctcctttgaagtgcctgcctctggtttctgctggatgctacactccccagcctgcgagatggtcagcttacaggctgcaaccccttataagaaataaagctctcctttctagatgcatgaacctcgtgtttcttcagttgacaaatccttactctgtaactcactggctatataactgaacaagtgaccaaaactctccctgccaagcttctttcttcccaatatgggaatgacaacagtacctagctcagggagttgttgcagggattatatgagttaatatacataaggcccttggaatggttcctggtgcataggaaattgtatcaaagtgttggctgctactaacactattatcatttatgcaatagatatttattgatctatgtgtcagtagactgttgtctactatgtatcaggcactgacctaggtcccagttgtggaacattaagctcactccatatccttttacccttacggagcttgcatttcagaggttggaggcagaaaataaataaataaataaataaataaagtgtcaggtggtgattaagacatgaatgaaaaatcatactagaaaagtcagatgagggagattaattcctaattgagcaaagatgatgaaaaacttccccagaggagatgacaccagctgagaagaggcatggtagtaagaggcaggcacccaacatgcaattccaaaatgagattttgctagagaatgggaatatccttcttgggggtcatattgttacatctttctttttcttgccgcctatgaacaggaattctaaataaggtcagagactggggttgtcttttggtcttagtggccttggtgttggaccccaggttccaggaagtcttttatcccagcagcagtttttcggagagaagactcacttanatgcaagactgacatgaaaaggggtttgctctgtatgaggctgtgagctcagccccatgcttaaagtgctgagtgggaaaaagggcagagactatgcctgttttgtattcaaggggctggcacaacatttggttcttagtaggtgctcagtaaagaatataaatagtcattgagtgtttactgtgtgctgaagacatgtcaccaggttctaagcctttgatatttgtcaacttatttaatttttacaactgaatgccttttgttgttgttgttagacagggtctcactctgttgtccaggctggagtgcagtggcatgatctcggctcactgctgccttgacctcctgggtccaggcgaccctccttcttcaacccccaagtagctgggattataggcatgtgccccatgcctggctcatatttgtatttttttgtagagacagggtttcaccatgttggccaggctgatcttaaactcctgagctttagtgatccacctgccttggcctcccaaagttctgggactacaggcatgagccaccacactcagccctgaatgcctatttttgtccctgttgaaaagatgaggaaactgagcacaggccatgctggggctatctaaggactcttcatagaaagaattcaagaagacttcttagagaaggtgactttataaagcatgtcttgaaagataaattcgtcaggtaggagagtaggggtggggggtgaggtgcagaaaagaacattgtaaagagaagcagctctatgagcgtgtttggtaagttcagtccaggatgcagacaggagtagcaggggaagagggtagagagaggtcagggtgaaagcacgtgggcctcataggccttactcagtgatttagatctttatcttgactgcatcaggtagctatacaagtaattcctgaaaaggaaatgtcctgagatcaaactggctttactcaaaggtcaccatttaaacccagccatgcacagtttagcacttcattaaatattgtgtcctaatggttgctcccttctcccaggggccacacacgtcttctcatgtacataagcactcgtggagtctgcggttggaagaaatcacgcaaggactggttgtgccttgcacacctgtcacagatttgcacacccagaactagctcctgtttgcattgtctctactgtagcttctgcaaatgacaaatgtgggggtttcttcttggatgaagtggtttgaggtttgaggtttgagacttggatgttttctttgaaaattttttatttttttatgtttttgcaaagagaaacttgttcctcttcctatgctcactgagtcctcttttccctaacttctagaggaagtgcatttaatcatgctgtgatcaagtcagccctgggtacccatgttggcttttaattttaaaaaagagaatgacaggaaaagaaaatgggccagttaggttttgaagatttttctattttattattattaaaggaagcccatgtgggagaatgtctggtgctagtttctcatctcggcactgacatcatcactatcttgactgctgtaggtattatttgttcttggcttgtgtatcagctatctattgctgtgtaacaaccgaccaccaacttagcaggtgacacccatttattatctcatgggaaatgaggaggccactcaaagaggcctccttcttcaaaaccagtgatggagagtggaggagggctctgctgcttccagtctctgagcacagggaaggtttaagccttcttttaaagggctcatctgatgaggccaggcccaccttgggtaatctcccttttgattaactcaaagtcagctgattagggaacttaatgatatcttcaaaatcttgtcacttttaccatatgatgtaacataatcacagaagcgatgtcctatcatattcacaggttcacctgtactcaaggggaggagatcacacaaggacatgggtcattggtggtcatcttagaattttgcctactgtggctggtaatccaaaccaaatattcttcctgtggattaagactatcactttgggaacatcttagaattctgcctgctgtggstggtaatccaaatcaaatattcttcctgatctttgtgttaagactancacttttggaacagccattttccaaagctctctcataattccatcktaggcagagatggagtgtggccatacaatgttttggaggctccaaatctaggtaaagtggaaccactggagacagagtgccatcttgtttctggagtcaggcaaagacactgtgtccaggtgggatttgcttggagctgatttctctgttggataaaatagaccagtggcttcataaccctatgaaaaaataagggttctataagttgacacattttggaagtggagctaaacccaaggctgactccaggactacaactatttctacttggagcccttgagcttatttttccagtacataggtctcagctnancaatctgaaaatggagagtagggacatagggccttggaggttcctacttattttaatcagttccatagcctgaccctggtccagtgagcatcagatttggagactgtgccatttatgaaacaggcaggtattggagagactccaaaaagctngtctcatgtgtgcttccctgcaaaaacagccagttccagctagaaactttatcttcatgaaaggaaacctctaggcagagagaagttctatttgtttttacaactntccccagttgtatttgaagatggcaaaatgttgggcttaaggcctgccctgggttcatggagctagctttcttaatgcctcaatcatacttttaatcagaaaaaatttagagcattaatcttcagtgcttgttcttgccatttccagccactngacactttttcataaacaaagtgacagtttgattgaatgtggtttttaattaagctgccttcacttggaacaactttctgggggcatatgtaaggagcagaacttagaagcacaagctgagactgacttcgcaatagcttcatctccaggcagagtttgagaacaaaggaaaccaggcaagtggaattaaccaggcaccttaatccagggcatcagctcccactccatcctagctggctgtcccttagaataagtgtgggaaggcrtagcagtgagtgcagttgcctcatgctaacctcaggacgaagcatgtaagagcctcggaaattgccccatggtagatatttatattaacgacatttgacctgtttatggcatgtcactctcttctgcagttgggactctgcaaacacaaaaggcaaaaagaccactctgattctgccctcaggtacaactcagaattgtatgagcaacagtggattctgcagtacaagatctcagagtctaacagggaggcgaagatattcactggggcagaacattngagacgggaatgaaggaatgggctacctgagcttggagggtggagatgtggctgggaaacactttgaaagcccttcaaaggctgttcaagtataatygggacagtcatatgacagggctgggcctccttgaggtgggtgtttggatggtaagagggtcccaggcattgtcatctggctgcaatacaaggatctgcaatacaaggtgagggtgatattgctttaagtagcgctcatctgtactccatcgctccctttgtgttctgtggtgtatagatctaccctgataaatagctgctgccgtggagaaatccatcaagccttcagcctctgcatgactcatttccctgtggcaggcgtgttgctcggcttccaagaatagcctagcctgagggatccaagctcggaatcccttccaactttctgggctctgaagtttggcacccacagaggtctatgcttaggtaacggggtgcagatggcttgtcgtttgcagagacagtggctaataaccatctcccttccaccttckctttctgcaaaagcccagggcctggcagagtcacattgcttgcaaaggaagcctaatcataaaaaggtgccttttggtggcttaaagataaggtaatcaggaaacccattcattgatttatttgctcattcaacaaatatttgatgactgccttgggagtgagaaccacagcaagaaacttaacaggggaccttacagaggcaaatcagatctcagtgctaagccctgaatatactctgctgttgtggcaaccaggcagggagatgataagaacagtaattggcatttattaagcacttactgtatgtggtgtattaagtactttacatgaatcaatttgattaatatgcacaaaagtgccatcaattcagttccatgatcattcttatttgctcgctgagagcagcattgcacagagggtaacttgctcattctcatacaaagtgctcatgcaattcttcatacaggaattgcacccagggttctctgatacaagcacataaaaatcacactgattacaccattgcgttatcatagcaaccttctttctgtcgcttcttcccagcctgtgccaagctctttcctgctttcttagtctgtttgggctgctatagcaaaatgtcataaactgggtagcttgtaagcaacaaacatctatttcttatagttctgtaggctgcttaagtccagggtcaaggcaccagaagattcatgtctggtgagggcctgcttcctttttcatagatgnctgtcatcattttgttttgttcttcattggtaatggaaggggccgttgatctctctggagcctcttttatcagggcatgaatatcatttatgagggcttggccctcatgacctaatcacctcccaagggccctacctcctaacaccatcacattgaggattaggttttaacatctgaattttggagggatacagacattcagaccatagtgcctaccccatgggcttagcgttttcctctgcctgaaacatggctgcattgtctccatctcattcttcaggtctccccttaaaggccaactccttaagaggccttccctgactacccagtcagttctctcctattattctctagcttgcactttatttctttcacagcctttatcatactgtgacattaccattttttttggttgttattrtccatatgcccctctcctccaktccctactagaaattaagctcccaaaggcacaggccttgtgtatcttatttgtgctaagatggtgcctgacacctagtgagtcctcagtgagtgtggtatgggtggttggaggaaggagctcggaccttcagtcctcacagatgcacaacaaatctcaggtgttgttgcatggctgtttgaatgaatggagctatgagcataaggctgtattgttattgttgtcactgtcatgatcatggctggtgaaaaacagaaagacactggggattcagaatgcacaacartgtttgcaattgcaatgcagagacggtgatgtggcaggcagtcagtcagycagtcagtcagcrtgctccctttccgggatctgccagtggagtgcactgtgccccatggatgggcttcggagggggtagtggtgacatcagctccccagcagcttctcacctctcttggcctgaagggggctgtgccctttgtttcactgcagctgctgcagacagagaaaggaggagattcccagcctcgagkttgcctcgcagggcagtagcaaccgagggcagagcacagaggagcagctgcattctccatggggacatgactacgtggcctggcttctccttcccccaggggctgggggcctgccaggtgctctgaggattccctattgctcttatctccttccctcctgcatctcaatttgcctccccctggactctgcttttccccccttgtcttgcctaatctgccacaaggacatgctggaaagaggactttctgtgttctagaacattctacatgtgtggctcctgagtctcactttgtccacctgtgaagtgggcattatacccaccgagagtgtggtcacgaggaacagacgaggctgtcatttccccagcacggttccaggcacttggctggtaaagctctgtggtgtttgttcatcacactggaccacagagcaacagtgtctcacatgttatgaagatgtttcaatccgtggactaagcacttcattattgttgttgtcattattattactaacattttctaatttaacagctttattgaggcattgacatgcaataaaccgcacagctggatgagtgctgatgtaggcatatacctgtggaaccatcaccacaatggtattcagcccttaccacaaccgcattttgcagatgaggaaaaagaggcttagagagagaaataccttatcctggttcacgtggatggctaaaagcagagctgtctgatccaggcctgagtttaccttggagacaagaaacgtcagagataaggctgcagtcttaaatatgatgccacggaaggtatcaccaaaaaaaatggtatttggataaagaccctaaagaggcttcaaagggagtgggctacgcagaagagcattccaaggagagaaaatagcatatgcaaaggccctgaggtgggggtgttttccagtgtgtttcagaagcatttaagaggccaagctggcttggggatggaaggagatgagggcagaaaggtaaccggaggccaaactctaaagggccttgtaggactgtgcaaggtcttgcctgaaacaccattgcagggtttggggcagataataaacatggactaatggggccattctggcttcactgttgatactggattgtaagagggcacaggtggaaacagaagtcatccaggtgagaggtggcatggaccaaacttgtagtggcagtggtgagagtgtgggatgtactgggtttactgatggatttgtgcagaatgagagaaagaggagagttggagatgccaccaaaatgtttggcctcagcaacgaagtcaggggctaatgtggctgagatggatgatagacttgagatgcctgttacacatcctattagtattttttccctttgctgctataacaaattacacacagtggcttaaancacatcaatttataatcctactggtcacccacatctcactgggctaaaatcaaggtgcagtgctgtgttctttctggaggctgcaggggagaatccatttactgggctttccagcttttagaggctgcctgtaccctttggcttgtggtcgcttcctccatctccagtgccagcaacattgcattcctctgtgcctttcttctgaagtcacatctctttctacccaaagccaggaaaggttctgcacttgtgaccctggtgatgatattggccccacgcaggtcatccaggataaattcccctctgaagatctttaactgaatcacatttgccaagtcccctttgctgtgtaaggtaacatgctcacaggttccaggaattagggtgtggaccttgttggggaccagtgctctgcctactacacacatatcctggtggagatgcaaggagagactttgatgtttgagtctggcttttcagaagtgtaggtagctgcagatggaatgttcacagtgctctcgactcttccatatttactttctgcatttgttcagtcgtcatagctctttctcctccagactatgagctgcttgaggtagaacttgggtcttttcctccttgtgtgtctcagagccacaccccagagagtgctctggattgtctgtgacaagaatacagtttgagttcaaatttaaaccaaactcatctcttagatgaggagcatcatacagatcctagtgcgtgggagggccacggacatgtgtctccaccctgccttgcctggtaagagttcatggcagaccctaaccctgctgagctcttgttttagcttttaggtccccaccgtcgccactctggatacaaacttggcattgtggctaggggttttgtgggatggatgcagcagttgttgcctcgtcaacattctcctgtggatggtttttgggtcaaggcccactggatcctgttgtgagttaatttgcaaagcttagctgtacctaatgcaggaaagagggtaaacaaacacaagcagcaggacagactttgcaccagtgactcagaggaaggcctatggggatgggatcctcaacccactttgcttcctgatgtcccaggtgctgggctgggagaatggtctggttagccctatgtccgatcctaaggaacattcacattttgccatgctttttacaggtagcacaatgggcgcatttttcactcttgcagatgggtctcggaatgaacttccttgcattgaaaaagggagtggtttggattttctcactgtctagaagcatagtggctaagggaatttctggagtccctctgtctgggttcagagcccagagttataaacactagttgtaggattttattttttaatttttaattttttagcatattaattatatttaattctctattttggatatttagagcagctagaggcattattttagatattgacgagatgaatgtccttctaacacttgtctgattattttcttatgagaaattcctagtacagaatgtgttagtcaaagggcttatttttaagactttgatatgtgtcatcaaggtgccctgtagggtgactgtcctggatgacactcattttgatggactggttcctttttattgtggtagaatatatataacctaaaatttactattctaaccatttttaagttcagtggcgttaagtacattcacattgttgtgcaatcatcatcagtatccatctccagaacttttccatcgttccaaatcgagtctctgtacttacttgcaatcactctccattccgccccgctgcttggtccctggtaactactattctactttctgtctctataaatttgcctattttaggtatcccatataagtagaggcatacaaatttatctttttgtgatacgggactttagacaagtcacgtcatttctctagggctcagtttcctaatctgatttagtatgactgtgaaactctcaaactcaggatgaaagggaaggagggaggaggacctttaagtgatcaaccaaaatttactaggtgctgactacgcgccaggtactggataccattatattccccgacatgcagatgaggaaactgcataggagaggacccatgcaaagtcccagcaagttcagggctgagattttaacccatgtggcctggcgtcagaaccacattctcaatgcctacactgggctgtcctttgataataatggaaactccttcattggaggattctttgaaggattgagccagaaattttatctatgtataatagcacttaggccagcaaggagaaattggtcaataagtgatacctagtcttacgtttaaatgtttttgagatataattcacataaaatttatcatgttaaagttcacagtccaatgctttttagtatattgactatattgtgcaaccatcaccactccctaattctagaacagttccaaaaccacaaaaagaaacctcatatttttagccgtcactctgtctccctttgtccccagccctagaaaccatggatctactttttgtctctatggatttgcctattctggaaatttcatgtaaatggaattgtataatacrtggccttttgcgtctggtttccttcacttagcataatgtcttcaatgcccatccatgttgtagaaggtatcagtacttcattcctttttatgggtgtataacattccattgaatggccatatcatatcttgtttatcccttcattgattgtaggatgtttagattgtttccagtttttggctgctatcagtaatgctgctatgaacacttacatacaagttattgtttgaacatctgttttcagttctcttgggtatatacatacctagaaatggaattgctggatcatataggagttctatgtgtagctttttgaagaactgtcgtactgttttccatagcagctgtaccattttacattctcacaatcagtgtacrgggtttcttatttctccacatcctggtcaacatttgttatttccattcttctgaatttagccatcctggtgagtgtgaagtgctatctgattgtgattttgatttgcatttctctaatcactgtttgtattgagcatatttttatgtgcttagtggctgtttgtatgccatcttgtaagaaatgtctattgagaccctttgccttttttaaaaacggagtcrcctttctattgttgagttgtgagtgttctctatgtaccctggatactagacttttatgagatatataatttgcaaatattttctgtgtgtcgtgttttcacttcgtttttttttttttttgtgacgggggtctcactctgtcacacagattggagtgcagtggcacgatctcagctcactcactgcaacctccgcctcccaggctcaagtgattctcctgcctcagcctcctgagtagctgggattacaggcacgtgctactgttgcccggctaattttttttttttttctggatttttagtagagatgcggtttcaccatgttggccaggctggtcgtattttcacttcttaatagtgccctttgatgaataaaagtttttaattttgacaaagggtgaaggatgtctaatattttgtctatgatccatttttcacctctaggcccacttttttgaccctcacacatcacggtagattaggaatttcttaatgctgtactggttttggaggtaaggaagatgggactagcccactttgctttgtcaggctgagagggaagaagtgattccattgagccaggacttcagtggccaaaactacctcccctggcttcagaatcccttccccagaccaaccctgcgtgatatcagcatgtggtaaaacactcctgtgtctttagagactgcagtctataaatgatttttctgtcttccatgggccttgcctgcaagcactttccatctttccctaggtttcaggaatgctcaagaattacgggatcttgactgggcacggtggctcacacctgtaatcccagcattttggtaggccaaggcragtgaatcatttgaggtcaggagtttgagaccagcttggccaacatggtgaaaccccatstctactaacaatacaaaaactagccagacgtggcggtgggtgcctgtaatcccagctacttgggaggctgagggaggggaatctcttgaactagggaggaggaggttgcagtaagccgagcttgggccactgtactccagcctgggcctgggcaacgaaaagagactctgtctcaaaaaaaaaaaaaaaaaaaaagggggtcttgtcactgagtttcctcatcttgcctctgcctctgagcacatttttccttctgcttctccaccataatgaaaaccagccataggctttgactactctctattctctagtgtcccaaacttcagtgagcacagacaatcacccagataacttgttaaatatgtggattcctgggatattccccagaaatactgaatctaaatttagggatagagcctaggatgcacatgtttaagcagattcccaggtgattctgatgtcagggggtccacagaccacgtctttagaggcactgccttattctagaagcctacccacccaaacttattctgagatcccaagagaggctaagtccagtggttctcaaacttgactgcatactataatcacctaggagaactttacaacttccctccatcctaggacacagtgcagacaaatcaaaacagaaactcagggcatgggaccccagcttcagtagtttttaaagctccttgggtacttccaaattgcagccaaagctgagaggcatcggagccataaaattgtaggtacttgtttctctttgctaagtcctttaacccacacaggtcagctggatttggaagttgatgcttcactcttataaacacatttcaacttgttgtttattctcatgctgcaaatggaaggtacagaattgcaagggatggaatgtgcacgtacctccaatttccctaccagcagggaatgcaacagcctcatgatgcttaaccacaaagggcatcacttgagacatctttgctcactctcacgatggtgaaagattgtcctgggctcattgaaggagctatggatgtttccaagtccccagatagaggtatcatcactttctgatcatgaacctatggtaccaaggtcattctggtgaagaatcttttatgtagtggccaagagtgtgggctttggaatcaggctgcctggtttgaattttagctctatcacttaggtgggcaacctacccacctttctgtgcctccatttccttctctgtgaaatggagataaacaaaagtactgtacctatagggttgtcttaaaaattaaacaagatgatgcatataaacaatttaacccctgcctggtgtcggctcccgtccacttctcctcttgggttgcctttcaagaagtgatagtggcaggcagggctggtgcttgggaccatactggtgatagaagcagcagccaggtactgtgcccaaaatgctctcaagagtacaggctcagtacatccctttcatttaccacctgagccctgtctggtgagactcatcatttgtcctctatacaatgccttcccaaactccactccaatccctttctataggcacagcttttgttaacaaggtatagcttcatcctgggggcataatgcacttgaagtttttctcaatacagtgttattagggtgaagaagggacttacataatcaggacaaccagaagagatacatgcccaaattcttaacaagattcatggctcgtcccgtaagactccttgactctattattgcagttttaagagtacagactctttgtggttttccccttacttcaactggatctgtcagtaattccaattactgacaatgacacattcttctagaaccaataagcttcctacattgcatttctgctaatagaatgttccgaatatttccaggtatatgtgtctgcatgattctacctttataaagcctctaactagaaatcccaaatttccatgcaacagtattcaacattcagccatgtgctaggcatggttcttttatgtaggtattacttaagctggtttatcaattttaacacactagatttccccttctgatcaatactgcctatcggatggcatgaggagagttttggagaaatggtagtcattactctggtgagggcatggactttccatgctctcaggtgaccaaggcactccaagagttgttgggttaatctgactgctctctcaacaaagagaaatagggagaggaggagaggaaaagaggaaagtaggcttcttagagggcaaagtacccatgagaaaagcagacaaaggaaagagggtacttggaacatgtcttctctataagcggtccagatggtctgcgtgtgaggcagtctgcagaactggctaatccaaccgctgaacaattcatagccagtttgcaaaacctgaaaaaggcagcccagaggtccacacaggagtagagggggaagaagggcctgctaaaaacttatcatctggaaaatctgatgatgagaggagtgctcagagaatacgaagggaaaccttataaatatctcagtgtcactaggatctcgggcttcaagcagcccttgaagtttaagaacaaatcatcccaggccacgctggtagcatttttttttaactgtaattacaaataactgacatatggcaatgttgtagatggctggcttctgagctgtggaccagtgattctcaaactttaacacgcatgcacaaatcacctgggatttggttaaaatgcagattccagttcagcaagtctgggctggagcctgagactctgcacttctaagaagctcctgggagatgctgatgctgctggcccatggaccccactgtgagtagcgaggctagaggcgtgcttggtaaacaaagtcaggaggcctaaatggaggtgcttcgaggtggtgcaggagcacctggggcacctagaaaacattgctggcatctcggggacccatgtccagggaagggctccaggacttccccgagttgaggatgaagactcagacttcctggctaccactcaggtagagaagagcagacgttgccactgaagtcccaggtatgaatgaattctagagctgctggagtggggaacattgtcattgagcttagagaaacagaagtaggagggaggggtggataggcaagagggaacccacaggtactgagcatttcttgattgtcttcctcttgctccccacccttaactgttccttcccaggtctttctctctttagtaattgcactcaccatccacctaactgcctaagcccaagacgtgggatctatccttcactgcattgggaaaggtggtcatgcacagcttgctggaccctgtatggctgtatgagtggccttgggcctgaaacatttccttaacaagagatgaagagccctcccagcctgggctgggcatatctctttgcctggaaatatctttccctgttctgggcttgatgtactttgttctgctcaagtgtgtgcatctaatggcccctggccaaacctgctactatatctgtccctggtggaaagggatctgggtccttctactgcagcacgaggtgggtgtgtgcagctgcactgcctgggttgactgcagagcagatccactggctgtgggggactgacgcattgcaagggactgcatcttgtgtagtctgtctcctcttgctctaccacttgagcctggtgtgtgtgttgtctgttctcagcaacctcaaatcgtgtgatggtctcttccctggatgacacttagccttttaaccttggctgcccagcctgaccacccagtgaatggtggaacattctctttctctcatccccaccagagtctagtgcaatgtataattattctccttcaaatgtatatctcagatccttcctcatctccagtgctaccaccatcatcaccatctggagntgtagatgaagcagcctccactggtctccctgcttctacctctactcctcccctacttcatcctttcctttgcagccagggtaaattggatcaggtcacttctcttctgaatagcctttaagggcttctcatgacatcttggtggctagaacctaggtgccttctcatgaactgcggggtccttacccacctgtcttatccctctcctcttgccacctgctccccaccacgcacctgtgctctgtcagttgtcacctgtgctctctgtcagttttgaacataccctgttttctttccttcttagagtctttgtgtatttggttctctctgtctggaaccagcaccaatccccaaaactctgccatccttcaggtctctgcttcaatgtcgcttccccagagacagattccctgatcaccctagattaggtgttagtctctggcctctgtcctttactctcatggcactaaccttagtttggtttgtacattatctattatctgcctctcccaatacattagatgatccatgggggaattgataaggtttggatgtcttgcccaaatcttacgttgaattgtaatctccagtgttggaggtggggcctggtgggaagtgtttggatcatggaggtggatcccttgtgaatggcttgggccacactcttggtactgagtgaactcttgctccgagttactttgagatctggtcatttaaaagtgtatagcacttccccccaagacttactctctcctgctctggccatgtgatgtgcctgctcccccttcaccttccaccatgactgtaagcttcctgaggcctccccagaagccaggcagatgccagtaccatgtttcctgtaaagcctgcagaactgtgagccaattaaacgtcttttctttataaattacccagtctgaggtatttctttatagcaatgcaagaacagactagtacaggrtctctgcctttcttatctgttgttgaatatccagcacccagctccaggctcagagtagacactcaatacatgttggttaaagaactgagtgaattagtaaataaatacgctttgggaaagcagaggaccacaaggagagcataaaagggattagcattcatggaaacagctgctatgtgcattgcacatctgccatctcatctcatctatcccacagatggctttcagccatcttgtagcctagagagtttaattaacctgcccaagttccacagccactgagtagcagagctgatctgtactctgcttcatcttagcctggagttgttttagctttggcatcatgacatttgggaccacatcattctttgctgtggggtggagggggtggatataatacgcattgcaggacatgtagcctctacccatgccatgctagtagcaccccctgcccaatttatgacaaccctcatgcatccagacattgccaatgtcccttggggtgggggtgggaatgtgtccccagtatagaaccactggcttagcctgtgggtaatctcagcctcccatctgcttctactccaatccctgcccaccccactcctctcagctgctgtttttctcctggactctttctcaccctgtcttcacgcagtcctccctgggtgtccctccnggcatgcaacacacagatggcaatgttccgagtgttgcaatacacatttgtgtttctggttactttaatatcagccccatgtcmtgatgttcgtgtcattggcatggatgctaacaggctgtctagaaaatgtgcaatatattttttattttgcctaaatagcacatctaattgttcagcatgagataaaccagtatgtttacggggagataacttgtcaaaacagacttttgtggctccaccgttggaaaaacctagcctcctcattcagagatggagtgtgaatttttcgtgggtattttatgtggatttaaagcaaattatttcctgctgttttgtggacagaaaaaaatgagggaaaaaacggcttcagaaaaagccccagatgcaagtgtcttttaaagcataggggatgaagaaagagaatagaacagaaaagaggagaaagaaacagcaaaaaagagggaatttgctagagaaaaaatgtgagagagttcacagctgggggatccagttagaggtagggtgctctttttttgctcattcatttattcatccamttaaaatatcgtgagctagggagtgtgctggtgtagcatgtatccgaatgtcctttstttttgaacgctggctaatatttmattgtatgtatttacattttgtttacctgttcttctgtcaatggacatttgggttgttcccacctttggctattgtgaataatgctgctatgatgggctggtcttacatatcagtgttaaaggtgacatttcccaagtgcctactgctgagctgggcaccatgctggcctctgcacacgtggtatctcatttaaccttctcaatctcctgggaggttaaccctctgccatgacatttagcaaacactgggaggggcagcttaagatgcttcagtcactcatcctaaggtctcagagtgatagatcctgggtggaaacatgggtctctttgtaggtcatcatttttataatcagaataagtgattgtgagtgaggtcttactcagtgaggaacatgaaatagcccatagttttgtccctgttgactttgacgccctcttgcatttgtatggaactgctattttgcagcatacatctgtcttcaggtaccatttttactctgcaaacattggttaaccttgaaactctctgctgctccttcctcctctccttttatgacagagataaataagttggtgatgtttccagaaggacacgatgagacagacaggattagactccaggaaggagcccagcggccacttcgtgagctagtgttcaggcaaccctccccagatgtgcagtgtagcagaagtaaaggcccctgagaggcacagagaggaagacgcatcccaaacttcaaaggctggcagcctcccactccaacaccgggggatatgaaattctgccgtgatgaagagcatcgtctgctttctaaagtctgaagaatatttctagtcagttcctaagatgtgctgggggtgagatggactatggaagtgtcaggaggacagataaatgatctcttagttgttggattcatgatgtctaaatccatttccgaaagccctctctcaaggaacactctttaaggtatgggtaggtgactttcagctctctattcgtaagagacccatgtttccacccagtatctatcaccctgagaccgtgggaggaatgaccaaaccatgttaagcgccccccctcccaatgtttgtccaatgtcatgacagagggtcaacctcccatgaaattgagagggttatagtcttggcttgagatggggttggagtaaataatgtatycaatcctcttccagcttagcattcacttggtggccaatgagctcttccataattattaacactactgagcacacgctacaagtcaagaactatgctagatgcccttcatccatgctgtcactgaattcttttaaaaaccttatgaggtaggagctatgattagccctattttagagataagaaaattgaggttcaataacttgcctgaagtcacacagtgagcaaatgacagagatttaaacatgcattaaaacaactttatgaaaggatgaattctgaagatctgaccttagagagatgggtgtaattaacctgaagttgagagactcctgtggcatatgtattgtgctagatagagaaagaaaatcgtggttgtaacaaggaggccgaaatagaatgtcacaagagtagatgctctgggttgcaggtgcattcttttgctaacaagttttttctcacgtgagtaactccacacagcatgctcttggctgggtggcagcaggctaccattttagtgacagttaatcatttaatgatggttaataattctcccaactgatgccaggcaggcgaggtaccttaaaataaagtacagaacttactggcatgtatgaatgcccaattgcatcagagattaattttctgtttgtgttgaatgctgtgtggagagtctatgttatcaccagactttgctaaatttccctgtaattttttgcatggtcctgactctcctctttcatttatctgcatatggattctccacgttacggtgtattctgattttcttaggtaggtgacattgaaaaagtgtaacaattgatgaggcatggggattcgtccgtttggatgaatgcactgaccgtgtgaatgcttgccagccataaacaaccagctgaatatcaatcttgccctgaaacaatggagatttccccatagtctagtccatgggatcaaacagtaatttgcatttcactgaagcacatggagaagtcaaaacagactatgcaagtaagagtcagagaatagcatgtgaagcaaagatttgcacctggggttgttagtagcagggtctattgaactatgacatctcttgatatgttttagtcaccatattaatttctcttgcnatttcaaatagcattagaggaaaatgtgaggttaaaaatgtttatcaaggagacctggatcataaaagcttgagaaacatcaatgtagaggcatgaacagtagaaacaagcataggtttgatggagtcgctgggttaacatggagtgaagctgtccatctttttcccgttgataaagtcctagttgaaaatgtttgaggatctctggtgcagggctttgggaatcaggcaagacctcagtccccagggagtgaagatgaggttagaccagtgacaacgttgttctgatgcaccaaaatgggcgaacgaagtgaggtgcctgggacgcattcaccagcattcaagtacctgttgatgcagggcccctgcatgttgctgtggctagttttgggggttgtttgaaaaatagaagagtcagcccctgattctgaaggaatatctgttctcgtggaagaaacaaaacactcaccaacaaagtcagttcaattctatagacatcgattgagaacctaccatgggtaagaaaagctctctgtttgagagtaacttaaggatcattgaaaaatgacacatcagtatgattcgaataaagcagaacagaacaatcctattgttctcaccatactgctgagacataaaatcccagaattctagaagggctctaattaggaaaggcttccaggagamggtgactgtggggtcatgaataaagtggcagcttcctcaggggagcctgggaagagggtatttgctccattatcagcccggcttttggcggtgcaagaaatgaaggctactgtaygtctagaagtttccaatattttcaccacctagtgttcttttttattattttgactcctatggacactgtttttaggaggattttatctactgataaaagtatattgaagcagtggttctgtactaatcaaacctacctgtaacatgtaatttagatcctctgatttgcttgagaattatttattcattcaacaaatattcacgggatactaaatcaattggattcagtttggtggtttatgacagaaaatccagattatcaatggcttaagtaagaattttatttccttctcatgttaaagaaggagagaatagatttttgggtgggaggcttatggttgctgtcataagcatctactagaagccaaataccaggttatgtactagaaatggctaggcggggctcatgcacagtkatttgctatgattctaacccatttttaaattataatttcaacttttattttagatccagtggatacatgtgctgggttgtttcatgggtatattctgtgatgctgaggatatgaatggtcccatcatccaagtagtgagcatagttcacaacaggtagtttttcagccttgctctcctcacycttatcatcatccccagtgtctattcccatttttatatccatgtatacccagtgtttagctctcacttataagtgagaacatgaagtatttgtttttctgttcctgtgttaatttgcttaggataatgtcctccagctccatccatgttgcggcaaataacatgattttgttcttttttatggctgtgtatattccatggtatatatgtgccaaattttctttatccaatccaccactgatgggcacctaggttgattccatgtcttcgttattgtgaatagtgctgcagcgaacatatgagtgcatgtgtctttttgctaacccaatgtttttcttttcttcttctttttttttttttgaaacagagtcttgctctgtcacccaggctggagtgcagtggcacaatctctgctcacagcaacctctgcctcccaggttcaagcaattcttctaccactgcctcccgagtagccgggattatagacatatgccatcacacgcaactaatttttgtgtttttagtagagatggagttttgccatgttggccaggttgatctcaaactcctgacctcaggtgatacacccacctcggcctcccaaaatgttgggtttacaggggattacaggtgtgagccactgtgcccggcgtgttaacccaatgtttttcaaactttagtgtgtgtcagtcacctggaaagcttgtgaaaacagatttccgaatgttatttctggagtttgtttcattaggtctggaggcaaagagactgacaatttgcatttctagaaaggtctggatgctgttggtctggtgaccagttgaacccagtgacataggtcagggcatggccatctacagcctacaggtcaaatccagctagctatttttgtacataaatttttattggaatgcagccatactttttttgttttctactgtctagggctgctttttactacaacagcaggggtgagtagttgtaatctgaagtgtttcctatttgaccttttacagagaaagcttatcaactcctgccttaggtagaagtggatactcgcaatccataaagaaggtatgtacatcagtggagaagtcagcaagtaccggacctgggtttccatctcatcccagttcagccattcattttttatgtgactttggtccggccattaccctatctgatcctcagttgcctcccctatgtaatggaggcactgagcaaatggtttcaaaaatcccttttagtacttctctgatttcagcagagaagctgacggaatggtttgttgccattgtacaaagtgacaggctctggctgaatacgtcccattttgctgctgagttcgattggcctttatgttctgtttatgaaggtgtcccctctgccacttttggagggaactccctttcttcacttttgattgatatgtgacatttactggagctggcattctttaattcctactctctgagccactttccaacatgttctattcatcactgtgacttttttgttgcctttgccactaytaaccttctaagagttcggaaaagaggcacttagagtttataatgacatatataatatcacaccacctctctctgycccagactgacttcactgtgggtttgggagtctttttcagaagcaacaagggagaaaattttgcttttgatggcaccccatcaatcaaagtgagacacacagttgactgtatttaaatcagagtgaatgagtggaaatgagtatgtaaaggaatctcaggaatctctattcattggattttagtattcgggcaggtgcatatattggttaggaattgtgtttgccaataaataagcctggaaatgctaaaacaaaagagaagtttatttccttctcagattaaagcagcctggaggtaggtggttgagggttgccaaggtggcttcatggtgtcctcatagattaagcctcttcctgtatttctgttgtactcttaagcacatggtttgcatcattaaagttgcttcatgatccaagatggctgctggagctccaggcatcacattcacactcaaagcaggaaacaagaataaggaggagaagagcaaaaagggcacactctagctgtatgccccttcttcaagagctcagaaatcctaccccagcatttcagtctattgttggtcatctctgatagggaggaaggctggggaatagaatattttacctagaaacattgtttctgaattaaactggagttctaaaaaggaaaaggagaaccgacattgggtgggaaaccagcagtttctgctctgatgtctttcagaatgaatactttgatcaatatggtaggaagttagatttggggatggtttttggcttgcactgttgtgggtgtgttatgaatggaaggccatatagcttgcactcgtaaagaggaaacgcagctttcattagatatccctggctttgaatctgccatttactagctttgtgacttggggcaagatatttaacttttctgagtctcaatttcctcatctgtaagttgaaaataataatagtagcaaagatgatgataatgaagatggtgctaaaagtaatcatgactttcttgcaggaacaaatgatacattgaagatcaagcactaggaacagtttttagcatgcagttagcatttaatgaacagcagataatcctctttgaagaacaatggatatcagaggaaagactataaattttgggttcctccagacataggtttaggtgccagcttagccactggctagcggaggaaccctaagtaggtttctgaatcttgctgagccttaattttcttatctataagataggtcacagtaggggctaaacagataatgtgtgggacagaactgaggcaacatcagaaaacgtgaagcacagaccccggcatgtggttcgtgcctagtacctattgattttccttctctttctagtatagaggattgggctgtgaggactttgttcccgggtctgctccggtagcctgattgttctcaatcctttctctgacctttcccttctctgttctatatgcaaggacatattttatccaggctataggtgatttctccctcacttcctcttccttgggaatgtccccatctagctcttgatgggcagcctccagggtcccaattcctatcaggtggtccctgctgtgggatttgctactgccaagcgacccagcttctgaactttggtaatgtctcctgcatcccccttttcctccatccctaggatattaatggcttcctcttttccttttctctctgtgtcccagtggctcctatgtaaccaatttcctgtattatctctgttggaaacacctggagtggtttccgtttccctgactgggtcttaactcattcacgaatctaaaattgtataaacacataatgcccaaacattctcttcacttacctcttacctctcaccaccctctaaaaatcttgtttgttttttttttttttttcggtcacgatggtgtgattttatttctttagttccatggcccttcattagctacaggagaaagtcaaaagtccttcctctgttgtttaagacgctctgttgtctgaggcatgggctcctttctaaagttattatttgcttctgaacttcagaaatttttagaacaaatttgattttacctccaaaatatatcatcaacctacccatttctaccaccagtcaaagccaggggtagctgaatcctgcacttgcatggccctgagaatgagttcttccttgaattctgtacccgtagatgcctcagtagccccagccctggatcaagtcaccactctcttacttggatgaatgcaatggcctctaaactggtctcttctatcaattatctttttctttacaatccattctctattcagtgtccaaagaaatcttttaaaacaatataatgtagatctgttattcccctgcatacactgcttccatggctacccactgcacttaaggcacaactaaaacctattcccatagtctgtggggcccagcacatctgcagctgctccatctttgtcgccatttcctctgtctcctattgctatgttcactccagcaacatggactgtcctcctgttcttctgatgcccaagttcttctcctgttacagggcctttgtctgaatccctcttccatgtattatgattccccatcctgctgcataatgtgttcatcatgggtaccaacaccaggtgaacctcccctttccccatatcactctgttgattctttttcacaatctattgttatcacagcctataactatcttgtttatctgcttattgactgtctctgcccactagaatataagctcattagggaagacaccacatctgtctttttggccttgtatattgctagcactaaccatattgtcaggaatgtcagaaacattcagaatttgggggatgaatgagcgagtaaatgaatggacaaatacataaatacctaaacatataaatcacataaacgggcccctaaggggtctgtggatggaactcagtggtctgtaaacttggatggggaaaaattgcttatttttacttacctctaacaaaagttttcattcttttcattttgaattgtagcaagaaatcacagtaatagcagctgtctgattttttttcaccaagagaaattacatatttcttatcacattatcattgttgtagatatttcagaattatttacttttgccaaattattttgaaatcattgtagttagtagacacagcacagatcttgtgatttagcatgttaataccgacataaacataacacaagtttgttttaaaacatcattatgactgtattttgatataatttgttttctttgtaatctagcggtttttttgtttctttgttttttgttttttgtttttttgttttttggtttttttgttttttggttttttttgagacagtgtctagctcttttcaccaggctggagtgcaaggcttgatcatggctcactgcaacctctgcctcccgggttcaagcaattctcccgcctcagcctcccaagtaactagaattacaggtctgcaccaccacgcccagctgatttttgtatttttagtagagacagggtttcaacacgttggtcaggcttgtctcaaactcctgacctcgagtgatccaccctccttggcttcccagagtgttgggattacaggcatgagccaccacacccggccacgtattttattttacttatttgacagctctgttctgagaaggaatttgaaggcttcaccagcctgccaaagtggtcgttggcacataaaagtcaagatctcttaaaatgaacgagtgatgtctgcgcttttgtttattgaggaccacgctaaaaataggtatccctcccattacttaactgtcatttatccttcagtatccaggcagacttttcttcaagaaagctttgcagtcttcagtggactccctgtcctctgagagtgtgtagcacttacccaaagcccaatacttccctgatcgtgtaagcctctttgggaagtgattttttttttttaactacttatgagtttgttttgtttttccaccttacagaggctttctgttactccctaatcataattagtgccctgtcccctgcacccttgttattttctttgtagagctgtatttttttccttcatagaattcaacraaattgataaatatatatttacttgtatgatttatttattgtctatatatccanttgggaagaggccttggatattttgctcctcatctagtggaggccccagaacatttatattggaagggcctaagtgccaccaacatagttacaagtggcaggaatacctagggaacttaccttgaagttcagtttgcatagcaagcccattgtatttacttagattgtatttattcttgaggtctggtgatattagtggggttattagcatatgtcagaggaagaacccataatatcgtgctactactgttgtcgccattgtacacttagcacacagaacaacacttggcacatagaccctaaataaagtatgtgtgaatggatgaatgatggatggatgggtggatagatggatgcatggttggatggaatgaatggggaattgggtggatggctggatggatgggtggagggatggatgggtagaaggctggaggggtggagggttgtatagttgagaagattactggctgggggttggagagatggagtagttggtaggggaggtggtgtattagtttcctagggctgctcaacaaagtcctgcaaacttcgtggctcaaaaccacaggaatttattatatcacagttctagaggctagatgttcaaaatcaaggttctggcattactgttctctttccaaggatgctaagggaagaccctcccctgcatcttctaacttctggtggttgccatcaacccttggcgttctttggcttgtaggtacatcattctagtctctgtttccatatttatgtggccttctccttgtgtgtgttcctgtgttttctcctcttcaggacaccagtcattggactggggtccaaattcagtatgacctcatattaatttagttgataacatctacaaaggccttcttttcaaatatggtcatattattaggttctgagtgagcatgaatttttgaaggatgctgctcaacccaatacaggtggttagagggttgaagagatggatgtatgaagcaatggaaggtggcttaatgggtaggtgtagaatgggaagggaggaccagcctggctggaaggggaagaggatggattggtaaaggagttgttgtataaagagaagggtgaatgattatttgaatggatgagtggaaagatgtagggttgaatgsatcaagggtggaaaggtggatgagtgaaagggtaaatgggtggagggatgaatggttggttgcttggatatatgtatgggtgaatcaattatattattaatttcttcagagtagaaattctggtacntgtatttatcttctctgttattagtatgacactgcatttaggaaatgctcattaagtatttgttgcctggttttctctgcattcagaaatgctgttaactggaatgactgctaccagctgtccagggatrtgaacttctagtgggtgagggagtgtatgtgtgaattcatttggtgcaatrtccagcctggagctgtctctagcctggagtatgcttagtgaaaccctgagaaagaacttaaatgttgggtataattcctgctgttwagggagtgacaaaaatgtacatgtatagacaccactatttcatatttcaattattatttatttaacattttaaacctgatggcagaaaaatatgcctcagacaggcacaattgcttttattgtttcagattggatgggtaaatgtagcgtgggtgatcctaaatttgggctacattggtttctgttgaagcttttatcttatttgcctaaggaagggcttagttgaatttaaaagcacctattctgatgttgtctattgaagtgactgagtttgccagtgcactgttaatagggagtttgcagcttggtgccagatggattcacttcatcagatgtgacaaaggtcttcccagatgttttgtctgctcagagtatcctttttacattgatctggatatctgcagtgaactaaggagtctcagagaagtcatcctattattgtgtttaaatcttttctttttctctttcaaaaccaggatttatcaatgstggaatatttcagacatgctgataagtacagagaataaaataacaaacaaccatgtactgacaattcagatttaacaaatgttaatatttttgtcacatttatttcagattttaaaaatataaagatgctgctgaagcctgccaccctcatttcattcccttatctccttcctcagaggaaaccactaacctaaagctgataaatgtgtttttctatatgtacatgcaaacctagggtataatggtattagtatgttttatgctttttataaacagtactatatttttccaactactgttttttttttcttttttctttctttctttcttttttcytttttttttttttttttttttttttttttttttttttgagatagagtctcgctctgttgcctgggctggagtgcaatggcgtgatctcagctcactgcaacctccgcctcctgggttcaagcgattctcctgcctccagcttcctgagtagttgggactacagacgcgtgccaccatgtccggctaattttttgtgttcttagtagagatggggttttaccatattagccaggatggtcttgatctcctgacctcatgatccgcccacctcggcctcccaaaatggtaggcttacaggcgtaagccactgcgcctggcccaaattactcttttttactcagtattatgttattgagatttatctgtgtttataaatgtagctttagtggatttattttaactatttatattttaaatatccaccctatggatgtataaaaattttacttatccatgaactgaatgatgggcactttgtcattaaatcaacgaaacacagaacatctttgcacagatgagaaattttcttaatgatatatgcctgtaagtaaaatttctgggtcataggatgtgggcatcttcaacatcaccagagattgccaatttgttctgcaaaaggattgagcctgtttatgttcccacagcaaggaatgaaaagttgcaaccttcttatatctctttaaatctttgtattagtcctgttcatttttgcttatatgatagatgtaaaacggaatctaaccatggtcttcaatttgcawttatcttattaagaagttgaacatattttcacatttattggccatttgggttttcttttctttggtttgtttttcttgaacagtcatgtcagaagattcatttaatgtttttcctctgaagatcagcttatagttttatttggcttcttttttttcgcttggtttacttttggtttctgctttatccacgtaggatattttcctttttttrgctttgtttctttattctgttcggttttttaaaattaaattttaacttcttattgtcactccatattcaaatatatccatttatggatgtattagattggtgcaaaagtatttgtggtccttgccattacaaaccacgattacttttgcaccaactaataatacagctcttgtgtggaggtttctgctttatccacgtaggatcttttcctttctttggctttgtttctttattctgttcagttttttaaaattaaattttaacttcttattgtcattccatattcaaatatatccatttatggatgtattagattggtgcaaaagtatttgcggttcttgccattacaaaccacgattacttttgcaccaactaatacagctcttttactgcatttcatgagtgaccctgacaacagaaggacgttgtaacagcaggtggcaggatgtagactaggcaaagtggtctaatcctggctccattttctccccagggcaatccaccttagtgcaacatttgccctcctaaaactcctatgaacttgtcaccacctgctcaaaagataccagtgactctgcttcattcgtcactcacagtccttaagagagacggtgtgtagtggaataattatgggcttcagagaggcacacatttcaggtttaagctccagctcttctcttgctagctggctgactttgggtaatttaaagtgggaatattcatagagggttgttgtgaagaatagacaagattagattctgatctgtggtagatgttcaacaaaatatattatcttccttttagcctgacatttaaggtcctgtagatcaaaccaccttttccataggatcctctgctagtcaactacagaaatcttctgtctcagtcatttgattttcttgctgaatttggaaagtttcagttaaaagctttctgtctccatcctactcttctccattcactgttgtggccctgaacagtggcagaattactagtggggcttgttcaaagttcagattcccaagttttactcagactcactgtctgtatttttttttttttttttgagatggagtcttgctctgttgcccaggctggagtgcaatggcgtgatctctgctcactgcaacctctgtctcccaggatcaagccattctcctgcctcagcctccagagtacctgggactacaggagtgtgccactgtgcctgggtaattgttgtatttttagtagagatgaggtttcaccatgttggccaggctggactcgaactcttgatctcaggtgatctgcccaccttggccttccaaagtgctgggattacaggtgtaagccaccatgcctggcctcactctctgtattctaaggatagggctcaggatctccatttaggagaagctcccagtttgggtggaatttgctctagtgattgaagcttcctgcctcaacagatcttttctttatatccagcacaggacctacattttccgggaggtctttaccgccagccagccctggtcacacttaccctcccagcaacctgaaggcggaatatcttagcccacccctctccctggctagaagcatcattcatgtcccctggggcagatggcgattccttaaggacagggcctaggtcttggggacttgaccgttcctgttggaagttcagtgcatgatatgtaaaaggacttagggtgagcatgggaaggagcacaggctttgtagctgccmaagttcaaacaccagctctgcaaaactggcccacggggctcagtctccttaactgtgaagtgatgatagcacatccaacccacaggtctttaaaggaagattaaatgtgatcagctctttggaaagtcatttgtttttctcttattccagatggagaagagcttgaattatcatgagaatacatctgtcattgggatcatctttgtgttaatttcctcctacagtagaatttaatgacctcttgaatttcctgatgacaatgttttgggcatgtgtgccattgtctactggccactatccttgtctttcagagacatttccttccaggccattataattctgtagtttcccccttgaagtcttcagtaaaagaggtagtttgagatctctcagcacaaacaagactttttagtatgtgacagtgatctgacaaatgaaaatgcattgttatggtgcccacgtaacagtgcaagtgtagtctttacaaaatacctacctaatcccattacccttctgcttaaatgtctgagctggctcctgtggctgacaggagcaggccagcctggcagagaaggcagggtctggccagtctctctgccccatcttctgtaccacctgcacagtattgcactcaccctggcatgctctggtgaccgttcctggtattttctacctccttgctcttgtacatgcagttctctctccctggaataccctttctctttgccaagttgtgtgaattcggcaatattcaattcgaatggtccagtccctgatacaccccctcagacacacacatgcaaggcagaattaattccttccagctttgtatacttggagcactttaaaaactactttgagttactactcattcattcactcaacaaatatttattaagtgcctactatgngtcagccattgatcttggctctggggatactcntgtgaaaaggcaatgccctgcacccatggagtttttcttcccaatgttttattactactcacttacgactgccctttccatcagactctgagacccatgcaggaggtgtcttgttcctgtctgtgcacttttacaactgactgcagttatttgagcttagaattccatggagaggaaaaacagtcccaaagtacagagtgggtgctgaagagattgcagggtggaatagtcatgaccttatagcaccaaaatcccaggaactgagtgttgcacacagtgtttcttattgtttgatcaactcccttgactttgtacagaggacaagaggaagagtgtggagttaagctgactgcacttacatctacatcatcctaccacctaactacatggggggcctgggacaygctctcgagtcttagcttcatcatctgaataatgggtctcttactttcctattgctgccataacaaattaccatgaacttcttagcttaaagtggcacatatttattatataaattatatgttttggaggactgaagtccaaaatgggtttcactgggttaaaatcaaggtttgtgaaagcagggctgtgctcctctgtaaactctcagattatgattcactgtctctacagcagtggtcctcaatctttttggcaccagggaccagtttcgtggaagacagtttttccacagaccggggttgggctgatggttttggaatgattcaagtgcattccatttattgtgtactttatttctattattacattataatatataatgaaataatgatacaactcatcataatgtagaatcagtgggagccctgaacttgttttcctgcaactagatggtcccatctggggttgatgggaggtagtgatagatcaacaggcattagattctcataaggagcatgccatctagatccctcgtatgtgcagttcacaatagggttggtgctcctatgagattctaatgctgccacttatctgacaggaggtggagctcaggtggtaatgcaagcaatggggagcagctataaatacagataaagcttcacttgctcacctgccgctcacctcctgctgtgtggcccagttcctaataggtcatggactggtactggtccgtggcttggggtttggggatccctactccagaggtcacctgtatttgttccttggctcctggcttcttccttcatcttcaaggctagaagtgtagcatcttcaagtccttgtctccctctgccctttctacctccctcttagaagaatacttctgattacattgggccaaaccagggacttcaggataatctccccatatcaagatcctcaatcacttctgtgaagtcttctcggccatgtaagttaacatattcacaggttcttggtatcgggacatagacatctattgggagacctttattcttcctatcaggtaggatggtatgggtatgagtataaatatgggagtgatgataacagtggcttttccactgggttatcagaaagattccaggagattcatttattcatcctttcagtcagcaaatattaattgaaagcttcctatgagctgggcactgctcacaaaaaaattgcacaaaatgttctgccattatagagcttccatcttaatcaggagagacagacaaacaattcattatataatgtattggagggtgctaagtataatggaaaaaaatcaggagggaagaggactgcggagtcccaggcaagttgtgggctggtcgcggtgactcatgcctgtaatcccagcactttgggaggccaaggcgggtggatcacctgatgtcaggagttcgagaccagcctgggcaacatggtgaaaccctgtctctactaaaaatacaaaaaattaggtgggcgtagttgtgggtgcttgtaaccccagctactcaggaggctgaggcaggagaatcgcttgaacctgggaggcggaggttacagtgagccgagatcgcaccactgcactccaacctggtcaacagagcaagactctgtctcgaaaaaaaaaaatagtaaaaaatcaataaataaggtggtaatgctgtgacaacttgagaaggtagcatttgagataatgagtctaaaatgcttagcacagtgcctgagatagagtaaacacagagcatttaaatgtaaattaaaaataaatttaaataaataggcaatccatctcttcattgtcatctcaccatccataaaacaaaactctgttctttctgggtggtatcattcattgaaattcactgggcttttgccaagcggaactctgatctttggaagggtaatttcagtatggagtgtgtcatatcaggaaattaaaatactgttatagattttcctcccctctggctctcttttggaatagcaacgactgggaggtaaatagcttagaatagagacagcaagtttctgatgcatgaatgggcaggggctggggccagagagatctctccctcggctccttcctccacgtcagcaggaaggaggcttgtagaacttggccctggagcttgcactgatcccagctgccatgaagaatagcattaggaacagaaaccctccaaggttgagatggagagaggaaatggggagagaagtcttttatgggttgagacattttgagccccttgtggcaccagcccaagggaggccaagtgtggggtattactgtctttcagaatggaatactgcttagccattcaacagcccgaggaatgctcatttctggagggcacagacctgggctatgttagtgtttggagacactaatatctctagtcttcttcccaggccaggagagattattgagcaaatgcagacttattcaggcatatttcctgaatgttaattcaagtggaggaatccaagcagtttgcaggcaacatgtccccacatatgtcttcactaacaaagtctggaattatcctttgggcaaatagaagttttctttttgctgttgactgtttttgaaaattagattcttaaataattcctgatatgttggcttgaggtagtaggcagttctcccaagtcctagaaacttgactctggctgccaaggagactaggattgattacgaaggaattaaaaggaataattgcttacatagggcttactaagtgccaatcacgattttaagtattagacaaatattaactcatttagcccttataataaccttgtgaagtgagtattattatctgcattttacataaagaaaactgagtcataggtgaaataacttgcccatggctacaaaattaatacatgtttgaaaagggattctaatcaggaaatataactattgagtctgaactcttaatcattaaagtaaagggatagtgttttagttgggtccctcagaaacagattgtgattaaatattgaatgtacctagtttatctgggacatgtaggggggtcacaggcaggggagacaggaggtgataaaaggagagggagcccaccagtgagacatatgttagtaagccagataccaaggtggtgaactgaaagttaaccctgcaggtaagctctgagatcaatgtaaaatgcacacctgagaattattcctgccaaggagtggaggagctgaggtatttatactcctgtgcccattagtcatctttcaaaggctattccagggcagaaaaggatatattaactctcagacacttctgacccaccatgcatgctggcaatgtggggtccaatattcagaggggtttctctcctacaaagatgaaggtgctggctattgggattcagggtggctttgcagaaatggtaagaagatctgaggcagttcaggtggagcaccaacatctatatcaggtatgggactcaagtctgtaagttcatagaacaaagtaaagaagattaacaggaactgaggtcctaattcctaaaagcagacaataatctttaaaccaagaacacaatagtatgcaaagctaacatttattgggtactaattgtttgccaggcactttgttaggtgttttgcagtccttattttactgaattctgaaaatgatctagagaggtagactttatcaccccgattttctggatgaagaaactgagatcgagacagtaacatccacaagctagcggagagtgggacctagatctatctgctaccaaataatggttgtggttgttttatgttataaaataaatgatcatttatagaaggatataaattacttgagggcaggaaacaaatctttttatctgtatgtcaccagggtgtacaccaatggttttcaatgtgaagtaattttatccttcagggacaaatgttctctgtttggcaatgtgtggagacagctttggttgtcatgagtgaaggtgagtactactggcatctggagggtagagtccaggggtgcttctacacatcctacagtgcacagaacagcttccttccacacagaattaaccagctccaactgtcaacagcactaaggtagagcaactgatatacacagcacttaacatatagttaggcttaataaacgttagctgaagtctgagtgttgggtggtgaatatgtagacgtgccaccctctgaagggggtggtagggactgaaaatgtaatgatacccacaaagcacttggagtttattatgcattttcatacacactatctcatttgaccattacacaatctcaaaagggtgcagaatttatggtgttatcaacatggaagaaatgaaggaaattaagagctgtgtgtgtgtgtgtagctgctgctcaaacttagctgtttgcctcagactccagggctctttaaaccatcctatacggcattgggatgcattgaaaggtgatgttttgactactaataagcgagagaagcaaagtaggtttgttatggaaaagatgggaaggtgtttatattgggatgcttttggctgcaagtaacaaaaccccaactcaaatttatgccgtcagtaatgaaatgaatttcatttattatgtagtgaagagtcttaaggtatggtgaccctaaagttgcttaggttaactgaggagccatggctttaagaaaaaaaaaaaaacaatttaaaaatgtatttcatccttttttattggctgcatcctcagggtggtgataagatgtgatctagatatgccagcaaccagaaagagacactttcagttttgtagcttcttaagagtgagagaacatttctcaaaaggcctcaatatgacttcctctcatgccacattggtcagaactggatcacgtgctcacccctaaaaccatcactggctaaggcaatggggctatcatattggcttagagcagtggttttcaactggggacaattttgtctttccctccccgaagggtaatagtctggcgatatttttggtgttcacaggtaggtgtttgtcgggagatgctactaatatcagcatgtagggaccagggatgctgtaaaatatcttacaatgtacaggacagcccacccagcaaagaaacaygatctggtcagtagtgcagaggttgagaaaccctggcatagggcaaaagagatttaatcctgagcctcctgtaggcaagtaagcacttgaacaaaatgaggactccatcagcttggaaaagggtggcatggaagttgggtggggcaccccaagatgatctgcttcaggaggactttgcacatttttgatgactgatgtcataggagacaaatacagctcttttctgcaaaacgtttctggatgcctctgtcagacagtgccatggccagaatgggccattggtctgacccagtctggcatttcttatcttcatcaggctcactgccaaaccccgaggataggttgtcacctctggcagaagatcagtcaggattaactgatggtgaagctgtgtcccactttgaacctctctctcacgtagccagagcagtgcagattcggagtcttaggagcagaacattcgggagccagtgcaaaaaaaaaaaatttgcaagaggcctgagagagagcctgctgtacaaaaggatgtaaaccagccagagacccttggtaaacataagaaggaagaacatatttaccttgcttctatttagggaaagaaaataatactttcctgaaggaggccatctgtgttcttaacaatagtgcttggcagttttgagctcgtgggatacattttcctggccagatcttaccagaaatccttgaatcatgtctgcaccctggtgatggaaggcaccaaggaagacttcggccaattggcaaggaactgtcaccaacttgaagaagcctatgacatcaactaaagatcctccccatcaaacattttcaaaagaatattttgaacaggcacaggttttttttctttgccaggtgataatgtacggtaaatgttttattcaaaagcagtgtctttgaattgctcaataattccctggtcattgattagggaatagtaacacatttaacccttgactaaatagatcacagttgtcacacatttatctacaaatatttgaatgctcgccttgtaccctgtgatttatgttagagataagaatggtgaaaaaatcaatttcttgcccttggtaacttacagtctaaaagaggaatcagattcgaacacatgattggaatgtcgtgggatgagagctgtcataactgttgtaggaacacagcagacgtaggctatcctttgaatgataaacgtgtgcatccctttcataacatttattgagcatctagtatgaaccagacattggtgcttagggaatttttaacacatctgattgtctaaaaacttttcaaaagcaaataatcataaagcaataggatgtatattaaagatatgtatagaacacaatgacagcctagatgaagaatgacttaatttgggagttagggagtggcattaggaaagacttcataaggactcagcaaagacatcaacagaggaaagaaaaagcataaaggagggcaggcaagtcaaacttttctgtgcagcaaaaagccatgtacacatgattttaaaaatgatattgtaggccgggtgtgaaaaaatattgcaggccaggtgtggtggctcacacccgtaatcccagcactttgggaggccgaggtgggtggatcacgaggtcaggacttcaagaccagcctggccaacattgtgaaaccccgtatttactaaaaatacaaaaattagctgggcatggtggcgagackgaggcgggagaattgcttgaaccgggacctgggaggcagaggttgcagtgagccgagattgcgccaccgtattcctgcctgggctacagagtgaggcactctctgtctctgtctctgtctctsyctctstctctctctctctctctctctcwatatatatatatatatacacacacacacacacacgtatgtgtatatatatatgtgtgtgtgtatatatatacatatatatgtgtgtatatatacacacatatttatacgtgtatatatatgtgtgtatatatatatgtgtgtgtatgtatatgtatattgcagcccccttccattgatcaagcagtgggcaagtgtatattaagcatcaaatgctgtaatatctaggctcaggggctgaacaaaaggagtatttggcacaggagtttgaccttaagaaggaggtagcttggctgatgggggcaggttaagatgcttgaaacaatttgaaaacccttcagcactaagctgtgtggttctggttatcagtacagtgggggttcagagcagggagccttgactgtgggctagaatggttgcagaagcttccctagctgagataattgaaagttggtggcatctttgtaggatactgagaaacaataccatatatagtgagaagtggaaaatcacatcaagacctgtcctgctttggaaggcatcatggcagaggataatgtttagctccacaaaaagataaggaggtagcgagtgagcatttaaagtttgggcttgctgctgatgtgatcccggctgcctttctgagcaaatcctggggtgctttcttagcgtgccactttgatcatcagcctggtgggttggaacgaatgtcaactttgagttcaaaggcctgtactgaatcctagcggtgcctctcactagctatgtgacctaggaaaagttanttaacggcatcaagcctcagtttcctcatctgtaaagtaggggtgataatatctaaattgtaggatactagagagattagaaagaatctgtaaaaagtgtctaagatactrccaaatgtaaaatgcagagagcccattacaagtagctccttgaatgagttggggtatgtttagctgcaagtaattatgagaaccttgactcaaagtagmttatacgatgtataaacttattatttcacatgaccagaaactctgamgtagatcaaagttggggactgatggattcagtggcccagtggtatcaacaagaatccaccttcttcccttccgtctgttctaccatccttagtgttgagtctactcataggctggttccaaaagggttcctgaagtttgaggcattgcatacagacacaaatgtggcagaagagagattttatcttcctatggcccccttaggtgtgagttagtaaatgtttccccatgccgcctccatcccaaccccagcagattcctcttaatatatcattgtccgggattgggtcagcatcagaactatgtactgatggctgtgttgtgtattagttagctattggtgcataacaaatcatcccaaaacttagaagtttgaagcaacaagcatttattatcttactgattatgtggatcatattcgggagcaacttagttgggggattcttgcctagggtctcttgtgaggctgtggtcagtacattggccagaggtgcagtgatctaaaggctggactgaggcnggaggactggctggcatggatggcttgtttccgaggctgctggcagggggcctcrtttattgattttgagaacctctccgtggggctgcttgaagtccctcatgtcatggcagccaacttcctcagagtgagtgatccaaaagagagaaggcaaccacattgcctttgttgatgtcatctcagaaatcacactgtcttttgtcccccactccattcatgagaagagagttgccaagcacacagggaggattaagctttaccttttgaaggaggggagtattgaaaaatttgcagacatattttaaaactaccttatgtgtggtacaacagaaattccattgttatctggtggtcagggggtggagtgctttttttggagccacctacaaggtctaccacactattgctattaatcacctaaggaacatttatggagcccctactgtgtgcaatcattgcacaaggaggactcagacatgagtcttgctaattatggtgtaaagggagtgtaagatgcaccgggactatattgcgatatacaaagctgaatgtggaaaggaacaaataaagtaccagggggtgactgcagattgcagaaggaggtggtttacttccaattagcatattcatggaaagacttcactgagaaggtgggctttgaactgagctcagcggagtaggttggatttatacactcaaggatgggtatctgggttggtcaaaagcatggtcataccaaagttatcagctagcaattattgagcacctagtctgtaccagacactgaacatatattatctttaactcttattgcatccctgggagacaggcaatattactcccattttacagatgaagaaacaagcccggagacattaaatgaccccgtgagaccatgtagctaggaagaggccccactcagagcccttacctaagagatacttgtgttttaaagaactgaggggacaccaccttgccttaaggaacttccctagcttgttcaaagtaaggcttttatataacaatttagcttcagggagtaggtacagcagaatgagtaatctctttacaaaagaatttgtcattttattgaacctttacagaagattctccttaattatcaagcccacaccccacccaatacattgaaaatatgattcaaaatttattaagatttactttgcacatctttccccctggaattcctactctgcgttataccttttgtaggctgggttgttggaagaattagctggtaaaaatgagcttacgaaaatgggaaggtctcatggaagaagtgaagtcttacacattcccttcacttttttatgataaaggtgataagattcattaaagtaaaaagacattaattgctgctgattaacatctggcactctacccactcagaccaccacctgtgtattggaggtgagggggtgccttaacctgggttactttgccagggggctttgatgtcaggtggaggcagagaaggaagggcttaggataagcacagagaaagccacctcttccagcctgcggcagaggggagtgttcctggctggggccgctttcgcagagcatagatacgacggctcatcggcacagctctgacctgccagcctcccccacagctgcctccagcctccagagcggcttattcaggaacagaggcagatgcagtgtcggagcgcagctgcgtgagggttgcgtgggtgtgtctccatgggagtgtgtgcagtgtgcctatggtgtgtgtatgtgtggtgtgaatgtgtaggtttgtgtgtgcacatgtgagtgtgtgtgtatttgtgtgtgtatgctatgtgtatttatgtgtgcgtagttgtgaatgtggtgtggatgtgtgttttgtgtgtgtgtgtgtgtgaatatgtgggtttgtatgtctgctgtgagtgtgcagcattatgtggtgtggatgtgtgtttgtggtgtggatgtgtggtgtgaatgtgtgttcatgtatttgtgtgtggcgtggatttatatttgtgactgtgttcatgtatttgtgagtgtgtgtggtggtgtgtttgtgggtgtatttgtgtgtgtggtgtggatgtgtgtggtgtatttgtgtgtgtggttgtggatgtgtgtggtgtatttgtgtgtgtggtgttgacgtatgtgttgggtatgtttgnnnnnnnnnnnnnnnnnnnnnnnnttgtgtatttgtgtgtgtggtatggttgtgttgcgtgtgtgtgcagtgtatttgcgtggtgtggatgtgtgtgttgggtgtgtttgtgggtgtgtgtgcactgtgagcgtgcgaagttgcgagcgtgtatgtatagtgtggatgtgtgtgttgtgtatttgtgcagtgtggaggtgtattgtgtgtttttgtgggttgtgctgtttgtgggttgtgtgtgtttgcatgtgcgctgtgagtgtgctggattgcgagtgtgtacctggtgagtgtgtggctgccgcacccctcctctgagcggtgtggaccaggactcctctctctctctctctctctctttctcccccccctccccctccccctccccctccccctccctctccctcccttgcacatttgctcaggctcctcattgctgagggagggagggggcttctgcccagcacctggtccttcgaaaggcccctcccaggagtagagcgagcagaggccccgctcccgggtgcggaccctccccgcgcagaccctccccgcgcccaacgccaccggtccctcccgctgctgcgcagtcctcgctgccctctgttctgtaggtggcagccttggtaagccttgctcccatcctgcccctagggagaggagcttcagcaaaagacttagagtttagcgtctcgattttcaaacaaacaactctatcttttacagtttaaaaatgaaaacagaagatccagagaatgcgcttttaaacaaagccacatttacctgagaccctggggatagagagcaggtttttggtgcaggtttggagtgcagttcatccctgcccccgctacgaatgcacattcgcattcgcctttgagtcgtgagcaagagagcatctgagaaaacacgctagatgcagccaaacctctttaaaccctggcaccaaggaacaagagtgggtcccccctctgcctttcttttccactcactstctatcatctagttgatcaacagacatcagtggggacattggggggtgggaggggatgtctgctccctgccrggcgggcactgtgctagcgtcaggggcacaaratagaagcagacctggtttcagtctgatgtgggaaagagctaaagtaaacacgcagtgaatttgctgctgtttgggggatgagggggccagggggcttcctggaggaggtgacactgccctgatttttgaaggactagttgsaattatctaggccaggggacatttggcaatatctagggtgggtttttgttttttttgttttgttttgttttttgttttttttttgagaaggagtctcattctgtcgcccaggctggagtgcagtggcgcgatctcggctcactgcaagctccgcctcctgggttcacgtgattgtcctgcctcagccaccctagtagctgagactacaggcgcctgctgccatgcccgggtaattttttttgtgttttttatagtagagacagggtttcaccatgttagccaggatgatctctatctcctgacctcgtgatctgcccgcctcggcctcccaaagtgctgggattacaggcgtgagccaccgcgcctggccggcaatatctaggtttttctgttgtccaaactggggataaggtggagttgctactggcatctagtaggtrgaggacagggatgcttgtaaataacctacagtgtgtgsaggacagccccctccaatgcagagttatccagccccaaatgttcgcagtgctggggttragaaacacaggtctagacaagaggaggaaaagtgctgtggtttgaatgttagcgtccccctagaattcatatgttgaaatcytgatctccaaagtgataggctgaggtggggtggagcctttgggaggtgattaagtcatgaatgggattagggcaagccaggcaaggcaaaaatctctagacccttccactgtgaggacacagtgagaaggcagtgcctgtaatccaggaagctgaccgtcaccagacaccgaatatgctggcaccttgatcttggacttcccaacctctggaactgagagaaataaagtctgttgtttttacgcgcagtttatgtgttttgttacagcagcctgaacagactaaggcagaaaagcattccaggggattatgatgtagactgggaggagctgcagacagctgggtttgtctggaaggactgctgggtgtgggagagggcttagaaatgggagtagagccaggcacaatgattcatgcctgtaatctcaacaatttgggaggctgagacaagaggattgcttgaatccaggagttggagagtagcctgggcaacatagcaagaccctgtcactgtaatacaaaaattagctgggtgtggtggcatgcgcctgtctcagatactcaggaggctgaggtgggaggatcacctgagtccaggaggtagaggctgcagtgaactctgatcactccrctgcacaccagcctgggtgacagtgcaagaccctgtctctaaaaaataaaaaccaataataaaagaaataggagtagagaagctgtcagatggagatgaatgaagacccttgaatatcatgctaaggggtttagactttatcttagggaaggggaaacattaaagtgttttaagcaggttttaagtaacttagtccaatatactttttagaatgatcactctggataatgcrtgtcgggtgcggtggagggtggcagggctgcacacggcggggagaggcttcaaatgcgggctgttagtrcatgcaagcggagaagtgatcaccatgtttccacaaaagaacttagaattggtttagttaatgcagtgcaatggaatgcagttatacaacagggtcgtttttatatttcaagaagaagaaagcaatgggaagaaaagcattagggagatagagttttgcatggctgccgtgccctttcatttaaatgaccgaccaggtcagcatgttgcataaggacacgggcaaattacttctgctaaccgaggcggaactctctggtagcccaaattccagtgctccatccatccagggaggtgtctatgagatgacaggtcatcaaggcaaataatgagttgtttgtctccacggcatggatcctcctgggatcagaggtgtcatctgacaaggcatcatgggctgtatcccccaccaaaacaaaatatatgttgaagtcctaaccctcagtacctcaggatgtgaccttatttggagagagggtctttacagaggtaatcaagttaaaaggaggtcattagtgtgagccctaatctgataagactggtgtccttataaaaaggggaaaattggacacagaaacagacatgcagagaggagagatggtatgaagatgcatacaatcttaaaaaaaataatactggccaggcacggtggctcacgcctgtagtcccagcattttgggaggccgaggygggcggatcacgaggtcaggasatggagaccatcctggctaacacagtgaaacgccatctctactaaaaatacaaaaaaaaaaaattagccgggcgttgtggcgggtgcctgtagtcccagctactccagaggatgaggcaggagaatggcgtttgcaatgagcygagattgcgccactgcactccagcctgggtgacagagtgagaatccatctcaaaaaaaaaaaaaaaaaaaaaaaaaaagaaaaaaaaaaagtaagtactaatatttttattatggcataaatagaacaccatctatgagccaaggaatgcctgaggctaccagaagctggaagaaaggcatgaaatagattgtccttcagagactccagagggaaccaccgacaccttgatcttacactttcagcctccagaactatgagagaaaaaaattatattgttcaagccaccaagtttgcagtactttgccacagcagttctagagaactaatgctaataccaatcacacaaagtgattgaaaaggggagaagtcctggtgaatttcagaaaaacccctgatctcagttatgcaagtgagatcatcaggggaatctgaatcaatcatcgtttttacctgaaagcagtaggcagaaaggaaattaaattccatagaaatccattaatcgtgctgggcatggtggcttacgcctgtaatcccaccactttgggaggcccaggcaggcggatcacttgaggtcaggagttcgagaccagcctggccaacatggtgaaaccccgtctctgctaaaaatacaaaaattagccaggcatggtgrcaagcacctgtagtcctagctactgggaaggctgaggtatgagaattgcttgaacccaggaggcagagtttgcagtgagccaagatcataccactgcactccagcctgggtgacagagtgagaccctatctcaaaaaaaaaaaaaaaaaaatcgatcatccagtgcagtggttctcaaagtgtggtccctggaccagcagcatcagcatcacttgggaatgcagattcttgggcttcccctgagatctcctggtcggtgactccagtgggtgatgcccatgcacactcaagtttgaaagcccctggcctagggtctgtgagaccctggagaagtcaggcagagcttcacaggggaggtgacacatgagatgtgccttgagggataggtaagggctttgaaaggagccagggaaggacatttgaaatggagcagaggcagggagatatagatgtgtgagacttcttcagaggagcagtacagtttggagggtatatggagaggagggtgagagaaaggaagtacagacacatggtgggcagtgaggatgggtggggagtggtggctcacatctgtaatctcagcattttgagaggccaaggcaggaggatcacttgagtcttgacatttaagaccagagtgagcaatatagcaagaccctgtctctacaaaaaatacaaaaattagccaggtgtggtgacgtgtgcctgtagtcccagctactcaagaggttgaggcaggaggttcactggagcccaagagttcaaggctgtagtgagttgtgatggtgccactgcactccagcctgggtgacagaacgagaccctgtctctaaacacgttaaaagaaagtgaagatgaagtcaaagatgttgtcatgttgtaaaggatttgtgagccaggatgagtttatatttaatgggggccgctgaagagttttagaaagattactgtaggctaaagtatcaatgtgtaatttgggtatatgtgtgatattcaaattagctgacctattaggactgtctcagccaacaaatcactgaatgcagacagtcaaccatgctttctgaaaatgcaaagtcctagtggttcttgagatgagtggaggggtcacaccaatgtcaggagaactctagatttggggaatctttaagaaagccaaggaccagtaagtctcctgaatagatagaccagttttcttccacctgggactattaaagatgagtgacacctttacctcttgaccttaatcattcattagccagcaagtcaacatccttctcaaagtgtggctccatcagttctgagccagttttttttttttttttttttttttttttggcttttttttgacgtggggtctcactcttatcgtccagcctggggtgcagtgacacgatcttggctcactgcaacctccgcctcctgggttcaagcacttctcctgcctcagcctcccgagtagcagggactataggcatgtgctaacattccggctaattttttggatttttagtagagatagggtttcaccatattggccargatggtctcgcacttctggtctcaagtgatcagccttcctcagcctcccgaagtgctaggattacaggcatgagccaccatgcccggccctgagccagttttgccccaagttgctaagcttccctgatcactgaccagtctgaaggcagataaacacaaagcctttgtctatgggacacttatgatttggttgcagagaaggtggaccttcacactgccaatctcagttctcayggccgcctggcatcaggaaggcattaatctctgccaaggctctgtcctcttcacctttcagcaggtgttccttgctggttgtttggcccggttgataggaaaaaaagaagagagagtgggcccgtgtgcctctgtctcctctttgctcaatgacccaagaaggcaggagaaggaaggcacttctcagctgcctttcctatggttggctgctgggctgggatggagctggggaacttacctcttgtgacgaacgatgaagaagcagggatttcatgcagcatcagcatacgcacaaggctgtgttgggaagaacaaggacagggctccagagaggactgactgcagctgcccctttaatgctggtcgcacatgcttgcttctgtctggctcccctcccggactgcatggatagctttgttcacacctgaatgcctggtgcctgggttccagaaaggcatagctttcatttctgagcattttatatgtgccttgagattaaccatcaccatgaacagatttggaaacaggtttggagggattacgagacttgcccaaacacatttagcttgatggggagaagatcatggccctgttctaacccctcactctcagttttgtttcatcacatcatcctgtttattttcatcgtagcttgtatcacaattgccaattttcttgcttgttgttgtgtttagtgtctgtctacccctccaggctctgggtttctgatagcggcacctgtgtttcctgggtttaccttggtatcctgagttggtaacacaggcccatcatacagccaaagctctacagtgtttgttaacaaaatgaatgaatgaatgatttgaacccagacctatttggccaaagcctcactctgtaacctctgctcactgcagagttccatgtggtacaatcttgcttggcaaatgttgatggaattataacagttcacggttggtaggtgggggtgtcagatacatgcatctgggaaagtcacagaaattcaccccaatataggtataatcacgtgcccaggaatgcagggcaaactttgcccacaggtgcaaaccagctggggcacctgtggtatcctaggagcctggtgtgcttaaaagcatggtgtagtcatgggttcgagaaactctccactgggtaaggacactggatatatggacacaagaaactctycattggntaaggacaatgataaggaaactctccattgggtgaggacactgaactctttcacatgagcagagacttatgttaggagttgcagctgggagtcaggcagaagctatgatgaaagctctctgggcctcagtttccccatttgttgtttggtgtgtgttccaccactgttgtttaatggctcagagtggagaccggcattaaactgtgttcgttcaaccctgaatccaccactttctaggggtgtgcctactggaaagttttcattttccttggtgcctcagttcctcrtctgtgaaatggggataatgatagtatttacctttgaaggtgggttgcaagggctgaaagttaatttatataaagcacttggaacacatgstaaatgtctggctgttttgatgagaagattcaatgagatactgacttttcataatgcaaaaggcgctaaaagaaactcagcagaggtggcatttagatcaaggtatctctgtggaaggtatcaaattagatgaaaggcttagaggtgggtagacccacatttaaaaaaaatcacttaatttgtacagtgtgcgccaattgttgtttataaaatatcatccattttatgtcattgaagtctcccatgtctctctggcatagccatcgttacccaaggctcaacaagcttgaagtagcttgtttgaaggtcacagctctttagttatttgttcatggatttcttgaaagcctactatatgctaggctcagcataaaatggggtccaaaaccaggtgctgtttctgctcatgtgaatctgacagtctagagaaggagggacatatttcaaaaaagtatcatgcaagtaaatacgatgcgctgtaataagtactgtgtgacccacccaggaaggtcagagaaggttccctgaggacatgggctgaaactgagatgtgaagactagggtgggtgacagagggaagggaaaagcattgcaggaagtggaaagagactgggcataggccctgtggccggagggatcatagcaaatgtctggtctgaaaaaaattgcctgagaagaccctggtgcttggagggtaagagtgaaggaggtcagagcagaaccgtgctgagaccctcaggccacatttgggtgttgcatctttgntataagagcagaaagaaaccactaaagattttaaagccagggtggatggtggtgaacatgagatttaccttccagaagcatcctctggtggccacgtggagaactggctgcaggggagaggagtgcaggcagtaagttacrgttgctaagaaacattcaccattccatgggtaattattgtgcaccactgtctacgggctctctgctgggtgccaggaacgcagcactgaccacgacaaagcccctgccttagagagatgacgtttctgtataaggacagagacggcaaatggacaagcaagtgaatgaatgtgncaggaagcagtgtggctgggaagaaatacttaaaagcagggcgagagactagagcatattggctgccatttaggcaggaaaaacctcttgtgctgacatttgaagtgaagggacacccatgtgagtatctgggggaagggctttccagggggcagcacagcaatggcaaagaccctgaggtgggaacaggctcagggtattggaagaccatcatagaagtcattgtggctgcagagaaggattaaaagaggcagattgtaaaggccacattgaggatttacgtattttatttagagggtgagaagaggccattggaagccagatctgggaagtgacgtgaactaagtgcgattccagcgtaggcttcttctcttctcaaattctggcccccacaccactttcccgagttcagatttctccctggcctcatgatagtagtatttttaacaagtcagcagccagtatggcagagcctaccccctagatggtgcatgagacataccaaagaagcttcacttttcacttttttagggcaacaaataatacatctatttattgctttttccactagaatgtgggcactttgacagcaattttgctcactgctgtatctctgaagccttaaatagtatctgagattgtagctgtcgataactatttgctgagttaatagatgatcaccctgcacttaagtttctatgtaatgactcctggccagagagcagagattcagcaaagaagaaggtaaaaagaagggaaagatgagagaggcccctttataactcatcaatgtaaaaaacacaaaataaaaagtcttgagcttaagagagaatgcagtagaaaacrtcaacaagaaaacctttctgtctgaaaacgcctgatccttgtgtgagacctttccaggatatgtgggttttcaggtagcatcttcacccccagggcaacagtaagtgcaggcaggagaccaaaaccaatacccttgccctcatccccatagcaggggtgaagtctgagcacgtgactggacacagcagccacacgcctttggtgtcttccaaggaggcagtgtctcacctgtgcacatgctattcatacaaacacaacatgatctggagcagagaagggcataggaaactcagcaggggtatattatattttctgccagaactgacagtaatattgaatgatgagagaaatgcagtaatattgaaggacgagagaaatgagagttgtataacatttaatgattttttttwwaaaaaatcacccaagaacgtgaagatgatttgaaacgcctctgaaaatgatcccttcctgtccataggcagcccagcttgcacatagcccgtgcttgctttacacaatcagtgataaactttgaagatgctgcagcctccattgagtttctttttgtatatatatacttttatttatttatttatttttttggagacagagtstcactctgtggcccaggctagagtgcagtagcgcaatctcagctcactgcaacctctgcctcccgggttcaagcaattctcctgtctcagcctcctgagtagctgggattacaggcatgcagcaccacacctggctaatttttgtatttttagtagagacggggttttaccatgttggccaggctggtctcgaactccagacctcaggtgatctacacccccttcggcctcccaaagtgctgggattacaggcgtgagcattgtgccaggtctgagtttctactttaattggctgccttaygcaaaccatgaagaagcccctgcatgaataaggcaggaaactttttagtcccagactaggtgagacatatgccgtatccccaaaataaatgttggggcattaacttttaattgctgcattatgttttactgtttactgttttatacagcattcttgttcttttttttaaaatactgtttttcttttgagtctacgtgactgcagcctttacgcctctaatcccagcacttcgggaggccgaggcgggaggatcacctgacctaaggggtttgaggccagcctgaccaacatggagaaaccctctctgctaaaaatacaaaaatttgccacgtgtgggtggtgcatgcctgtaattccagctacttgggaggctgaggcaggagaatcccttgaacctggaaggcggaggttgcggtgagccaagattgtgccattgcactccagcctgggcaacaagagcgaaactctgtctgaaaagaaaaaaaaaaaagtgtgtgcaattggggtggggaggtatagtgctcttcttgtagactctctctcccaattttccatagataaatggattcagtggggacagaaagagggccactccagctctggggagaaatgagagagttgggaaagtgagatccctctgcatttggttgtggattattaggagactaagaaggaaaccaaagaggactccccctttcctatattacttgattaacattagctataataacaaataattcctgcaaaattttaatgccttagcacaagatttgacaagctgtggttctccagcccaatttgggcccttgtttgtttttgtnaataaagttttattggaacacagccacacccatttgtttacagatcatctaaggaagcttttatgctatgataacagagttgagccattgtgagagagactgcatggcctgcaaagctcaaaatatttactctctagctctttacagaaaagtttgctgacctctggcttaacaataaagcttactttttgctaacctgatggtccnatggtgggtattcctggggtcagcaggcagcttctcttcatgtggggatttaagaastcagtctccactatcttgtggctctgccatcttctaataacttaggattttctgcaagcagccagaaaatccaggaancaggaaggagagaagaaagggtgtcctatctctccaaaactctggcccacatcctgttggatgaacgagtcacatggctacacccagatgcagaggtgctgggaagtgtccatggctgggcagctgcctcccagcgacagtgccacactgtgtaaatgggagcacacattcattttggacctgtagccatcaccaccatgctctttccctactatgccagatacctgcatttgaatcatggctgtgccacttactgactgtgaaacttgggggaatttaacaaaacactctgtgtgtcccaggttgctcgtctttgaaatgggcacaatcacagttcctgcctcatagagttgctgcaagcagtaagtgacatattatttactgctcaacacagacctggcgtggggcatatgtagaacatgtgtcactgatcaaggatgatgtcggcattttcagtgactagacaaaaaccagaggcactcggcaacatccttcagagcactttgtaataagtccccaacctcccgcactgttctgtgagaagccaggtggatgtaggagaggttccctggagagattagtccaggctaaggcagtggggacagctcgagggtggaaagggaactctgcccaaaagacaagggtgcttttcggaatgccttggacgagggaggagagaggaggagcacgcagggcagaggaagcacttggttggtgggtgcagcatcatctctggtttagtcctttactgcatcaacattgccttgcttgtgacgagtaagggtagggacagcttgtggatgggaagtcgcagaggcaccaggccagcccatgctgaaagctcaccaactccagcactcaccagcgaggactcctcatgtctcactgggttccccttccatcatcagaagccaaggatgtttccaaaatattccatcgatgtccagagcagcactggaaggtagtaagagcaggatttgtcatcttattttgcatatggctagatggaatcactgagagacacaccaacctcactcagctagtaaatgcagacccaggatgggcagccaggctcctatgacgctgtggctgtggatgttgcttctgaaacaaggcaggatgaacgttccttggagcactggcagggggggacattcactatattctaacgttaatacttgggttktcttgatagctgagatgctaaactttgctgtgagagcttggaaaagtctgttctctctgagcctcagtttcctcatctgtaatatgggcaactcctttataagatcccttacactttatgtggatgctaggtgttggggagggctataaacaacttattttctcatgtaacaaatgctacttgagccttcaatgggctgtgcatgctggagatacagcagtcaacaaacctgtcttctttgtgtgaggagaggccaacagaaacataacaaatatttaatgtgtcagctgataataagcactrggcaaaaagtggattagggaaaggcaaaaggaagcccttgggtggtggtgcgatggggttttgatttgaaatagagccatctncacgggagggtccacttgagaacaggcaggtggaataggagagaacttgatcgtttctgtgattgagaaagagaggggactggaagtgcagttgttcctgaggttcgttcacctgaatctgaaagcacctgatttcaagttctgcattgttttggggtgggaggaagtgagagaaaagcagacctggttcttgtttggcgtgtttctcactgagtggagctactaggctttcctggggccattgttaagagctgccatggcccatgtctgctggtggtggtcttctttccttgttctctgcagtgccccccagcttgactgtgcagtgaatggagcagatccatgttcttcagttgacagaaagggagagttagagatgaacctaatgccctgcttaaatcagagggcgaagtgatatgaagtttnaatttaggaaggactttdtttrtctctctctaatggcctggagatatcctacaggctatgctgggtactttgcatagactaccttcaagatgcagagaaaggaaatgcatctaatgctgttagtamcaataataaataatagcaatagattccctgtacatgctggacagtgcaccaagcattttattttatttttcacaataataccatgaggaagctactttttattactcttgttatacagaggagcaaactgagscttaggaaggtgacgtgacttgccccaactcatccaattagtgagaacctaagttgggatttgaatttggctctcaatctccaagcagtcatgtgtcmaagtggttgccactgggtgggggattctggaagtcctttctgtgtcctcatgctctagatatttttttatttttttctgtagtgagcatacagagattctatggccaggaggaaggttgggctgagaacagtgatgatgtagccagacagtattgtgtgagtcaaagaggctgccttgaggttggctccaggaccctggctacgaagctcgctgtgcctgacttcctcaagccacttgcctcccattttttctttagaggaaacttccactgcctcggatacataangtcattgcaatcctgtctaaagtctggcctccagggtttgcagtaagatttctctgaagcaaggctgcatctctacccatgagattttgcatcccctagcctgcctgtctctgccagccgatatagggaggcaggggatggctcacatcagtatccttgagtggaccccgctctggtgtctttattttcatctctgggaaaaagttatattttccctggagtcaaatgaggcggtattccagcctccttgcttaaatatatctcaaaggttctgctgtgtcaggcatggtgattcacgcctataattccagcacttagggaggccgaggcaggaggatcacttaagcctaggagttcaagaccagcctggggaacacagggagaccctgtccctccaaaaaaaagaaaaaatagycagatgtggtggcataggcctatagtcccagctacttggaaggctgaggcaggaggatgcctgagcccaggaggtcgaggctgctgtgagttgtaattacaccactgcactccagcctggatgacaaaacaagaccccatctcaaaaaaaaaaaaaaaaaaaaaaagaccctgctgcktccctgatctggcaaattaaaaatataaaacctttcgttaaaccccagagccacgagtttcctataagcatgrtagttttatgattcagctgcaccattagtaatctccagtcttcttagcccctcccatctctctgccacctctttcaattttcttctttactcattcctctcttctttcctcctctcttttcctctccatctcctctcatctctcgattcctctctccatcatmctctcttccctcttcctcccttccctcttcttttctctcctctctgactcttccatgacttatctccatttcaactatgctttttttaaaaaattcatttaaattttggattattttgtgggaggctctgttttgaatttagtgcttattttatttgctcaaaaaatgagcagccagccaaccaaatagccattctgtgtctacttgtggtctctcatgccatccaacagctcttacttgatataattgctaagcagtgagaaagctattgtgcctacctcttcagtgaggagtgagtgggaagttatggctgaacgtgggctttctctatgttgtttaggcttctcatcttgacactacactaaatccatggcttgaatgggtctgcaaaatgagagtctctaaaagccagacccatcttggcatatcttgtgatctctaagcggcaatgggagacagagaagacgtggtaatgacatagtttagctgagactgaaacatagttttgcttaaaactgtgcgtgacattggctgggcacggtggctcacgcctgtaattccagcactttgggaggccaagacgggtggatcatgaggttgggagtttgagaccagcttggctaacatggtgaaaccccatctctactaaaaataaaattagctgggtgtggtggcacacacctgtaatcccagctactcaggaggctgaggcagaagaattgcttgacccaggaggtggaggttgcagtgagccaagatggtgccactgcactccagcctgggtgacagagcgagcctccgtctcaaacaaacaaacaaacaaacatgcataccattaatgagaccacttgtgcatcattagtctgcaatgagccaaaaatccaaatgaactggtagatagctgatagaagcctcatgggctcgatttgagcccttgtgtgtcctagggagaggtgaatgccatggttcttaagaacatgtctttggattcgaattctggctctgaggacaagctatatgacctcggatgagtcatttaacctctctaagccccaacctgttcttctgaacaagaggcacaatgacagtttatggggtggattaaatggcataatgtgtgatgtacctggcctaaggtttatgcttaataaatatgtgtcatcactgcaatgttttgggatgttttctctgtatgtaaaatggtgcccatgtccacctccctgngctattgggggattaactgagacactgcatgacaaaactctttggaagtccagtgcaaatgagtggacttgtgacctctcacattatttctgtttgtaggttcaactggcaagccaatcatgctyatttatagcgacacgcastgaaaacttttttctcacaagaggttattgaaccaagatgagaggaaataccaaggctctttttggtgttttaattccttcacatctatttctttcatcaccagttaatgaggacttagtactcacatcagcagtaagagtagaaaatgggctcatattggtgttcgaatcctgatgtgttctcttactggttttaagatttgtgccaggttactaatcaaatcttaaaccttagttttctcacatataaagttgtaattataatacccacttcgaagggtcattgtaaaaaccacacctgaatgtacccacatatatacagacacaaccactaaagaaaatagattatgtaatatttattcaatgtattttacttgtctgttgtttatagagccctgcytcagttggatgagttatttcagatttggaagtgtctcgttctctagcttgggaatgcagctgaacactgggggcagctgtggccctctttttgtttgttgccaactcggtctaagatcagcctgagtggactcagtcggaatctaccatctcaataccaggtggttaatttctcattggtagagccctctttttacaggcttgggaagtctggctgatcatctcgggttgtttaagcaagaaagttaagctatatccccctgattagtaggattttctcctttagattcctgtgttaatctacaaactgagcagtttatccctggtagacattggaataccaggtgtggtagtcatactgattatgcatgtgtagtactttctagtggtgccgttcttagaccacattttcagttcttgagaacagtgtcattgttgkcatttttctcccaaagagctggcataatactcaaaagaaacggggtcttattaagtggttgttcattgactgataggaagagaactgtgggaatatatatttatggaaaaacagttccaaggtattcattcactcattcagtcactaaatacttatttatcatcctcaaaatgtcaactgtgtgctaagtgttcagactggagagaagaataagacctgctatggggaagcactcagtctgaggtgagggaagagagggtgggaaatagactatggtgcagcactgatgtatgttttatttttgtttatgaaatgttgtagggatgtagaggaaaatgaaactagcatcagtgctggactttaaagcgaggctaaacctccacaggtgaaggagatggggaagacattctagacagaaggaagagatttgtagacatgtcaaggtgggacatggaggaacagcaagatgttctgtgtggctgggatggtacacgtatgtgcgtgcttgcgtgtgtgcgtgtgtgtgtgaatatgtgcatgcacatatgcatgtgtgtgactctgtgcatgcatgtgtatgtgtgtgtaaggctgagctggaaatcaaggcttgcattctattctgctagggagtttgtattcacttattcaacacatatttatcaagcacctgctatatgttggatgctgtggtgttttgatgtgtgcctcataatcacagtaaaacctccacaggtgaaggggatagggaaagacattctagacagagggaagagatttctagaggtgtcaaggtgggacatggaggaacagcaaggtgttctgtgtgaggtattatgagataggtattatgaccattactctcattttactaatgagaaaactgaggctcagagaggtgaagcgacttgcccaaggtaacacagcatgatgatccccatcactgggggcagagagtccactgagaagagaagttaggcagatggggcagaatgcagcctaaggtcactcagagtgtcctgaacgggcttgatggacattgactttggcagcctcctcatttgctccagccccactgaccctgtctcccctgacaggggagacaaccccaaggtctcccctgctttggggcatttgcatatgcttttctttccacctggaatgctcttcccctcattccctcccttggctggctatttctcatcattatscatcatctcctgagaaagggcttgcttccgctcctgtcaatcccctcctgcctatctttgctgtcaatgtggatttcagcttccttttttatttcctttttcaaagtctaccattggtaactgkgggaatgtatcacagttcactgagtggcgaagagcttggagtctgcggtagactgctgaggtgagaattctggctccaacacttaccagctgctgggatattgggcaagcccttcacctttctgggcgtcattttcctctgctataaaatgggaacaatagtagattcccctcacagggccatccaggagggattccaggagggcagagtctgacacaacatagatgttcaataaatatgtgttgaatagagccgtcattgascagtccattcattcactacctaggtctcatggctgccttagagctgggaaggtacaggctgcttaggggacccagctgtggtcttccctctcccacccacccagtgactgctctccaaaggctgtgggcttgcttctggggattctgccagtcacctgccccctgaaaggacttctgctgaattgcagccaattagggctgattagatgttaatgagtctgaagctgcttggtaagcggtttagcacaaacttggaggtgagagggagaagtttggggaagtggtgacatcatgcacaggctggagaagtgcaagggcctgaccaagacgtacagcatctcagttgtctgtccagactgtcctgtggctctttatgttggagctggtacaggtaggacccctgctaaacctggcaggggagtagcaatgataataatgatgatcataattatagtaaaatmatgctttttattgagctcttaacatgggccaagcactatgcttggtgctttatatgtacttacttttatcttgtccttacarcatcataggtggcaccatgattatttatcctcattttgcagctgagaatcagaacaattaaccttgtatcgtatagctagtatgactctcttgaatccagagttcatgttctccttagtttttcagaaactcaatgtggaaaattctaattctatatttattgcacacacagctgcagcctgctgcactaaactcccacctcgtattgaaataataacgtgcagaactcccttttatatttattgatcatctacattgtgaaaggtggttttttatgcaattgacttctgaacatcttggaaaaataatggaaaaataatgtaggttaggtatgagaattcccattctccagatgaagaaactgagcccaaagagtttcaatgagcctctcaagtagctgggactacaggcacctgccccacgccccatgccctgctaattttgtatttttagtagagatggggttttaccaggttggccaggctggtcttgaactcctgacctcgtcatccacccatctcagcctcccaaagtgctgggattacaggcgtgagccactgcacctggcccatcttttcatttctttggtatactgtttttttcctnccagctttattgaggtttaactgacaaataaagtggtttgtattcaaggtgtacaawgtgatgttttgatgagtgtgtagactgtgaaatgatnaccaccatcgaattaattaacacatctttcacgactnttggttaccattttgggtgtctgtrtatgtggtgtgagtataattaagatctaatcgcttcacaaatttcaagtgtatantatgatattactaactgtagtcaccatcctcagaacttattcattcaccttataatggagagttggtaccctttggtcaacatatctacattatggccatttctaagtcagccaggaagtcagtgtaagatgaatccaggatcactccttctgactccggtagtcctgaaccctcgctgagctgacacagacctggctgcaatcttagaagaaagcatttgccaaacaaatgagtagtaaagaggcattgggggtacccggcagggttgatttaatctacttgagggcataccgttttctagccttgggtagataaattgtttatgtacaaggaatgctgctaactagaaatgtgttttatcttntcattaaaatgggtccacaaatttctgcttagaaatacaattttagcttccctctttgaaatscttacagattaaacatttcctccttgctatcmttgtgacaatatcttccatttattgtgcctctgctgtatgccagacngtgatagatgctttccatgcataatctaattctaatttttacaacttaataatagtgataattataaaacaatgataaacagtagctttcatgtatcaaatgcttgtcacatgccagacactgtgtcaaatgtttatatcttattttatccttatactcgccacacatgaaggtactgttagtgtccttattttactaatgaagtgttagcagtgaggtgacttccctctttttattaatggggcaactgaggcacagacagatcctgcaatttgctcaaggtcacaaacttacgttgrgattcagttttttttttttttggagatcaacacttccttggacttattgggaaatggatgatcattgttaaaaacacgttttccaaaaaaaatattttttcttgaggtttgggggaacttgggagaaaaagtggggtctgagctgctggcatggtccaaagtcactgaaggcaggccacagccagtgctcagattgggaaggtggagctgtaactctggggcattcttgcttatgacaatgaggatttccaaggtgtctgcaactcagagattctgggacctagagaatcagagcaacstcgggttgggagatgagttttctttcctgctcatcttcatggtgaaagcggagctggggtgcacggtgtgtggggngtgactggcagtgcaggcatgcccagctgtgagtgccgtggcaccaggacaatcacctccctggatagagtttccctcgtgcagcatcagcaataggtggaccagaggttcacccctctctcagcagaagtatcattagtgttgacagcgtgaaatagcctctagggttctctcagccatctataagaaggtcaggctagaattgagctgagagccacacccccttagcacgcagctgctggactcccctttcacgttttggtgaactcttctccaggggcttctgtcacatcaactgcagtggnattgctgcctccagtttgtgtcttctggtgctagcacagaaaccccaccttcttctcttntgtttctggaaaacaccagcctcctcttaccttactgagatcagaattcttataacacccaccactgtttcatcttagggtcctttttcacatacagtcttatggttttctatttgaaatggcccacgtgcatctgctttgcctcctaaacgaagctaaatgtcttctgatcaygtctccttttaataactcatctctttaaaaaagtcatatcatttgattcttctaaatgtaaaagtaactactctcatcgtagaaaattggaaagccacgtatcagggccaggacaaggaagangagattaagaatccctccttggatgcaaaatttaaaagggtgccaaacaattaagttatcaaggtaaataccatttcagtgcaatattttagagaatagaaattaatgccaagaattccatgattaacataataatagaggatccagcagggctgagactaaggttgggcaagtacagtcggatcttgtctttatttcaaattttgatttgttttgcatcattttttttgcattggtttttatttgtaaaaatatcatattaaaatattacttatcttgactgatgagtcatttatcaccctcttaaatgttgcacccaaaggaagtgcttcattggccttgctgtacttgcagtcctggttatgatgaccaatgtatactgagtactcacagtgtctcaggctcattcttatgcttttcttatgttatgcttgttcttttgtacaacccccacaacaactcacaatagctgggaactgttactgttcatatttctcagagcacttagagaccctcagagagtagtgacttgcaattaacatagctcgaaataagccgaacaaaccaagatgcaaccaaggctgtttggctctagaacatgcactcagtctactgtaacctgtgcagaaatgatttcccctcctgccttctttcatgatccccagcccccaggtagtcttctctgactgccgccccmccaagactcatcaagtgccctatcatgctgccattgtagcacttaacaacgtgtaatgattatctattaatcgtgtaatgattatcttaatgtgtaatgattatctgtttctttgtctgtattcctcataaggttccttttaaaaaaatggcagtgtctctatgttcctatggtgtttttgtggtcagaagatgaggggcttgtaggccatttcacttggggcttgatcacctgctcattgtcggctctggactcaaactcatttgccccagtagcagcatgctcttcagaggacagaaagaggsccataggctctgatcccttagttggtaaacaatcatttctctagatctgtgttcatccatcatggcccattaagcagcagtggcctggggccattttccagtgtgactgatgatatttgaagatttggcagaggaggtgtaggaggcttgtcttctgtgccagctccatcctgctgctcatgtgagtgatgatagtggggttggggtggmtctggtctgcactgattggaagtatgaggggtagtgggatggtgcccttgtgcgagtccaggcngggaggcccagagagcaggtaagagagatgtgagctcactttgccctaatgtggagaagcagtgcatgaataatcacccagtgggggagagaaactattgcaaaaacacaactacaataaattcttcgtctctccgttgttatccatttatcctatggacaattactaggcacccaccaggtgtgggatgctatgccagataggaggcacagggctccctgccctcacaaagctcatgatttaatgctaccctttgcattgtccactgagatgggtctgtggttggcaagaggctgcagccccttagcaatactagatgcagtgaatytgtggggcaatagyccttcttttctttcccatgcatgtgtggaaatccagtgtgtatgaagtggagatctgaccccatcttgtttgagctgtgtgctgattgttggatggggtgacagatgaaacatgtaccatgagaagtccacaggctacatgggaaaccaaacaacgctcaggtatccaaagtgtctttcctgactgtcccccactccactgcaccattgcaggctgaattagggggcctcttctctgcgcctctyacattaccctgggtttcccgtgctcaggccatgcctaccacttttttttttttttttttttttgagatggagtttcactcttgtcacccaggctggagtgcaatggcatgatcttggctcactgcaacctycacctcctgggttcaagcaattctcctgtctcagcctcctgagtagctgagattacaggcacttgccatcacacccaaccaatttttgtatttttagtagagacggggttttatcatgttggccaggctgacctcaggtgatcctcccacctcgacctcccaaagagctgggattacagtgtgagccactatgcccagctaccctaccacatggtttaatgaggttctgtgtggctgtccatttcccacactgatggtgaattgcctcattgcaggggctgagttgttgcacctccctgtcccctgcagttgccatcacctcgtaaatagtatgttcccaataaatgtttgctgggggaatgcagccaatgggtgatgaagcaggtgaaaatgcttagaagaaagcttacactgcaatgttatatacatgcaaatgaatctagtgcaaactgcctatcttgcaaaatgattttccaaatgtaagtatgttcagaaatttaaagcgcattcggaatcagggagtctttttttgaaaaaaatatttttgttattattttgcctgagtgaactagttgttgtgtcactgagttaaaataagtcacctggaagtaggtctccaaaggtaggccacaggtctctgtacttagatctgttttatagacattgtggatctttcaagtctttttcttcctctctattctttcctcctacccttagtaagattctagttatttcttttttttcttttcctttcctttctttttctttttttttttctttttttttttttttttttgagatgaagtcttgctctgttgcccaggctggagtgcggtggtgcgatctcagctcactgcgacctccgcctcccggttcaagtgattcttctgcctcagcctcccgagtagctgggattataggcatgtgccaccatgcccagctaatttttgtacttttagtagagatgagatttcactatgttggccaggctggtcccgaactcctgatctcaggtaatctgcccaccttggcctcccaaagtgctgggattacaggcatgagccaccacacctgtccagttatttcttatttaaatgattataacaaccttctaatgncctcctgcttttctattcactcatcctcctgtagatgctaaatwtttttttctgaaatataaatgtcatgttcctattaataacccattacttgttgataaagtccatattgcttaactcactgcataastctctttgttcatggccttctaggcttgtctctctccactctgacctatgtttaaatgacttaaaacggttgtcacttcttgagacaccctcatttcttggtaatgagtttccctttgtctgggactcctgtgccatcctcatctcgttaactcctacttacaccacagaacccaactttctttataatggcattcaacacttggtttcagagtggtccatttatgcctctgtctgtcctgctagactgagtaatctaagggtggggctcatgctttgtttacctatttatcttcagctaccctctgagcctggctcatagtagccactcaagacatgtttgtagaatgaatgaagacccgagttttctaagaaatgtgtacatttataaggccaggagaaaagaacatatagtggccaatgaaatcaagcttcaaatatggtttactaaactagaatgcagggtaaagttgtcaaggtatcctttaagagacatacatactggtcttgcatttaggttataaaatttattctacaagtgccaggttgagaaggggaaggtatccagccatatgaaaatgaccaaaaactggagttttcatttgttctgataataaagcagaatattgacaagtcagactccccyacacattcactcacaactcaccacctacccatttattagctgggctaggctatacaggcttgcactctgctctcacagagcttatcaatctagacggggacacaggcatcaaataacgaagtcacagtaactgtgtgtaattacagacagagctgaatgttctaaaggaaaatatcattcaacagaggagcttgacccagactggtagctggtctgagacggcttcgttgaggaagtgacgcttgagcaagagattacaggcatgagtagaagctgaatcaatagctggatttctaggaagaggaaggaggccagagagagaggtgtgggtcaaaccactttaagcaatttttctcttcaccaaagaaaatctctttgcctggaaaaagattgaataattttaaggagagtttagatgatttgtagttaaaaagaaacacttcagtggtcatggtttcgctgtccttgctcctgacccaggaggatgctggttggtaccaatctttgcgttttagaagggtcagacagaatgagcacagagagaagagctatgattccaggaaggtctcaggaagaaaggcagagggcatgagagagcagtcttcaaacatacgaaggrctgtcctgtggaggagaaacaagagccactagttactgtcccgcagggaagagtaggacctgtgggcaaaagctataagggagagagaaattagctgtgcttgagagcagaccctttgaaatattaaagctctcacttattgggatgatgattaggaaggcagtcagctgccatcatgtggatgcttaaggctggatggccattcttcaggataaagcaaggggaaggctttcgtgggagaggaacagaggaaaaagggcagcctatgggctgaatccagcccatagatacaccctggacctcagaggctgtaaaaatccaatgagtattcacgaaaatatctagggatggatctctttttaaaatccagatttttgaaacttttattttaggtttgggggtacatgcgaaggtttgttacataggtaaacacgtgtcactggggtttgttgtacagattatttcctctcccaggtattaatctcagtactcaaaagttatcttttctgctcctctaccgcctcccacccaagaactggtaaattgggccagctttctagaactgcaacaattgtttgcagttgwtacatggtgtattagttgcctattgctgaaataaattaccgyaaacttactggcttaaaataatacaaatttattatcctacagttctgcaggtcagaaagctgaaatgggtctcatggagctaaaatcaaggtgttagtagggctgaactctttctggaggctctaggggaagaagctgctttttccttgcctgatttccttggctcaaggccccttcctcatcttccaaggcagcaccagggcatcttcaaatatctttctcagactctactttcaaatgtcctttctccccatctcaagatctttaccttaatcacatctgcaaagtcccttttgccatgtaaggtaacatattcacaggttccagggattaggacatggacacctttgggggccattgttctgcctgtcccacatggccacccttttagaatcgattgaacaaggtttacattattttctttacctgcttctccatgctagatgttgcatttgtgattcttgagttaaagggctggtctggataaccattyttcctgtggttatcctataattagaaatgaaatttagcatatgagggttaaatgcattaatacaaccctttgaggggctggagatcaggtataaaakgtgtgagaaggaactttaagttctttaaaagtgatgcttttattgtttgcaggatgtcacataatcagttcaattcaacattgaatctgtgctctgttctgtacaggattaaagaatatgtaagacaaagcataacacattaaaaactttttccatttcgctcccactcaagaaaacatttcagattgtaaatgagtaagaatgatgttattatagaaatgaccttgaatgtgctgtagcttacaaaaaaagccaaaatcatttccaagtwtcactgattggactgggatcctaactaattagtgcatcacacctcacagctgctcatgatccattagttttgaggacctcttatctatgctatggtctccagcctccagaaaagcttttgtctgtctgcagagacaagagttatagggtgaaactatgagcagcttggtgtagcatgtgattaagtacttacatgtgtggtacagacactaggtgctcaggggtttggacaggcatcatggtgaaccagccctgaacgatgcttggtgaacgtcatcccrccacaaagcagattcccactttctgattctgcagtagggcagcaggtagatgaaaccaacactgggtaacttagattaaaaaaaaataattaattagcatgtttcaagggtgctctgcaaaaagcgtgcatctgcaatgaataaggagagcctctctagggatccrtgaaggaggatctgacaggcagttacttcagcacacagcagtcagtgaatcggccctgaccttgtgtttttcctcctgtgttggaaatgtttggagaatgagtggttgatttgggtcccgccttggccctgggagagtagacacgtagactgatggacccaccaaggcaaaaggaaatagaatattgctacttacagaagaatggttggatgctgatgtcagttgtaactttttacttgcaatgtcttaagagtcacaactcaggcaatcccacaggtaccttagcaccttactaaatattcaggggtgaacttgtgtccacttatctccaaatctagaattctttctaatgtaaacacctgggaagataatcttagcattaaaaacttagtttaacatacatctgtaattactgataagagccatcttcaaaatgcaggcacaactattaccgtgtaatttcaaactgattcataaataagaaagagtggggaaggtagataagtattcttcccagttgtttgtggggttactgatgctaaagaagagtctggcattggtggctgggaactttggatgtcaccatgaaaagttggactgggatatagaacaaatgttacaggaataacccagcaagcctgaacgtttagcacatggggacaccatgttccacaacttcaggtgaagggtggggtggaggactatgctcacaggatataatatgattgctgccccctggagttgtgcagcatagcagtcctggtgaagagaccagtgcagtataaatacatggcctccctggagagacaaggtaagaattctggaggagcaaggggagatattcctttttcagcacgtacctgggggtggaggcatgaaccttcagtagcctctcctctcctcctctctgagctgagtcctagtcatcacttgttaatgctgcaaatccatagtattcacagtgcaataataacggtgggaagcatttatgaacctatgaagtacctataaagtactatgaagtatattaaacagttcctatacatgatcttatttaattttacaacatttttacaggtaggtactattgctaatgctctccaggttccaaatgttatccttttaaaacttttatattaagttcgagggttcatgtgcaagtttgttatacaggtaaactgatatcccaagggtttgtagtacagattatttcagcacccaggtattaagcctagtacccattagttatttttcctgtctgtggaataagrttctcttgaaaactctggaggactaagaaaaataaggctgtggaaactcacctaggtgaggattcttcttgtattagtgtacaaagtaaaagctagatatatgtgctgaaatgaacagcttgataataataaaataaggaaagaaccaggtaggccttgctgttctctacccttatcagaaaggagaaaggaactgagatgttcatctatgtgcctgagggcacagtactagggagtagaaagcaggaattcaaacagaattcacagtcgtgcttgtttctttgggccttgctcctcactcgtagagtagaggggactgtgctttggtctggcccaagacaagtgactgtgcaacgctgtgccagcatctttaggaacctcagttccagtttcattgtgcatttggccatcatccggcctgtctctgcctcttgttcattgtggtcccacgtgacttctttctgrctggtttgtctccggtcatgtgacttagctgcctggactcttctgttctatgcaggaacagagctagttttcatttactgcaggaaagaccagattggcaggttgattttttttttttctttctcatttgagcaaggcactgggaacactgagggtgataaagggaaggcttagttttgcaatctgtgcttatatcactgagctccctgcaagcaagacccttgaggaacatgtggggtgggtgcccaggtgagctcaggcacagactctattgcaacccccatcctgyccaggtctccctgtttgttaccactgcctttcctggtctgagtctaggggttgtgccgtccttgggaattgagccgaatcacaaataaaagggcacttatggtttcgagtggcgcatactctattacagtatgtcgctctcacctgcctacttttgcattgaaaaaattcacctcttcttagctcctaatcctcacttcatccttacctaccttctacctctctgtgtgtcaactctattgtgtttctatgattacatttttaaaaatatttatttsttttgaataggcaatacccacatgggattacaaaaattaaatcagcatctgtatgtgtctagcaagtattttttcttctaagcttccttcctggaggaantgctgtttcttgtacatcattttgtctgagtatgtatttggctaagcctttcaaaatcaccttctttatggatcaaagtggtcacttaccagcaaattgacatgattcacccaaattccagcataaatacgggactttatcagcacttgacrtataacgtattttcatctgtattagtgtattgcctgtctctctccatcagagtgtaagctaaatggagccagggcttgttttgtttactgctaaatctccaatgtctggcaccaaaaagacccaacaaataaatatactactttttattcacaaatggtagccaactctgtgctctgttctacaccttgctttcttcatttactgccatgtttttcaaattattatttgttggtacctgtaaatcagttttgttttctaacagttgcatggaatgtgcatccatggtgaaaatgtaccctaatggatgtgaccaattcccttctgatggacacctagcttgttcctaatctcttgacattacatgcaaaaaatgccttgaacatccttgcacagatctctgcctaaaagtgtgagtacctataggaagttacctatgtgtggaactgctgcttctgagattatgttgctgttttgggtaaacattgcctagttggtttattgtatgctcagggaagaatcacagtgctcatgggtccggtctttggtcctttgattgttattgttggaaacaactccacccacttcttatgctctacaaaacaacagcagtaggggagtgactgcacgctgttcaagcttcttaaagttagtcttactactccctgtggtcaacagcagtccattctttgtatgctaatctgttacatttgtattagaagatggatatctcagcatgacacaaccanattagttttgctgttggaagccaccatggggtactagttggggcacagctgttgcatagccatgggatatccaaataaggggattggggaaggcactgtcataagatcatgacctctcttagaagcaggagccgtcaaggctcaagaggacagatctccaataccttcattccctgcctcctctctgtggtgttattacttccccccaagatgttcaagttcagctcatgttcatagagtgcctactgtatgccatgtactttctgtccaagatcgaatttaactttcttaagagccctgtgaaaaaaagaatactacttgtatcttatakaggatgtaccagaggctcaaagaggtagaatgacttgtcagagtaagcttttttaaagatacaaataagactgtccttcctgcttaggaccttccattctaaagtcctcctgtgttcttatctgcccatgtcagtgtctccaagtcaatcatattttcttcctttcaaatctgtctccagctacacagcctcttgtcacttacatctatgtgttcattcctgtcaaaggccatttgcttttctatttccctttaccgagaacttttagccccctaaattaaaatttacgtggaccccgacagcacaggcaaccaaagcaaaatgggcaaatgggatcacatcaggttaaaaaacttctgcacagcaaacggtcaagaaagcgaagagacaacccaaagaatggcagaaaatatttaaaaactatccatctggcaagggattaataaccagaatatttaaggagctcaaacaactcaatgggaaaaagatctaataatccaattaaaaaaattggcaaaagatctgaatagatatttctcaaaagaagacatacaaatggcaaagaggtctatgaaaacatgatcaacatcactaatggtcagaaaaataaaattcaaaactacaataagttatctcactccagctaaaatgacttttttacaaaagacaggcaatgatgaatgctggggaggatgtggaggaaggggaaccctgtacttttttggtagaaatgtaaattaatacagccactatggataacagtatggaggttcctcaaaaattaaaaatagaactaccatatgatccagcaattccgctgtcaactatatacccaaagaaggggaaatcagtatattgaagagatatctgcactcccatgtttattacagcactattcataatagccaacatttggaagcaacctaagtgttcatcaacagattaatgcataaagaaaatgtggtacatatacacaatggagtactatttagccataaaaagaatgagatcctgtcatttgcaacaacatggatgaaactgaaggtcactatgttaagtgaaataagccaggcatagaaagacaaactttgcatgttttttacttctttgtgggagctgaaaattaaaacaattgaacacagaagagagtagaaggatggttactagagtctgggaagggtagttgtgagagagggtgctgggaaatagggagggttaatgggtaaaaaatatagttaagatggaatgcgtaagatctagtgtttgatagcataacagggtgactgtagtcagcaataatttgtcgtacattttagaataactgagggagtacaataggaacgttgaaagaaatgatgaatgcttgaggtgatggaaacctcattttaccctgatgcgattattatgcattaaatgcctgtaccaaaatatctcatgtactccataaatatatacaccnactatgtacccataacattttttaagaaataaaatgaaatttacatgattgggttcttctagccacagccagaatgtcatctctttaggagtgatagatcctccttgaccgctcccccttagcactctctatctcatggcccattttgtcttgcacacagctcttctcactgtctaaaaaagtcgttttggttgttcacgtggtttatttattgatgcagatgttgaagttgcattgtaaaaaaactgggtttaaaaatctgggtgcatgcacctttgcctgagacgatttcattgcagtcctgaccaagggccaggagagcacagttggtgacttctacgactgcagttaggatggtgtccaggttcctgggacaattgtgcttagattgaccactgaggctaatcacattgtatttgggagcttattttctcttatatgaagtaggttattattacaacagcctacatccttacatagatcttcactgaaaggaaaacagtctttgctcagtgctggccaaagctgtaatattgaggtaaaaagctatcccttaagaacttatggtttcaaaggtagtttattcatacactcagaggtttgtgtaaatgtgtgtgtcactgtgtatatgtggttgcnttagaaataaattcaacacaaatgtgatcatgtcatttcactggatgaaaacttcccctttttgtcttaggtttaaaaagtgaaaagtacttaatagaatttataatggaatttgcaaagtgacaggccacaggatgaatgagttttattcagcccacatggtgctttgacttagtctccaacattkacaaatcaggagatgttacatgaaattctggatatttgacttctcttaaagatttaaaagctccagtgatactgtctgttgaaatggcagtattcagatggaagtgagtaatatctttttctccaggtagggcgtggacccccccagtttacctctttacgtatctggaccacttcactcactcatggtacacacttggcccctataaaatttggttttgtgaccatcgctctgaaatttctccttcattttcctttggattgaaaaatagcagttaatgtgagtaataaaaaatgttatactcatgtttgttantttgtggaattgcacaagcttacaaatataaacagcagttgtctgagagaaagcaggagagaaatcaacttttaagggtacattggcccagaatataagtagcttctgatatctaaatcttcgctgtcactttttatatcaatagttatttaaaataagtgctggcaaagaagtaatttcttaaactaattactttgatgcatgttgctagatgcaattttttcaaatgattattttatttgattcatgcttgtaacctacatacttaccagtgccccatatattctagcctcaaaactttgtaaattcagagaaacacagagcttttataaaaataaattttcgttttacttttgtcttttcaataaaattcatgggcatctaatttataatgcactttaagtaacaattcttaaaattgtctttcctttccacttctactctctcttgccccgtgtagtaggctgaataaagggccctcaaaatgcttatattctaattccttgaccttgtgagtatgttaccttacatgacaaaaggggctttgccaatgtgattaagttaagcatcttgatatggggagattttyctgtattatccaagtggacccaacaatataatcacaagtgtcctcatcagggaaagacagggagattctactaccagggaagatgacagtttgatgaccaaaggaaaatgctgtgcttcttgctttgaagatggaggaaggggccatgaaccaaggaatgctgggattacaattctaggaactggggaaggcaaggaattggattcttccctagagtgtccacagagaatacacccctgctgacaccttgattttagcccagtgcaactgatttgggaattctgacatccatgactctaaggaataaatgtacactgttttaaaccacctggtttgtagtaatttgttacagcagccgtaagaaacatcccataattgtccttttttttttttgagatggagtctcgctctgtcacccaggctggagtgcagtggtgtgatctcggctcactgtaacctctgcctcccgggttcaagcgattctcctgcctcagcctcctgagtagctgggactacaggtgcgcaccatcatgcccagctgatttttgtatttttagtagagatggggtttcaccatattggccaggctggtctcaaactcctgacttcgtgatgtgcccgcctcagcctcccaaaatgctgggattacaggtgtgagccaccatgccgggcctaattgtcctctttatttgtgwgttctcaaccctctccgtgaaactttcccagcccccttttgattccctttcatgggtaatagtgagaggcagcacacacagggaaccaggacagtaaacaacyttcttacccttttccaagatttcttcccaggagagacacagtaaaatagagcaggtgaggcaatgcggacgtgtgactgcatgatccattacctgaaataacttgaccaaaatcagtgggagaaccaacaagtctgtggaacccacagtctttctcaagcacttattcctcttactcatagctcagtgtctttgctttaatgacctcattctttgctgcataagcccactcagactattccctagatattctgccgacatggcctcatctagactccatgtggctctgcctctaattactgtgtgcttcatttgcataaggttttactcattctcatgtcattcgtataaagtgggagtctcattgctaaggcaaccagaagtgggagtgtgcacaatttcagccttgtccaagaactcagctctacttggtatactcccactgtgttcttggtttcctgccttccatatccaaaataatgcaaacaataccatggtcatctctgttcgttttttctctttttattaatcttttagcaggcctatccagctttttcctgaattcactaactttgttctttaattatccctagctaatcttgatgtcttttccttttcctgcataatagatatcttatctggaatcctttatggtaattactgctgtgaacactttccacatgggtttttctctttcttctaccacccttttgaccattccatgcctctcccattggaatcagaatccaggatttctgtttctgctcttcatctggacagggccactcaaaaatagatgaaggatcagggactccatactccccatgtaggaagacagatggaggcctctaagaaatgtggttctaattttaaactgattgcctcgtattcgcttcccatgcatcaagagctagtttgagttctactgtccataattgtcagttgctacacactcactcagcagcaatatgscagatttttctgctagttaatgcttaaaagtttattccattttacaaagtactgatgaatttcgacaagaataaaaggccttatggtttccagtaggaaaattgcctttctcctaaaggccatgaaatgcctttctccaaagtccattgggtgactctcgttcacaaatgtgtcctacacaaaatcttaaatgtgcatggtttaccaactgttaaaataggaagattttaacacaaaatcctgaattctggattgtcttgaaatactgaaagagctggcaacatcaagttgtattcttctatggccacagaccacagaagctggagttgtgtagtcattgccccttgggataaggtggtaacccttcgctcatctcacactctacacaccctactttgctcaattttgttgcctgcgtgctttctgtaggcatctcagtttccaacttctctcatggagttccaggcttactgtgaggaaggtacctatagatgactacactgacttccttctcttacccacctaatccgtgaaaccggtcattcagcctccagagatgaatttctcattgccttcctgaatagccattccatctgtggtcagctctccctaggggaatgtattccacagattaggtgtttcatctattatgtcttcttgtcccttagttggagatctattggcaataacccattttgattattctgtttctccaaaacttgatttccattgtatttccaagggctcagaggaactatcagttcaccatttgcactgagctgatgttaaagcattaaggaacctgatgcctcctcatcttgtaccttgttttatctgattattttatgccatttgcaagctctagtgtgatacatgaggccatctcagagatttctcaaggttcacctggtaagagccaaaggaagctgtgttagtttctatagctttttctctagtggtaatggtgctgataataatgatgatattagtagctacattttattagaaaaatgctgccagggtaaactaaatgccagaatgaatgattgataaatatccctgcatctaatcctaattaaaggtaggtgttatcctggtttatcaatgagtaaactgaaactaagagaagttaaatatattctcaaaggccgttgtggtggacattttatttgtctctcctcaaatttgctcttttttcttatggtaactgccataatttcccgttggatatccgtgcctaccccatgaatttcatgtcctttggtaaaagcaggccatgtgactcaggcttaagccaatccatgcaattctgattcactggccatggtgactggctcattgattagcatgaatcatagttaagaacgatgagatgggagattttattggagggcttctgagaaccttctaaagatacaagarcatgcatggaagcacttgtggaatgttggcaggttcccatgttgtgttcacgatggggcancagccataagatagtttcagcagagggtatgtagggcagagagttggaaggagcaaaatcttgatgacatcattggtctactgacttgaaaactcctgaagccatctttgccactggtcattccagtcacagaagcttatgtatctctattgtttaagatggtttgaattttctgtcacttgcaaccrggtgaatcctacctgatagatgcacccaggtagtagataatagagccacaatttaaacccaggacttcatggttccaatattggtgccatttcttctcctctgttcttggtttggataaacactctttgtatagactcatagaatctcagagtttgaagagacccacaagatcatcctgctcagcctctgatgttacagataaggaaactgaggcgaagaaaggaaaagtaacttgcccaggacaattggggcccacgggtaaggtaggctgacctcagtatgctgcttttcttccccatatcacaacacctttatttatttttctgtttatcatcctagttaaattaatgggtctcagggatggagagtcattgcctacagattatggccatggtaagcaggacaaacttcctgggcccaggaggagtctagagttcatttgtgaaatctgccctttgagtataaccaagactaggaccaaagtaatgggagtacaaaactgaagaagctgaagatatgcagtattgcacccatttctggagaaatagaaaartaaataaatgaagacagcagcggaagagaagaaaaaggagaaagaggaaaatgatatttacaaggtgctgtccaaaaccaaagaagcatgatggatagggaagaatctttgtttttttgtcttccttaatacaatgaaatcagtgtagatccggtaggccaaggtacccagaacactgttctctctcctctgtttcctcccttattccatgctaaagtaccttaaaggactctatagactattaatagtgctttagaacataactcactgcttaggacttccaacaagtggcccactggtggaagaaaagcaatatattaagtaattttagaggaatttcaaggaatgagggtataggtttttaccctttctcttgatagctgagacatgactgctacttattttccttttaggaggagaaaaaaaaactttctttctctgtaatagtaggagtagtgtagaaatagccgcagtggttaacacatgcatgttcttcacatgtggtasgagaaggactcaccaaatgtgtccatgccctaatgcttggaaccagtggatgtgttgcctaatttggcaaaagagattttacaactgtgattaagttaaggctcttgaaatggggagattatcctggactattcaggtcaacccagtgtaataatactgggtccttataagggaagaaaggaggcaggagggagagagtcagaggaggagatgtatagtgaaggtagaggaaacagaggtggaataatgagggtgctcaggggaggaatgcaggaactccctggaacctggaaaggcaaagacatggaatctttcctagagttctggaggaacacagctttgtccatactttgatttttagcctagtgagcccatttagaatttatgacctcagaattgcagaataataattgtgtgttattctaagtcgttgtgcttgtggaatttgttacaacagcaaatggaaactaataccccctgtgtgagagcctgtgatcagtgattagcctccgtatcttgcttgattcttttcttttttatatatatactttcagttctggggtacatgtgcagaatgtgcagttttgttaaagaggtatgcccatgtgatggtggtctgctgcgctcatcaacctgtcacctacattaggtgtttctcctaatgctatccctcccctagcccccaacccctgacaggcccagtrtgtgatgttcccctttctgtgtccatgtgttctaattgttcaactcccacttatgagtgagaacatgcagtgtttggttttctgttcttgtgttagtttgctgagaatgatggtttctagcttcatccatgtccctrcaaaagacatgaactcatccttttttatggctgcatagtattccatagtgtatatgtgccacattttctttatccagtctcattgatggacagcttgattcttatcaatccttcattttagagattacaaaatgctgtttagagtggtaagtttaatatgccaaggtcacttcttgagttaagcagttgagtcaggatttgaacccaggcagtctgataccagaacttggattcttaaccactgactctactacctctctaatatagctggaaactctttgacataagaacatccttcttgggccagcaggtgcctgggaagctgctttcagtgtaagtttctgtgctgtttggaggaaaatactacacttgtataataggaattgtgagttgttggaacctctaatttaatattgtttgttctgctgatgtaatgcttccattggctctgagctgactaaagaaataaggattctttgtatattccacaccccctacccgcacccctaggatgtttatgtccctcagcaagccatccaggaagtcctgaaggagaaagcaatgcatgtaattgaaactgatacatgacctgaaaagtttttgcaggagggggaggaggagtatttgtgactattgtcagaactgttagagagttggagaggaaggcaagggggagagaaaaggagggagggagaaggagagagagagagaagagtgagactgattctgaaattagttgagaaagatrcatagagatatatacagtaatacaaaaacataaagggagtaagattttgcaaggcaatttgccaatttttataaaaatttaaagagcatactttgtgatctggcagttctatgttttttattgcagtaaagtgcccataacatagagtttactattttaaccattttaaagagtacaattcagtgacattaagtacattcacaatgttgtgcaaggaccttcgatctctacttccaaaacattttcatgactccaaatgaaaattctgtatctattaagtattcacacaacatgccccatccttccagctccctggcaaccaataatctaatttctgtctctatggatttgcctattctggacattttatgtgaatggaatcatacagtgttatgcctggctcctgtcgtttatcatgacgttttcgaggttcatgccactcttatataacaacagatatggactaaatatcaatcgcagtgccatggctaacccatgacacatgagcaccatgggaaagattcatctagtagaataaagtagagcctcatactggtatggagaggtctccaagacatgtttttgggtaaaaacagacagttatagaacaaaaagcataacctattatttgtgtaaaaagttatggaatgaggtgttataattctataaataaatgtagtaggtacatgtattagtctattttcatactgctatgaagaaatacccaagactgggtaatttacaaagaaaaagaggtttaatggactcacatttccacatggctggggaggcctcacaatcatggtggaaggtaaagcaggaacaaaggcatgtcttacatggtggcaggcaagagagcatgtgcaagggaactgccctttataaaaccatcagatcttgtgagacttattcactatcatgagaatagcacaggaaaaacccacctccatgattcacttacctcccactgggtccctcccatgacatgtgggattatgggagctatgattcaagatgaaatttgggtggggacacagccagaccatattagcacatcaatgcatagacagaggtttgagtggatacacaacaaacatgtaacacaagaatggtcgatgttggggatgagttgagattagggatggcagtcaagagggctttagctttgtctcttaatgtttggatttatcaaaggagaatatattcatatgtgtatataaatgaatcaaattgaaagaaaacatgaaaagaaaggaaaaacagaaggagatcaatgataccaagaaaaagtgtagggggaaggctacacacaggaagagatcccccgggatagaatctggatggacctatcatcacaccattactgtaccatttggagtgggaacattgngagtggggagtgttgaatggtgagagcttttagactcagccttttccctgttgtcataagctgacttcaattatagcatctccaacactagtgattactggtttgttccagtgttagaaagtctacaggccagttcaggacagagctcctgttttgagttttaactcagcaatcagtgtttcgattttggaggaaattttccaagattaatcaagttgttttttcttctgtgttgtcaggatgatacatttttgggctggtgatgatgaaaaaaatcatggtttccttaaaggaacgaaagagcatgacttaagttgtgtaaaggttggcgtttttttgtttgaaatgtcatagcaattagctacttaatatgtgagagataattttatgatttaaaaaaacacctggtgttagaggaatcagaccagaaaaatgaacattttatttttattctgttttctttkttaagaactgtgagtcctggtttgaaatccccacccctattcatctctccatcattgagaatttttgatgagtgattagtctatgtgctaggtgctgtagtgttaaaaaataggtatagcctcttcccattggtggagcttatggtgtattgggaaagacagaaactccataaaaaccacaacagctatgtgtatatgattataaatcctgacaagggaaattatgtgtagacaaatgaagttggaatattacttacaggtgtgcccaccacaatctgctcagggacaggtcacttgggaggagatgtctagttggatttcgacactctggcctcaggcaattaattttctcccttaacgattacagtgatgggtaggagcaggtcttctggagttcagtttgcatttagctgaactcaattttcatgcgtgcctgagtctgaaagaatagctgctcaggggagcccagggagcctgcatcgtgggagggagtgtcagcagtggtttcacgcaatgcaatgtggtagaagagaatgaggtctgctccctctggaaggtgaaagaggcaggttatgatgcaggttggggtaattgttggagatgcccttccaccctacgtaactctgtcattttcttggttggctcgcatcttctctttctgacattcaacttatcccattcttttattattttatttccatacttctttctccttagtttctttactttccaaatcctcctttctctgtttccttctgttctcttccctcttacttctttctttcttttttttttttttttttttttttgccaccctctgcctgctttctttttattcctcctattccttttcttccttgatctattgttttacctctttgctcactcttggtcaatgcccttctagctctcctagtttatttctctacctccctgcaaatccctctgttattatcttagactcattgatgatcccacatagatcccataagccttacttctctatcccctctttaaatggaagctagtgttaagggggtcatttatcccttgcattgaaaaagcatactgaggatatagggggacccactcaaaggaaaggggatgagggctttggaaaatgtaagtgcaagaatcacaaacattataagcatagcatacactgggagatcagaggtgttattagatgactgggaccttgggtgatttatgtgtttggggaagtttcattatgactgggagtgaatagactggtttggacccctccttcctttgctcacttgtacccaagccctccttggaagttgtgttactgtagcctgaaagggctggtcttcttcacaatatcttgaccaaaacaccaccaccaccaccaacgacaacaacagcaacaaccttcttgtctttattaaacctgaggggattaatgcttagaaatccatttaaaaatcctaattcgtcatctatcccctccatgaacctgcttaaaaatgtctcttcttttgtttgtcccccagattctcttgaccacatctggcttgtgctgtttgacctctttgtgtcttagatgggcttagccttgctttccctcttcccttttccaaaccctctgcagtctccagggggctgatttcttataattcaggcctcagctcagatgctgcttcctcagagtggccttctctaaccattctctcttgcagatactcttaaccttaaggggatgataggaggaaatacattgaagaatttgatgaaaccaaggaccaacagtcttcctttctcccagtctcaggggattcttcagctcgtccctggacttttcaggtgtctgtttgaccgagtcagtctccaagagcccctcccctcccttgtcataccctatcaccttagcttgcatttatttgcttgttaacccttaaaaccagatgaaatgaggttgtatgtttgtttgcttattcaccatcatcaagatcccagccaggaatacctctaattaccatagcaacaggagacactggaaaaagcactttcagggtaaaggagttccaatggagatggtgagccaagaattctcccttacgtttttccatgctgtggtgacgcaggtacctctgacctgaaacttagttcagaagctcccaatgctatgcctggtggtttccatttgtattcaaacccttccctgcccatggtcttctcttctatttgcttcttgtctgttttgatasaaatcaataattwccctcatcttgctcctgcatttagaaaagtgaaccaactgtccagtttccctgcttcattgacacacagaggttaacatctcggggacgtcaatcctcagggcagaacttagtgaagagaatgctttcctcctaattgatgggatcccattgctgagactctctcatttcacctcccacctggggacgaggagggctccacattctctggaacaatgacagtttactttattgccttagagagaaggagctacaaggcctgagtacagagaagatgggggaagtaacccaggtcaccncttgaaatagctgaaagaaactatccaggaactgacaaatgggctttgcattctgacaggtgcagggccctcttcagcagttcgcnttggaaattggaaaaatgagcctattgttgaagatctagatcattcattccatttttaagtgagaaaggaggtatttcacactattacctttacttccgagmgtttgtgccaaagatgtaagatgataacatggagggtgatattccatgtgatggatttcttcttcccttgcctcactacagaatgttcaaaaataaactttccatctgcaattcctgtagaatatcagactactctttgcaagtaagaagacatgatggtgcaacagaagaccagaggattacaatgatgtgtccgaaatctgagccaggagcaaaaacaaagaatgcatccttttccccacatgagcygcctgtcctgactcatgatggacctgggatctcttgcctctgttgacttggagactggggtctttacgaatgggggttggagttaggggcagatttaggttttagtctgagttctctctctgacagagtttttgggtgactttgggcaagccacccatttcctctgtgtctttgtttcccaacctgcaatgtaggagggaagcatgcccattgcacaggagagatttaaaatggaagagcctcaatttttagggaaaacaaaataaaacagatttatttattatttattttattttagtgatgggttctcacttcgtgtcacccaggctggagtgcagtgtcatgatcgtagcttactgcagccttgagttcctgggctacagtgatcctcctgcctctgccttccaagtaggtaggattacaggtgcaggccaccatactctgctatttctttttaaaaatttttttgtagagatggggtttcactatgttgcctagactagtctcgaactcctggcttcaaataatcctcctgcctcagcctcccaaaacagtgtgatttcaggcatgaacccccatatccaaccttattttatttatttttacttatttatttatttttgagacagagtcttgctgtgtagccgaggctggagtgcagtggagagatctcggctcactgcaacctctgcctctagggttcaaatgattcttgggcctcagcctcccgaggagtagctgggactacagacgtgcaccaccatacctggctaattttttggggttttttttttgtatttttggtagagatgaggttttgccatgtttgccaggttggtcttgaactcctgacctcaagtgatccatccaccttggcctcccaaagcgctgggattacaggcgtgagccaccgccaccggccttattttatcttattttttagatatgagagtttatcattattatggcaggaacgggtagtgttggaagcaagactgagaaggagataatttcagtcccaggtagtatgcacattgtgctttatgttatgcaccgatttacatagccgagtattgtctctctgtgtcagatttgtccactgtccacacttccatgtgaactgtattttgcacagctgccttgatttctctgcatcctgatttattagccctggttgatgcaaagtgagcctctgcataaattcaagaacaatttataacctgccccatcagcaaatatccagagcattcgtttcagaaaacatgttagttggtcctgttccttgcctccggtggaaggagctaaaacgaggcgggttattttcaccacggacaccttctccttaactttgggaactgagaaatatattggcctgtttcttttctttgatggtacaaagaaatagggcagaaacaatttgctgtttgtgaacaactggctgagagtgaagttggccttttctgctgagcaaatagaatctgtcttccctgttccatcttcacatgggaacatcagcttgagagacaatagacttataaagcctcctctttacctcatccagcttcctctataaactagcttatcctctgagaaggcttcttattaagaaccaggattgcaacttggattgattccctatcttttcaagtgtccatgaacggatcattggataaagaaaatgatataaacataccatggaatactactgagccataaaaggtaattacatcatgtctttcgaagcaacatggagggaacttgacgtccttatcttttttgtttttaattattatactttaagttctgggatacatgtgcagaacgtgcaggtttgttacataggtatacatgtgccatggtggtttgctgcacccatcaacccrtcatctaggttttaagccccgcatgcattaggcatttgtcctaatgctatccctccccttgcccactaccccctgacaggccctggtgtgtgatcttcccctcactgtgtccatgtattctcattgttcaactcccacttatgagtaagaacatgtggtgtttggctttatgttcctatgttagtttgctgagaatgatggtttccagcttcatccatgtctctgcgaaggacatgaacttgttcttttttatggctgcatagtattccatggtgtatatgtgttgaggcccttaagtgcagcaactccaaaacagtcaaatgtgacatgttctcacttataagtgggagctaaataatgtatacacatggacacagagggtggcataatagacactggagactcgaaggtgaggggaatgggaggaggtgaagaatgagaagttatttaatgggtacaatagacacttttgagtgacagctacactaaaagccaagacttcaccactacacaatatatccatataacaaaaatgcagttgtatcccttaaatctatttttaaaagaaccatgattgcaacttgaaatcatatcatttattttacctgtaggaccacttactaattcagagctgaaccctggagccagaggaccaagattgaactggttctccaccttggggatgccatttcctctatctaggacttggatcccttctttgcaaatggagttaataatactacctgatattaagtcgttggaagcattaaatctgataactcctataatgtgctgagtgtagtgtttcattaagaaataccaggcatttgcctttttccattttccttttaatgaggacatcggcatcttagaattatcaagttatttctttttttttctttttttgagacagagtctcaccctgtcacccaggctggagtgtagtggcgtgatctcagctcactgcaacctctgcctcccaggctcaagccattctcctgcctcagcctcctgagtagctgggattacaggtacccgcaaccatgcctggctaacttttgtatttttagtagagaggaggtttcaccatgttggccaggctggtctcaaactcctgacttcaggtgatccacctgcctcggcctcccaaagtgcttggattacaggcgtgagccaccgcacctagcccaagttatttcttaaaataagaaaatagtattatccaaaacctaccttacaaactctgttaggcgaaatttctcctgctcttgaccttttgagaaggagacaggtgaaaaaaaaaaatgccaatgtaagaacatagttgagactgttgagtcagtatctagaggcagcattcattttccatcaaccgtgtgtgkgtgtgtgtgtgtgtgtgtgtgtgtgtgtgygcgcgcgcgcgcgcgygtagagagagagattcagggggtgcgtgtgcaggtttgttacatagacatattatgtaatgctgaagtttgagcctctaatgttcctgttgcccaagtagtgtagtgaatgcactacctgataggtagtttttcaacccttgaccccctccytccctcctcccttttgggatccccaatgtctattgttcccatctttatgtccatgagcacccaattttagttcctacttattagtgagaacatgtgttacttggatttctgttcccttgttaacccacttaggataatggccttcagctgcatccatactgctsgaaaggacatgatttcactcttttttatggctgtgtagcattccatagtgtatatatatcacattttctttatccattccattgttgatgggcatgtgggttgatgctatgtctttgctattgtaaatagtgctgtgataaacatatgagtgcaggggatttttggtggaaccatttattttcctttgggcatatacccagtgatgggattgctgggtagaatggtaattctatttttagttctttgagaaatctccaaactactttccactggggctgaactaatttatattcccaccagcagtgtataaatatcccttttctctgcaaccttgccaacatttgttatttctgattctttaataatagccattctgactggagtgagatggtatctcactgtagttttgatttgcttttctcttatgattaatgatgctgagcattttttcatgtttgctgaccactgtatgtatgtcttcttttgagaagtgtctgctcatgtcctttgcctgattttaatggagttatttgttttttttcttgatttaagttccttatagcttctgaatattagccctttgttggatacctagtttgcaaatattttcccccattctgtaggttgtctatttagtgtattgatagtttcttttgcagtgcagaagacctttagtttaactagattccgattgtcaatttttttttgttgcatttgcttttgaggacttagtcataaattatttgcctaggctaatgtccagaacagtatttcctaggtttcttctaggattttttatagtttgaggtcttacatttaagtctttaatccatcttgggttaatttttgtatatagtaaaagataggggtccagatttagccttttgcatatggatagccagttttcccagcaccatttattggatgggggttctttcctcattgcttatttttgttgactttgtcaaagatcagttggttgtaggtgtgcagctttattttagggggtctgtattctgtttcattggtctatgtgtcttttaccagtacyatgctgtttgggttactgtagcattgtagtatagtttgaagttaggtaatgtgatggctttggctttattctttttgcttaggattgccttgcccattcatcaaccctatattttttattttgaggcaaagaagatggatgttcagagagcaccaaagtcttatcaggtcacgtatcaagattcaacattgtttcctttccttatttggacagaataatggaccaagatatcaagtcttcaatattggcttgaagggaaaatgagagttagttgtaggaccgtcctcctgtctggttatcatggttctgttctgggggatcttgggctacattccatcaaaagtgggagcatggagggacctgcagtattgtggaaagaacctgggccgatagttagtcttatttgagattaatcatatcttggcttggttctaaccatctcaacctggggaagttatttaaattccctgttcctcataatggagataataatggcttcttgagagggttgttgtgaagatgatattgtttaaggcacctatcactcagcctggcatatggaagatgctctttgaatattcattgtctttgctaaaaatgtgtgtttgtgttagagagagagagagagagagattaattggtacacacagagaaggagagagatggctggacaaccatggtggggatttgatatagacttgggggagctggaggaaggtttctggtgttctgtatcttgaagcttgattttggaaaatggttgtatggatgtgttcaaattgtagaaaattgagtggtataatttgtccactgtttttatgtattaaaaatttaaaaatgtgtgtttgtaagacctctytctgtgtcacacacacacacacacacacacacgcacacacacacacacccctatggatctctttccttcagtgttcaggagagacacactccccagacatcttgacatctccttttcttcactcttgattcctgcccctgacatcaactgtagtgatgcaggctcctacttctcttgagatctggtattcttctrttgygtctaagtggtaggttggtgttgtggaagccatatgggctttggaggcagaaaaaccagggtttgcatcttgggcttattttttacaagctgcagatttcttgtctgcaaaatggttgctgtgagaattagagatgattcaggtaaaccactgagcatgatgctagacacgtccaagtattagctgtacagtctttggatttntstcctgggtagagagaacctcctgccccaagtctggaaagatgttggcttttgtagagtaaactctcgaaatgtattaaattgactccatgcttgggaattttctccatttagaatgggtgtttctacctggttcagatctgagttcaacctagatcctcctaaaactatttaagaccattacctctgacataggctgtgcagagtaaacagatctcacatgaatgagaccttctccatctttctttgcttttatttaagccaaatatacagaatttgaatgtctaataattttcttctattggggtcattggtttaatttccttagcttaagggagagctgactagatattttttgtatgctactcttgaaatatgttttggcgtatttgtttgctttcttatgccctcatttattttactgcatttggataactggatgttatcaggtagctactattcttagtgaataggtggaattccacttctgtgcctaacagtatacaaagaaaacaacattattctagctgcattttttttgcttccatagtttctgagttataaatgggagtgagttggctttcatatgcacctacaaaattaatgttttataaaaggaagaaatataaaaagtctttaggccatctgtattggcctaatgcctaaaatcatttagcgaggtctgggccatgttanggttagggttagattctgttttttcataattagtaatctggttgcagggaccagacatgctctgcaataacaaacagccataccagtaagtatcaaattatgtgctnagtgaaaagtggagtccctaatacaatgtctcttactggagtctatggacctcctgcatcaatgatgccaagtatgctggttcagaatatagattcctgggtaccatatccagagattctgattcagtggtgctggaaggaaactcgggtatatgcacactgaaaagctcattagggtgattttgatgctaagttattgaattactagcactctacacaaytggaggacagaaaatacctatgtgaggttgtagtatttatggaagaaggaaaaggtgatatctagatcttgaaagataaaatactgacaaaataaacattttcttctttttttttttttttttttgagacagcgtcttgcactgttgcctgggttggagtgcaatggcgtgatctcagctcattgcaacctccgtctcctgagtttaagtgattctcttgcctcagcctcccaagtagctgggattacaggcacccgccagcacgcctggctaattttttgtattttttagtagagacggggtttcactatgttgaccagactggtctcgaactcctgacctcatgatccgcccaccttggcccctcaaggtgctgggattacargtgtgagccaccgcactcggcccattttatttctttaaaagagccttttggttattgtacattgttaaaacagaaatacactataaaataaaatcgacaaagatcacttgtaatttcaccacaactgtaactctttggtgaagtttttcaatcttattattttacaaatatttttatgattggcttgtatatacattttgttttcacttttattattcacctaacgtcataatttcagttcatcatgttatgacaacttctccataagcactttttcttggtagtagcatatttcttttccttggttgtaggattttctacagatttcctttcttatctcggtacccagccagaaggaacaatgctgttgatttctgtttccaaaggaggttgggtaattgtcttttcctttaaagttgtgtgatcattccattgtatatgtatataaaaacatcatattgtacctatgaatttatataattataaaatatcagttaaaaatgttttttatttctaatttttgtgagtataaagtaggcatatgtatttctggggtacatgagatacttcgatacaagcatacaatgcatgatagtcacatcagagtagatggggtatccatcacctcaagcatttaccctttctttgtgttacaatccaattatactctgttactctttaatgtacaataaattgttgactgtagtcaccctgttgtgctattaaatattagatcttactctatctaactatatttttgtactcattaaccatcactacctcataccatcccccaactacccttcctagcctctggtaaccatcactctactctctacctccatgagttcaattgttttaatttttttttttttagctctcacaaataagtgggaatatgaagcttggctttctgtgcctggcttatttcatttaacatactaacctccagttccatccatattgttgcaaatgacaggatctcattctttttcatggctgtacagtactccattgtgtatatgtaccacattttctttatccatttgtctgttgacatttaggttgattccaaatcttggctattgtgagtagtgctgcaacaaatatgggagtgcagatgtctccttgatattttcctcttaattcactgwctaataaacatcacttcctaatgataaaggcaggtaaaaaccaaaataataaattaaaatttcattctattctaaatgcgggaccatataaaatgaacatataaataattggccccatatctggatgttgtaataacatcattaggtttgttcttactgatgacaaggaagttaacatctttaggtttgggcccaacgtaactgagaagcacacctagagagttgggcacatcaggaaacttttgtcaatagtttagtttctggcagagtctcatggagaatcaagttactcggtgtgtgtgtgygygcrcgcatgcatgcatgagtgtgtgtccacatgtgagtgtgtctgtgagagaaggagaacatactggtatgtgtgtgtttgtagctgaaggagtgtcatatcgcagatacgtttattagggaaatctggaagatagcagcagagtttttgatatctttgaacccactcctcaaaaaacagacaaactaacaaaagtaataaaaaaccaaaaactaatggataatagctacaaaaaattatgagacaggatgcccccatgaattctaaaatgagcatgtagataaaaatcacaactataaatcccatgtggtgttagaaactgcgtgtgagaaagtaaagacaagaccaagttactcgtgatgcctctgagagtttgggaagttcaagatcatcatcaggtactactggaaaatgaggcagaccattctgaggacaacagctacagcagaaatggtgcttggaaaagtggatattcatatgcagaaggatgaaactaggcatctatctctcaccatatacaaaatacactcaaaatgggttaaagactgacgtgtaaaacctaaaactgtgaaactgctagaagaaaacagggtaaactccagggcattggtctgcaaaaagatttttatagagaagacctcaaaagcacaggtaacatcagcaaaaatagacaaatgtaaaagcttctgctcagcaaaggaaaaaatcagagtgaagagacaacctgcagaatgagagaaaatatttgcaaactactcaactgacaagggattaatatgcagaatatacaaggaactcaacagcaaaaaaaaaatccgattaaaaatgggcaaatgagttaaataaacatctcttaaagatatgcaaatggacaagtttatgaaaaaaatacttgacatcactaatcatgaggaaaatgcaaatcgaaaccacagtgagatataatctcagctcagaaaagatattatcaaaaatacaaaaagtaaatactggcaaggatgtggagaaagagaactagtatacattgctsgtgggaatttagaacagccattatgaaaaacggtatggagtttcctcatactaaaagtagaacttctgtatgatccagcaaccccattactgggtaaatattcaaaggaaaggaaatcagtatgttgaagagatattctttacccactgccatgtttattgcagcactattcacaggggccaagacattgaatcaaccactgaattaacagatgaagaaaatgtggtatgtatacacaatggaatactattcagccattaaaataacaacatcttggctgggcgyggtggctcacacctgtaatcccagcactttgggaggccaaggcgggtggatcacaaggtcaggagatagagactatcctggctaacgcagtgaaactccgtctctactaaaaatacaaaaaattagctgggtatagtggcgggtgcctgtagtcctagctactcgggaggctgaggcaggagaatggtgtgaacccgggaggcgaagcttgcagtgagctgagatcacgccactgcactccagcctgggtgacaaagcgagactccatctcaaaaaaaaaaaaaaagaataaataacaacatcttgtcattcgtggcaacatggatgagcttggaggacactatgttaaatgaaataagccaggcacaaaaaaccaaatatcacgtgttttcacttcatgtggaagctcaaagcattgatctcatggaagtagaaagtagattagtggttactagaggccaggaagggtgtagccacaggttggttaaaggatacaaaattacgctagacaggaagcataggttctagtattctatcacactgtaggatgaccatagttaaaaatatattgtgtatttttaaatagctagaaaagcagactttttaatgttctaaatacaagaaatgacaagtttgaggtgatggataagctaattaccttgccttgatcattacacattgnatacatgtattgaagtatcacaccgtaccccataaatattaatatacaatgtcaatttaaaaagtatcagtatgaacttatgatgtatttttacttaaaatacatatatcctagaacagtaaccaacctagtaaaactaagtactcctccacttagagtttggtttttaaattattttccactgagggagaccactgggaaagtgggtgattcaaggtgtagggtggaaatgaacaagataaaccttyctagagtgtcttgtcactgcaatgagcaaagcagttaccaaagactacaggtcaaagggactcagaagccaatctgaaatcaactggccaaagatggaacagcttgggcatcaatgaagatactaattgcagggcattgaaatacataaaatccgtgagtttgtaataataagatattttaaaagataactaattggtaacccttggaggatgctagggaaccaattcattgttctgaaaacatacatgggggaagaagcatgcgtttactgtattctgcccttcttgtatcagttcttcctcaggccaaatagctgacaaaggaagatttctctttttggcatagttccgggtaataaatgaagaaggaatagtagaattggaatatccctacattgcaaacgttaatgaactaatggatccaggcaattattgtcaatgcctgctaatgttacaaaagacaaccagaaaatttattttttaaagaaagtacacacatcacttatgaagtattcctggcaaaataagtgagatctgcatctacctctggcctgaactgccagcaaatatgggagggggcataagcctgttagatgacatcatgggcatgtcatcagcaaaatccagactattggaaactgcaacaaaagacccagtttttaaaaccaaaaatgcaatgaaataaaaagagtctcaagagtcatattaattacactggctgcggggctcacacctgtaatcccagcactttgggaggctgaggtgggcagatcacttgaggccaggagttccagacctgcctggacaacatggcgaaacccccgtctctactaaaaatacaaaaattagctaggcatggtggcacatgtctgtaatcccagctactgaggaggctgaggtaggagaatcatttgagcacaggagtcagaggttgcagtgagcagagatcacacccctgcactccagcctgggcaaaagagcaagactgtctcaaaaataaatacataaataaataccatattaatcatatagaccttgtgtgtattctaagtcaaaagaatacgatttttctaaaagtatatagaacaatcagcgaaatatgaacacagaccagacacttgataatattaaggattaaggtaaattttgagtgtgatgatggtattgtgatgatatttgtaaaaaggagtccttgacttttagagatgtatactgaaatatttacagatgaatgatatgatatctggagttcacttcaaaataatgcattggaaggagaacattggtaagaatrtggacaaaacaagatcagtcacgaattgaaaatagttaaaattgagtggaggatacatgggggtttgttatactattttttctgttttctatgtttgacatttcccatgatgacaagtttaaaaagaatataaagtgacccaagtttatgtgaacctttctggaaatgacctaatgggatcataactaagctttgcagataggtaaacatctaccagcccaattaccttgagacatgattggaggcgctgagcagcatggcagtgctgccttgagatcatagaaggaatcctcctggtcagtaagtgaacaacaaacagcatggatggcattttcagtttttattctaatggtaatttgtgcatttcctgtcttgtagttctttagcacctttagcccaggcctgctttttttcctcctctaaggactttacagggtgaaactattctctctctctctctcttttttttttcctaatataatattttatttatttattttatttttattttttattattatactttaagttttagggtacatgtgcacaacgtgcaggtttgttacatatgtgtacatgtgccatgttggtgtgctgcacccattaactcatcatttagcattaggtgtatctcctaatgctgtccctcccccctccccccaccccacaacagtccccggtgtgtgatgttccccttcctgtgtccatgtgttctcattgttcaattcccacctatgagtgagaacatgtggtgtttggccttttgtccttgtgataatttgctgagaatgatggtttccagccttcatccatgtccctacaaaggacatgaactcatcctgttttatggctgcatagtattccatggtgtatatgtgccacattttcttaatctagtctatcattgttggacatttgggttggttccaagtctttgctattgtgaatagtaccgcagtaaacatacatgtgcatgtgtctttatagcagcatgatttataatcctttgggtatatacccagtaatgggatggctgggtcaaatggtatttctagttgtagatccctgaggaattgccacaccgacttccacaatggttgaactagtttacagtcccaccaacagtgtaaaagtgttcctatttctccacatcctctccagcacctgttgtttcctgactttttaatgatcgccattctaactggtatgagatggtatcactctctttttttttttttgagacagtctctgttgtccaggctggagtgcagtcgtgtgatctcggctcactgcaacctctgcctcttgggttcaagcaattctcgtgcctcagcctcctaagtagctgtgactgcaggcgtgcaccaccatgcccagctaatttttctttttctgttttttttgttagtagagatgggggtttcaccatgttggccaggctggtcttgaactcctggcatcaagtgatctgcctgccttggcttcccaaaatgctggaattacaggactgagctaccatgtctggactattccctagttatataggggaattttccaatatcaccagagtctatagtttcattttcaatataatataaatatcttgggtatatatacttttatctcatacacacacacacacacacacacacacacagaatataagtcctagataaatacatacatatacatatatatatatatatatatatagtcccatagtcccttatatgtatataggactgtatagcctccaagcgttttctagtacagtcattcattctgtgaatattaaatgcttaaatgcctggcattgtactagagaatgaggatacagtcttttcatgtccagattctagtatagggagacatcaatacacaggtgaaaaaactaattacagattttggacagtgttatgggggaggtaataagcagagctgtggtgaagactgatggacaaagaccctgctctagcaagaaaaggcctctcagagcatgagacgtttaagctgaaatctgaaggataaaaaggaggtcctgatgatgggaacagcggaggaaaaagcattccaggtatagggaacagacagtgcgaagacactgaggagggaaaaagctggtgacaggaaactgtcaaggtctattgtagagcaaaatgagaaagatggagagtggcccaagggataggagctgatctcgtcttcagaataaccatgtggcactgtcttccttgttccttagatttcacagataaggcaactgaggcaaccctctgtgtcattgctagtaagtcacagaatgagagcttgaatcttcttcaccagactccagatctagtgttccttttgagtagataaaataaacctgttagaatcttagtctcctcttggcttactttctcacaaccagaggggtcagtttaagctgtgcttggcataaccagagtgagggacccgcattgtaaganaggcaagatcccacatgctcctgaaatcaacgtcaggatttcttcacaggtttcgttgtgggagtcggaaatgtgggcactactttttaatgtcttagaagtgtctgtgggtacatagcagaatttactgtcacatccatctgcttctctccctctgtcttgctgagtaacctgccatttcagacgagaagcccgtgccacgttatgtcatcagggtccattaagagattactctgattccagaggaacatccgttccraakacagaggaacttgctttcatcttccaagggatgccaattgttgattccttgctcctcttcaaagggaaatgtgataaaaatccttctggaggaattttcctactggcagtgatcattttcatagtgaacttgagccaggtcatggagtggaagaaatgtaatgttcttacagagggaagatcttgcttcattaaggaggagtaagaggaggatggggaggaaagggaggaggagaaagaggaggaagtagaggaggaaggggaaggagaggaatgagaggaggaagaggatagggaggaggaggagaaggactaaggagcagacaaagtactaaccaccttccatactcatgttaatcatcacaataaaccagcaaggctgggaattatcacctttctcgaaatgagcaaactgagggtaagcaaggtgaaaagacttgcccaagttcacacagayaggaagaggctgagccaggtccctgtaactgcatttgcctgagtcacatagcttctccgtggatactttgaaaagtgagtggcccttgctttctagaccaaatcacacacaactctaacttgcattgggaactgacaacccattgctttttctttatcagttggtgctttcgttatgctgtagcattgtcatgtttasaagtataacatccaactgcctcattttgcatggaagaaaaggctcagaaaggtgaagaatgtgtccaaaatcatccagtgaatatatggcacagccagcatccaagttctaactccaagtctagtgccttcttctcaaaccacagctgtcttgttcttgcccaagatctttttcttcatcttcgttgttaagctgcagggttgacctaattaaaaagttttatttttttatttttatttttttgtgaattagtagagattttcaatttgcttggagctgagattgagctaagagaggtatttactcaccaaagtctactccccaaggaaaagccgaccgaattgaagtgtgtgtgtatgtgtgtgtgygcacatgtgagtacatgcacacatgggtgtgcacgtgtgcatatgggatatgaggaggagagtgggacacttttatatatgtactggttaaaatttagtggcaaarctgcctgaacgtgtgctgtggttaatgattgcttgagctctgccttccactctcagctttggagtgggtggtacgctgtatacagagcacctagcgtgcgcacagaactctcctttcatttctacacataaagggcttaacatagtatctggcagatggcatgcaatgaaattaactttaattataattatctcatttagggtgaggtaatactattttttcagttttacagattaggaaatggagacttcaaggcttaaataacttcctaaaatcactcaattagcaaatgataaacccaggactcaaactccggtcagtcctccctccctcccccctccstcccttgctccaagagtattgctctgttgcccaggctggagtgcagtgacacagtcatggctcactgcagccttggattcctgggctcaagcgatcctcctgcctcagcctcccaagtagctgggattacaggcatgtgtccccacacctggcttgtttaatttttgaaaatggtgtcttgcatgccagctttagattgagcaggactatgtaataaactggctggtgagagattaatcactatgatcagttagagaaggyggagagtcaactctttctttgttgtcggaatcagaaccaaaattattttgggccctcctgtttcaggtctccagtgaatcttatttacagcagtgaactgaacacatgcagaaaactattttgtattccactcatgtggcagcctttgcctggtacgacttggttctcagatgtcatttgtcacgcgatgtggtgtcaggctggccaccggatggatagtggcttccctcggagggatatatctacaagtgacgccagctgaatggcttcagaggacatgcatcatttgtgaggctcctaaaggtgggagctgtgcgcctgtgatttcattactggaattagagtgccgyctttcatttttctattaattccactgatggtattagtcgtgttaaaaagacagcacaaacttggctctaagtgttcttggatgctgaatgccaccagcacttctgagtctcagttggttcagggtcctggagcttgcagttttctgttgggtttcaaacgccaactttaaagaggaggcttgggttccactcttaatgctaataaaagactcacagaacagaggaaggaacgttcaacaaaggatcagaacaccgggatstggcagcaacttgtttggttacaggagaccagttagtgtcctgtcctcctttggacatgtgagagagttaggttacataagtgtttcccagaatatggggctgcatatcacctcaggtaaatgagatggctttaggtggtacacagccccagttaaagaacacagactcacatagtagtcatgccatggtgtctggccaggatttaatgatatggtttgctttatgttcaaggtgattatttatgtaagtgacacgaggctccccatttatgtaagctataaaatttcctttagaatagcttaattacattttaaaaagttggtttatagactaataataaataatgggaaatatctgtgatggaagttgaagagaaactgtgattgtggagttgtctatttttccttttagttccattctgtatttttgggggttctgttattaagttcatacacatttatggttattatatctttctgatgaattgaccyttttctcattatgaaatgcccctccgggaatactgtcttgaagtctgttttatctgatgctaataaagatggtccattcttctaacattttctggttgtgtgttgtatctttttccattaatttactttgaatctgtctgcgtctttacattgaaagtacatctcttgtaggtagagaatagttggtcttgtttttgtttgatccattctgagagtcttcaacttttagtccacagtcatttaatgcagttatcgatgtgtttgggtttggcatgtttattgttgtttctgtatttcccctctgtttttcatgtctctcttctccctttcctgctctgttagttttctgttgctgctgtgacgaatgattcacaaaccgaagagttgtggaactgaggttcccatttatttgcagtctgtggatggcaggctggtctttgctcctagagacttctttctcatgctttccatgtagctcctccagcaatggtgaatgaagatcytctgacactttgagtctctctgacttcttctctgctacttctctgactccagctggagaaagttctctgtttttcaggggacttgtgagtaggatccatggaataaaccwggataatctctccgtttttaggtccataatcacttttttcatgtaacataacacattcagaggttccagggttaaaggtgtggacatctttgggggatycattttgcccattatatctgcctttttatggatttttagagtatttacacactttgttttaacttatttattggcttttaatctatacctctcatctcaatagatgcagaattatcttaatagatgcagaaaattatttaaaaattttaatactttaattcctataaaatttaaactatttccttctataaccagttttctgagtgttttcatgatagaagtatatccaataaaggtcaaatacaacaagcccacaacaaacaccatactcagtggtgaaaattgagagcttttcctctatgatcaggaacaagacaaagatgttcaatctcaccacttctattcagcatagtactggaagtcctagccagagcaattaggccagaaaaagaaataaaaggcttccaaattggaaaggaagaagtgaaattatctctatttgcatttttaaagtgattgctctagggatcacatgaaacatctttagcttttcacaggctacttagggttggtattgcattgcttcacatacaatgtagaaacttttcagtatagggcctactcattccccttgtagcaggacgagccgcagacaaaactcctcagacacggagttaaagaaggaagaggtttattcggccgcgagcatcggcaagactcctgtctcaagagttgagctccccgactgagcaattcctgtcccttttaagggctcacaactctaagggggtccacgtgagagggtcgtgatcgattgagcaagcagggagtatgtgactgggggctgcatgcaccggtaatcagaacgaaacagaacaggacagggattttcacagtgcttttccatacaatgtctggaatctatagataacataaccggttaggtcaggggtcgatctttaactaccaggcttaggtcaggcaggcccaggcctgatttcgggtctggttccttggttttgggtctggttcctaggcaccaggctaactgcctttagtttcgcttctctttctttttctgagtataaaaccgtataaaacaatgtgagagggcctgtctctcttcttccaccctcaccatcctgtatgctwtagtgttatatgcattgcatctgtacattaatacccyaagaggcaatgtaaggatttgtgctttaaatagtcacatgcatatgtatttttttaattaaaagaagagtcttttatgcttatccagatatttatgcttctaatgctcttcattaattcctgaaggaattagagttttcttctggtattattttctcttgtatcagcttgaataacttcctttagcatttcttgaagggctggtctgctggaaatgaattctcttagttttattttatctgaaaagtctttaattctttttcattcttgaagggcattttcactaattatagaatttgttttttttccccccagcacttataaagacattattccactgtcttctggactctgtagtttctaatcttaagtctgtgaaaaatttgaatcattgttctctatatataatktgctatttttctcttgctaattttgagattttctttcttttgattttcatcagtttgactgtgatgtgcctagcatggttttctccacatttgtcctatttggggttctttgagtttcttgaatttgtaagtttatgtctttcaccaaatttctttttggccattattcttcaatattttttccccttctccattctctttcttgtaggaacttttgaaaccacctttgcaaaaattataactgagaaatcatggcagtgaaagagatctgacttaagtgacttcatcttgcttctaacctccaagttgtccttgtttttcctgggcggaggtgtaggccaaaataaccttcagagaaacttagtttatagtttaactttgaaacaaagagatattagccctttcccaaaacaaacacccttcctgcctggggattgcctaaagccagaggatgagaaattatggtttaggagtcatgcagttgaaggctgcaagactctaaacctccccaaattgctcctggggataacatcactattgtamaacctaagatcggtacttgagatattttgcagacccttcatctgatggatcagttagcaccacccagattgataaactggctcatctggccttgtggcccccacccaggaacggactcacagcaggaggacaattttaacgccctgtgatttcatctccagacagccaatcagaactcctgaatcactggccctctacccaccaaattatccttaaaaactctgatccctgtattcttggggaaactgattttgagtcataataaaactctggtctcctgcacagctggctgtgtgtgaattactctttctctattgcaattcccctgtcttgataaatcggctctgtctagacagtggcaaggtgatcttgggtggttacactttaatcacatgtatgttagatctcactctgtcaatttataaaagcccctctgcttaagtcatttctattgatctatcttcaagctctctgactcctgcctatgtcatcttcattctcatgttagttctatccagtaaattctttatttcagatattttgtttttcatttctaaatgttcttttttttattttcctcttctgaggcttcctacctttttctttgtgatgagcatattttcctttacctcattaagtgtattgttagaatagctgctttaacacctggatcatattgggattggcctctgttgattgtcttctttccttgagaatgggtcagatttccctatttcttatatgtaaagtaagtcttttttgcttgagaatgggtcagatttccctacttcttatatgtaaagtaattttgaattgtactagcactttgtgaatgctatattgtgggttatatttccttaaagagtattcatatttgtgtcttagcaggtaactaacctggttatacttacatttccatatctgtctctcaggtggaggcttagttctcagtcctgttgggtttaaatgcaaactactytgagccttgtctactcaccctttgttcaaggactggccagaggcttgggcagagtttacatatacatgccaagaattcccttctctaagtctcctctttctggggtttttatattctgctggccgtggacttccaggtctctaacttccacctcctcaggccagaaagaggttggctcttccactagatgttgagccacccggtgccattttgggacagcagcatgctgtcagacctaggtggcaaaaatgtagaactctatgatgagcccttcttccatgtttcaatgtccctgtgaaatctactggctatttttactctacagagccttcaggtatattttttttttccttctagctttaattttttacctgtttgggtgtgggagggaatctgttaagagatttcctaccataccagaagcagaactctggctatcttctgctgttttcttaaacttctacactgctggaactatttttcagataaactagatcagataatttttatggtaaagttagactgacatgtcatcatcttcagccatctcattttcttacccgacattggcagttttacattcttatatattcttgctacaagatacaggagctagaaacaagaatcattttattgtcagtcacagttctgtgggttgactgggctctactaggtggtttttctgctscatgtaataacagctgaggctacagttccctgagagcacagttgggctgaaatgtatgagatggctcatgacatggctaagtggatggagctggctattggcttgggggcgtagctcactgcctaatgtaacctttttawgtggcttggatttcacaaagcatggtggttgagttttgagttgacatacccaagggnaattgttatatcagggaagaagtggaagcttctgttttactgaaaattaggcttttctattggtcacatagtcactgtgctggtcagattcaagaggagaataaagcaatccacctgtcaatgggaagaataacagaaaacagtgtgggcatccttaattcaccccacctcatactgtctgctcttatttgtcacccatagcctttgttcatgccttgatcatctctttatagaattcctgaaatagccttctagcctctccccttccccccagtcttgcctctcaaatgactatctacacaactctttgtcttctccagaaaggcttcctttatttcccagggtgaatyagcctntcatctctccattattccatagcattctgtaatactttaacatttactacattgttctgaaatcataaaatctatttgtctgtctcaccaaccagtctgcgtttctcaggggaaggaactatatttgatatatccaatatttctcctgttgagagtttaccagcctgtaattttcttaaggtaggggactctgcctgctttatttattttatcttcagtacctaactttgtgtctagctcatcagagatccttaatacatatttcttgaaccaaaatgattttttttaaattcacattgtcagttaaggcagagcaagaactcgattccagatttatttcccctctaatttacttctttctagggccctccagcagccaagtgaatctaaacaatcctcaaggcctcttttccttagcagatctatcgtatctttatctccatatctcaaaagcactttctttcatatgttttaaaatataaactgagcttaataagatgaaaaggtttcaggattttcctgcattggtctctactccagtctctctagtgggcaatgcaccaaaacactgctctatttcctagctttaaacttgaagaaataatctccaagctccagggctaagaaaaggattgtacattaaagacttgttgctttggactatgaaccttacaggtcaatttttttctggaatagtgctaataaagagaaaacaagttaaattattcacctggaggcctagcaggttgtatcctgaaggctgaagtcaagtgcttactcaaacattgaatttgagctgcttttttctgtatcagsgatcccaatgcttggtgcagaacaagaactcgagatttctttgacgtcaaggttggctctacctagagtgtgattcttgaactgtagtgtgtataagattcacacggagagtgtgttaaaacaccaaccccaggccccacttcagagaattctaattcagtaggtctaagatggcgtgcgggagtaggcgtgcctgtgagtctcctgtgagctgctgatgcagctaaggctttaaggcagagttgttcagcagtggaattcttgacattttgggctagataattatttgtgaatagggagctttcctgtgcattgtaggatgtttagcagcaaccctggtctttacccactgggtgccagtcataccctgccycctagctgtgacagctaaatgcatctccaggcatagcgaaatatcccctggtggagcacagtcattgcatgttgagaaccactggtctagggtatctggatggctgtggattgaggtatcactgagtaagtttgggtggtggatgacaaggtcagttttagagtctgctgagcttaactggcttatggggcaccrtgaacatccagttctttaaatatcaaagcccagtggaatgatctggatttggaaggcaytggcatatatttaaaaccatgaaggatggataaaatgtccaagtaaatgatgtacccagtgaggaacaatggatgcaacacagagccttggggaacactaactcattaagtggcgagtgaagaaagtgtgcatctaagaaggaatgatagggggatataagagaaggacaaggagaaaaagatgtttcaggcagcaatggaggagagtgtgtcaaggagaaaagggaggtgatgtcagtagaggaaagattcggtaacaccaagttcaaaaaaggaccatgggacgaggagatcaccttgaccacagaaacctgttttgtgcaacaggatggccattgactccctgtgtctactgagcatttgaagtgtggctagtgtgacctgaaatgtgctatatgtgttaaattcactstgnatttcanacttgctgtgaaaaaaaagaatgtgaaatatctcattaataataatttttatattgattgcacattaaaatgataatatagtgagttgaataagatacattattaatattaatttcaactttttctttttactttaatatatgtggtttgagggcagggcgcagtggctcacacctgtaattaccagcactttggaaggctgaggcgggnggatcacctgaggttgggagtttgagaccagcctgaccaacatggagaaaccccatctctactaaaattacaaaattagctgggtgtggtggtgcccacctataatcccagctacttgggagactgaagcaggagactctcttgaaccngggagtcaggggttgcagtgagccgagatcacgccaccgcactcccgcctgggtaacaagagcaaaactctgtcaaaaaaataaatacgaccaggtatggtggctcatgcctgtaattccagcactttgggaggccgaggtgggtggatcacctgaggtcaggagttcgagaccatcctggccaacatggtgaaaccccaaatctactaaaaatacaaaattagccaggtgtggtggcgcatgcctgtaattccagctacttgggaggctgaggcaggagaattgcttgaacccgggaggcggaagttgcagtgagccaagatcgtgccattgcactccagcctgggtaataagagcgaaactccatctctaaatacatacatacgtacatgtatacatacatacatacatachtacatacatacatacatacatacaagtcaatagaggcaaagaaatgatagatgcaggggagagaagaaggaaggaagcaatacaaagcctagagagattgtcattgaatggatagggggagtgtcggggagattaacttgtatctattttcaacctctttcagcctcctccttttttcctgcaaaatgggagtaagaatcacgttgcaataataacgcctacccactgggttgtctggaggtttacgtgagataatagatggggactacctttggaaataatgaaacactgtatgaattccaaccgcagtcataagtgtctttctttctgacatttcactgtctttgcctcctaatgcattaataattcatactgttttaaaatttttttaatttctatttcaatagtttttggggtacaggtgcttttggtyacagggataagttgtttagtggtcatttctgagattttggtgcacccatcacctaagactacyaactattgtagtcttttatccctcaccccctcccaaactttccctacccctaagtccccaaagtccattatgtaattttttttttgagatggagtctcgctctgtcgcccaggatgcagtgcaatggtgcgatcttggctcactgaaacctccaccttccaggttcaagcgattctactgcctcagcctccccaagtagctgagactacaggcgcacgccagcacgcccggctaatttttgtatttttagtagacacgggtttcgccacgttagccaggctggtctcaaactcctgacctcaagtgatccacccgccttggcctcccaaagtgcggggattacaggcgtgagtcactgtgyccggcccattgtatcattcttatacctttgcatcgtcatagcttagctcccacttataagtgagaacataacgatatttggttttccattcccgagttacttcgcttcgaataatggcttccagcttcatctaagttgctgcaagacatcattttgttcctttttatgactgaatagtattccgtggtgtatatctaccacattttcttgatccactcattggctgatgggcacttaggtttgttccatatctttgcaattgtaagcataattcatattctttattaccacagagtcgcaggaagaattcaccccaaatttcaaaatgtgggacctgctgaacacagaatctaccactgaagtgtsgaacatgagtcacttaatagtgctgaactaatagtgagaatttcatcgtgagaacttaacagtgactcatgtttcactactgctgaaggctgaagtgtggaaaatgagtcactattaaacaaggawgggcactgggtaacctttgtgctgtggttctcaaagtgtggtttstggaccagcatcatcactatcacttgagatagggccaaaatatgcacattctcaggcccatatgcatcctactgaatcagaaagtgaggggcagggattgtcagtctgtgttttaacaagccttttgggtgattctgatcgaggcttatacactgttggtgggaytgtagattagtgcagctgttgtggaagacaatgtggcaatttctcgaagacctaaagacagaaatattcaacccagcaatcccgtttccaggtatataccgaaaggaatatagatcgttctattataaggacacgggcatgtgtatgttcttgcaggactgttcacaatagcaaacatatggaatcaacctaaatatttgcccatcagtgatagagtggatcaagaaaatgtggtacacatactccacagaatactatgcagccataagaaaaggatgagatcatgtcctktgcagggacatggatggagctggaggccattatccttagsaaactaacacaggaacagataaccaaatatcatatattattacttaaaagtgggagctaaatgatgagaacacatggacacatagagtggaaaaacacacaatggggccttgcagagggtggagggtgggaggaggaagagagtcnggaaagtaactaataggcactaggcttaatacctgggtgatgaaataacctgtacaacaaacccccatggcacaagtttacctgtgtaacaaatctgcatgtgtatccttgaacttaaaagtaaaagaaaagttgagaaccctgccctcgtgcttgtcaaatcagatcaattctctataagtgcaaggattctcgaaccttgggaaactagttaaaattcagattctgggcttaaggtgctgcatatttaaaagatcccaagattattttgataagctaccrgaaagtattgtaaagcagcaattggcaagtgttttatktaaaagccyagatagtcaatattttaggcttggcaaaccaagaggccacacattctgctgctatagcacaaaggcagccacagacaatacaggaaagggcttggctgtgttttggggctatataaaagaggctgtggggaggatttggtccacaagccatggattgtcaacccctgctttagaatgtaaatatcacccttgattgtgatcctgggtgatttcctctccattcatttattccttaattccacacattttattttattgggtctcagctgtgtgctagacatggactggacatcagagatggactgttggcttcctggcaggatccttgctctcatggagcctgccatctcttcaagtgtcgaggaaattattaagtggaatcaaaatcggttgtgatttctgcttaaaataggggaggtagagtttgttcactatcccaaaagtctcttattctatagctcagcccaacatgctttgtgttctatttcctggcttcctcactgcccaacttttaatgatattgaggcagctttggggggcatttttgttccatctccccagttgcctggaattttttgcaaatggttaacaaagttccgtttaccaccaggctgtagccatttgtgagtcagactagaccagctggttgatacggcacagagggttaggagaggaatctgttctagctgttggtatggagatgctgaaacaccctgcagtctttgttctgccagcgtgtgagtatgcaactgatagtatttagtgaagaagycttactttattagaancttttgcctaaatggaaactctaggtttgtacatcatttggagtagttccctgagacctgagtattcccaggatttacacctaacttggtttatatttgcatgcttattggtccagaggatttggcatttccttctcatactcttgaatcacatttaataatagtaatatagttcctgacaattattaagcacacactataagccagacgttgtgctaaataatttcacgtgtgataggaagaataatggcttccctaagatgtccatgctgtgaatatgttgcttatagtgtaaaggggactttgcagttgtgagattcagggtttagtaccttgagatncggatgatcctggattagcaaggtgggaccaacttaatcctgtgaatcctcaaaagtgaagagcttttccaggatrtggacagagaaagatgtgaagatggaagagtcagagagatgcagtggtgctggcttgaagatgaaggaaggagtcataagccgaggaatgtgggcagcctctgaaaggtggaaaagtcaaggaagtggattctcccctacggcctccggaaaggaaagcaatcctgctgacaccttgattttagtccagcgagacccatttcacatttcagaaccacagaagtrtaagacaataagtgaggattatttaagcccccgccaagttgatggtaatttgtcatagcagcaatagaaaatgaacgcaccatggctgatcccattaaattgtcacaagaacctcaattaagcactaacagtggtcacattttcaggaagaagaattcaaggctgagtaattgtgcaaggtcccatatttatcaagtggtagatgcaggattgggtcactggttccagggccacacttgtactgtaaattcatgtaagctccatggtatgaaactccatttggatatttgacgattcccttcaagtccatgcggcagtgcctttgcacacatgccttcaaggatgctgttgcctcctccaaagagtcacctgcaatctctgctgcttcatcctcaggctgtgttgtgttttcttgggagccctctccaaatttgcaatcaacccacgtggccccttcctgctgtgcatcaagacaccacatgccctatcacagcacttactgcatggtgcggtgtgactttgtgtctgtctgtccactagactgtgagttctttcattcctgcaccacaagcacttcctctcctccaccaggacatggcactatgtctggcacatagctctaaaatgcaagccccatgargcagggagtttgtccatcattgctatactccagtgcctagaatagtacctggcacagagtagctatatagtaaatatctgttgaatggatgaattattgaatagcagattctcaataartatacagaggctgaaggttaataaacctgtagtaattatctaaaagccttttgtttatgtttcagtggtactttatggaggcatagcttacatatagtataatgcatgaatcttaagtgtaaagctcaatgaatttttacacatatatacaattgtgaccacacagatcgagatgcagaacattttttaaaaaattgtttaacaccacatgttttcactcataagtggaagttgaacaatgagaatacatgaacatagggagaggaacatcacacactggggcctgtcaggggtggggggcaagaggagggagagcattaggacaaatacctaatgcatgcggggcttaaaatatagatgacagattgataggggcagccaaccaccatggcacgtgtatacctatgtaacaaacctgcacatgctacacatgtatcctggaacttagagtaaaatttttttttattatactttaagttttagggtacatgtgcacaatgtgcaggtttgttacatatgtatacatgtgccatgttggtgtgctgcacccattaactcgtcatttagcattaggtatatctcctaatgctatccctccccgccccccaccccacaacagtccccgatgtgtgatgttccctttcctgtgtcygtgtgttctcattgttcagttcccacctatgagtgagaacatgtggtgtttggttttttgtccttgcgatagtttgctgagagtgatggtttccagcttcatccatgcccctacaaaggacatgaactcatcctattttatggctgcatagtattccatggtgtatatgtgccacattttcttaaaccagtctatcattgttggacatttgggttggtttcaagtctttgctattgtgaatagtgccgcagtaaacatacgtgtgtatgtgtctttatggcagcatgatttataatcctttgggtatatactcagtaatgggatggctgggtcaaatggtatttctagttctagatccctgagcaatctaccgatttccacaccgacttccacaatggttgaactagtttacagtcccaccaacagtgtaaaaatgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttgttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtggtttcttttgctgtgcagaagctctttagtttaattagaycccatttgtgaattttggcttttgttgccattgcttttggtgttttagatatgaagtccttgaccatgcctatgtcctgaatggtattgcctaggttttcttctagggtttttatcgttttaggtctaacatataagtctttaatccatcttggattaatttttgtataaggtgtaaggaagggatccagtttcagctttctacatatggctaggcagttttcccagcaccatttattaaatagggaatcctttccccattgcttctttttgtcaggtttgtcaaagaccagatagttgtagatatgtggtattatttctgagggctctgttctgttctgttttggtaccagtaccatgctgttttggttactgtagccttgtagcatagtttgaagtcaggtagcgtgatgcctccagctttgttcttttggctgaggattaacttggcattgtgggctcttttttggttccatatgaactttaaagtagttttttccaattctgtgaagaaagtcattggtagcttgatggggatggcattgaatctataaattaccttgggcagtatggccgttttcacgaaaaatctcaaaaattttgtttaaatttaagaggtgcaagtgcagttttattacatagatacattgcaaagatatagaacatttctagttccctatgaagttcttatttgctcccttctcaccaaccccaagataaccattattctgaattcaatcatcatagattagttttgcttgttcttgaacttttataaaatttccattctgttctgttataaatgggcttgtatagcatgcctttgttttgtggctggcttcttttgcttcagcatgatgcttttgtggttcattcgttaggataagtgtagaaacctctttactcctgcactctcctagtgatcccccacccctgcacccccatatcattagatgagttccctgtctggagcatgtgaccttctattgggttgtagctgcgtatttccatcagagtggtaaccagagattcagacttggaatgtcttcctccgggaccacagcttcagtgagatagtagttcttggtacatggttgaggcttaataaagagccattaagtaaacgagtacgtgaataagtactgtacttttctaatagtcttttgggtgctaaagtcrtacatatattgaatgcttgctatataccaagractrtagtgctgagtattttacatccattaaattgcacgtaaatgamaacaacaataacaaactcgcttgaatggtaaatgttattagctcaagtgtataactcaggaaattgagactaagaaaattacagctgggtgyggtggctcatgcctgtaatcccagcactttgggagactgaggcaggaggatcactttagtccaggagtttgagactagcctggacgacattggcaaaacctcatctctgccaaaaatacaaaaattatccaggtgtggtggaacacacctgtagtccctgctacttgggaggttgaggtgggaggatggtttgagcccaggaggcagaggttgcagggagctgagatcatgccattgcactccagcctgggtaacagagccagaccttgtctgaaataaatacataaataaaaataaagtgtataaaaaagaaaaattacacgttaggaacaagtgatacaattaataaaagatagtctggttgacttcacagcatatgctctccctacctacctaggctgcctcgttttccagttaatttttcatttataaaagaaacaggctaattatggaaaatttgaaaaatacagaaaagcagaagcaagaaaatgtaaaggcatccatatgctacaacccaagaacagtcgctcttagtattttggggtgtattatctttttgcattattttctgtgtatagttttttatctgtttatttaataaggttatgataaaagtatacatgcaaaattatatccaactttttcatgtaatctctacttaggttgttataaactctgtgtctgcaatctagttcattcagtatttattcaactgatatttatgaattacctactatgggacattgttgattgagcccctcctatatgcaaagctcatttttttccttttttactactaggttctactatctgttacctgggccagatagttgggtgtcaacctggaagccacatcatctctgcctttaatattgctcaattatgtggtttcagtgagtttctaggtttgctggtatgtgctatggtttttgtttgtttttttgagatgaaatctcgctctgtcaccgaggctggagtgcagtggcccgattttggctcaatgcaacctctgcctcccgggttcaagcgattctgttgcttcatcctctgagtagctgggatcacaggcatgcgccaccacgcccaggtagtttttgtatttttagtagagatggggtttcaccatgttggccaggctggtctcgaactcctgacctcaggtgatatacccacctcagcctcccaaagtgttaggattacaggcgtgagccgccatgcctggccaatgtttttaattagtasacgaataaaaccacaagaaaaccattggcaagccctctagttctttgggctccttgctttagcacagtggaaagcctgtgtactaagtcagaacggcgactcctggaataaatcatcccaggtgaagagttgatacgttgcacatcggtagcttgggtggcatatttaaatactaaccaggctcactctgcaaatagattgaagtgattccaaaacctcggtgccataacttgattttcagaatcaggtggaacctacaagcctattatgagctcctatggggagacatgcagggcatgaggaatagaaataggaggaggagacagaacatcataatttcsctctaggtttagggatggaagctggttggtgggtcaggggtgggaaaatgagtgaggctttttatctcttaggagattggagatgttttcaagagggctgtgaatcatttgaggctgatttcagggcactgtgacagatgagtgcaaatccagcctatttctctggtccaaatgaatacttgtccttgtaacactgaaaaccaaatatttgaataggaatgagtattctrgggtattctggggtagcatggctcagaggctcctagcagttgttcagtgacttaaaagggagatggttgtaaaaatttggggcataagctgaacatttgtctgattcaacataaattagcaccaattctgctcattttgtgccttttccctaccaactcctctgtatttattcattaattcatttatctaacaaatattcactggcaccttctgtacagccagcacaagggatgtatcagtgaacaagcccatgcttgtatcgattttctagtctgttaaggcagtttatgctttagtgtttatttagcacatactatatgtggcttggagacaggtggaggtaaggtatgaagctattcaggttctaatttctgccctctgcttgcaatctggtatgcaaacgaatatatgcaactgaaacctaatacacagcaagcattctttccccagctctctgtaattcctgatagttcactttggcaaagtgcttccatcccatggggtctgtcctagtaccartttgcagactatttgcttcagaatctacttaaaaatacggatttctgggtcacacctcagacatactgtgccagataaaatccgtgggaayagagccccaggagaccattgctaaagatatggaagtggggttgaacctgtgtgtgtgtgtgcatgtgtctgtgtggtcattgatgggcatgaggagtagtaaatttggcaattcacggtctggtttgccaagaaagatgatctcagaagaccaacattgcccacatcagcaagagggagccatggctttgtggcaagtcagcattcaaggaggatggatttagtagtaagttcaggtcaggctggatgttattaatggcaattatgataacaactaaatgtattggaagttaattgcatgccagatgcttttacatcaattgccaattttaatcctcacagtcgcttatgcagaagttatagttatcttcatttatggaggaagaaggcaggcacagagaagctaagcaacttcctcatagtcacccagcttggagatagcagagctgtgattctaaagcagtttatcactatctctctttcctggtataactgagaggaaagactagagaagcatgcacaatcaacatggaaaacaagccaaccgtgttctttggggaagcccttcatatcagtggccaagtgttgctcatgggggcaaccaatgtgaaaaccctgctgaaaaccaacaggcagaggcccaggtgatgttcacctgcccaagtctatagaagagttctcaggtgaggttcaaagaggtccaggaaatgcgagaaaccaagcccttcagagtcatcgaggggcatctttcggttgttaaatttcccaattaaggaagagttgagatagccccattttgacgtgctttgctgtggttggtaattctggccctattgctaattatgatgcgatgacatcatttgggtaatctcccttcctattagaagctgcctcttaggttttatatttgctttatttccactactctggccacccagtgcatgcagagaacaactgtggattgtgatattgttactggtaatgtctttcaaagtgaattggggtttcacatgggaaggcatgaaaaaagtttattaaaggtaccacagtatcaggacccaaatactgaagagtgctcgcagaagtgaaagagcttgttcttccttgggtggtccatgagatagggagtggctgtgtcccacagtgagagcagccctgtgtttggagctcaatcctatatccactgtgtgtgtcctgaacatgggcagctcccttaaataatcttccctgagtaaaattaggggctggcaccagatgagtgccaggctggtccccctggctgagaacaagccctagggagatagcacacagggccagagtgaaagccaagggcattcccagggtggaggaagttaggagcattttgtgatcacagagaggcagaggtatgctaataagggaattaacaccttttctctgattagcagccagggaattattgaaagggattagatagaaactgtgaaaagattcttgggcaactgagaggtcagaggaaggtaatagcctcttctttaggtacaaaggaatacaaatacattttattagcagagaaccagtctctttcaccctcaccccaatggctatcttaaagaccctcacacttgcctcctatctgggtacctttgcatatgaagcaccttctttgcaagaggcattctgtcctctcctctttgcctagataacccctactccagcatctcctgtttggagaagtcttcaaccatctaaattgttctgtttcccccattgtgcattcttaatgcaccataagcttttcttacaaaatgtgaatttcaatggcaattttacacgtgtgtagttgtttaattaatatttgtcttttccatctggatcataagctctttgagcgcaggtttcatggctgtttttgttcactactggattctcagccttcagcactgtacctggtccagagatgaataaataataggttaaatgaatgaattaattaaagacacagttaagtgataattgacatctggctcactgtgcagttctagaagttggtaagattcatactatttgtcattcctgtgaagagactgaagctctaaagatcagtgaaatgaagtgagtttcctgagacacacggctcatacgtgataaaccaggacttgcatagatcccctgagaatctgaatttttattcacctttgctttttaagtatgggtattatgtggcttataggtagaggtttaaaattttttaagttaaaacatgaaaataacagaaacaaaaacagaaaacacaagaaagcccacaggacagtggattctttccaaacatctcacttcagtggcagctacatttgaagaaagtctacttgttgcatttaaattacctgtcacaaatcacagtgttcacccagtagcagctaggaggggctgattcaagcccctgagaattgttttgtgtcttgatcatgagtccgaacaacagaactttacaaggatgttgcaagccgctttaaggggtgatggaaccaatgataggaaccagcacctaacacctggcagagactttgtcagcgtgatgcccaagcccctggggatttctgcccaaaggtgatacagcctgatgggtttcctggtttgttgaagctggcggtgagagagagtttgaaagaaatgacttactcgatgctgtgtgacacagggagctcattcgccttgatgcacttaggcaagctgcctaacctcattcaaaacaagccagtaaactagtaaaccaaaacaaaaccaaaaatggaattaggcttctacagtgctggagatatagtgattagtaagacaaaataaaacagcacacatagcccctgcctttctggacaatttgtttaaatggtggacacatacattcatgaaagcagtctataaatcaatgttgattaacagccacattaagtactatgaaaatattaggttggtgcaaaagtaattgctgtttttgccattaaaggtaggggcagtaacagtaatttacttttgcactaacctaatacaagaaagagcatggaagagcggaaatttgcctaatccgtgagggtatggaagacatcccttaggaaatgatgatctagaaatgaatgaaggaagaataggagttggacagagaaggtaagaacagttcaaggaacctggaacaagacaagcaaagtctctgtggtggacacaaggtggccgagaggtcattgcatccagagaggagaaagcaaggtggggaggctgtgatctgtgacaagactacatatcccattggtatccacaggccatgtggtgatttgtggtatttgtcctcagtgacatttgacactgaatggtcagcactgcagtagtggtaagctcaggctgttgagagagtgaaaccctcgccttgactcaggcaaatggctgcaaggatttattgactgcccatggggatgacaccaaactcatccccaacttcagacagtctgtagaataagtacagtctgatcccaggtgatggaaaccacatcatcacagtcactatgtgcataataactgtggagtaagcctaacgccacttggtacaaacttaccactcaacataatgaacataaaggacgctggcctggagaaaggaggactttgactcatattgaattctggattcatcccactgcatgacttgctttgtcgatgcatttcatttaagtctggagaggacttgagtgccgggtagagagatttatttagaggcagaaggctcattaaaatcccaacctttttgttttgttttgttttaagccaggggtacctctaatttgtggcctgaaaattttgctcggcaagggattgaaaaatggagagatgggtttgtatgccaggactgtctaatcaccatcttgtgtgagctttagaaaaggactcattctgcaggctattaatgaggtgagtgtttaatggccccttgatgctcccccatcagatatagtgtcttgagtttttaataagctctgttctgggtcctttacaaatcagagtgttggaacaaatccttgaggagacatcaacagcaagatgatgcaatgtgtgtgagctggaaagagcagccgtcttaactccagagagtgtctaggaatctgtctatctcaatctgccgaccatgtgcacatctaattttcacttcctttttgttctctggggaacaagacacacttagattttacgttttctctgtaaggaaaaggtgatgtccggggtgaaaaactaaggaatcttgttcttcaacattgaaggtatatcgcaagcatgattttggaattaaaaaggaaaaatgttcacttcgttttcctttagcatgtagggagttattttaggatatcctgtgttttctggcacaagtttctctgtctaggacagaaggattgacwtagaggacattggggaatggggaaaaaagaaagcaggaggaggagccccctgaccccagtttgaatcccagtattcagagaaattcttctctatacctctaaaatactgttgtgtttgagaagaagcatggggcagttggaaagtgttggaacgtcctccactgtcccctttactacttctgcctccttcactcctctggaccactctgaggttgtgcttctacctactccacttgccttaaagtcccaggtgaacatctcactgcaccacacagcagtacctttcagcctttgtcttcctggacactagacacctttcacccctgccttcgtcttcaagctctctactcccgtggcttctaagttatcgcattccccggctttctcctcgtacctctcctacattccttctctgcctcttttccacacacactctccttcttttgttaggggatgccatgcacagctgtcaacaactaccgcccccagcagatagacaacttctaaatctcaagcctcagccctgacccctttctcatcttcagacctgcctatccaccttcttggtggactccctgcagggaggtttcaaaagcagctaacctaaacctgaattccatatgcatttctctgtccccctacctatactcacttccacccttgctcactcattcattcaaaaaacatttacagagtggctactgtatgtcaggtacaagrctaggtgctggagctacaattgtgaggaagaaagcagggtccctaacctgttctccacttttgtaagtgacatcaccattcacttggcaatcctctttcactccccaatctccctgccaatccgatccatgagttgccaagaccagttgaatgtacctcctaaacatctcttgaacctctcttttgtgtatctgtattgcagcaatcctagttcagatctttctctcttttctggagttgcttyagtgagatttctctgggcctgcttttctgccttcattcattccctcctccaagcccttcctcatactcaagctcaagtggtccttcccgaagataaaaacttgctcatgtcacaccgctgctaaaaaattctttcatggattcttctcgtcaaccccagaaagcattaactccttgtctctttttttcactccctgtctgtgtctctccatccttcctcctttccatgctctttcttcctccctctttttcttcctttttccctttttctctcactttcttgttgcctgactttctctctttcattcaataattatttgaatgtctttaatccaatcccacagatataagcattgagttcctctctgtggcaggctctgtcacgtgtacttgggatcaatgaacaaacagaatatacctgacttcatggagcttatattctatcaaataggacattgaacagacagaaaatattaataataagcattgtaagtaaatcatatgagttatatggaacgtaaaggtgacagataactatggaaccagattcaaaggtatttctcattgtgagccagagaggcatggacctaccctcgggccctgcctcttcccctagccacacacttctctggctcttttttctttttttttgcatgtgtttcttcagcactaagctgctcacattcccagtgggtgccatgttcttcattctgtgtgtctctgcacactgtctttgtacactgtcctctctgtactctgtctccagacctttccagcctgtgccaagttgccctccatctacaaggacctcaggggtcactgggaaccctttcaccctctcttgctgggttgggtgggtccccttcctctgcattcccttggtgccctgagctttctttggccacaactctcactactggagcatgctgagggtgggttgagctctgtggctccatgactttctttctgggtgaggcttggaggccagtgaaccctccacacttccagccttaattttctcaggtacaaagtgtgaaggagagccttctatttatttctcgtggttgctacaaagtttgcagcaaatatgaaatacccaagggtgagcggtatcgttgggggctgggaggtcactgggcagtgagtgtcagggcttctctgtcctctgagccctgaggaaggagtgccttctgtgttcatcaacactggagaagacaaacttacctgaggttgaagaacacatgggctgacttgggctctcgcctgcaaccagctctgagtgtgatgggagccaggaagccctggggctcagcatgaacacaaatggaccttatttgattgtgtttttctcctttcaaatagtaatttggacacttttcagaggctgacattcaatttctttttctatgtcacttcggagaaaaaaacaaaccatcatttttttctgttaaaatctctcccttttccaccccttgtttatgctcctaattccatttgtgctcagagtttaattgtaatggtgagctctggtcatattagttcatcctcttcttttgagctgcaagtgggtcttggacaggctgcccagcttagtacttgctgaagagaacaaacagatattagctttttgacatgcacgcctgtgcgcacatacacaaacacaaacacaaatgcacccatgagaatttagcgttgctctgttaaaggggcagatgatattctgtatttggtctgctggtctccaaagcaatgagaggtgaataaatcggatgcccataagatgcttatttacataagttaaaggatgctctgtattgtgttagcttcagtggggggagtgatttgcgagcagaatattatgctccaggaaaacagtgcagattaggttgctaaatctcctggcattagttcagggtgcattcttctgctgtggatgcattgcttccagaggaagaagctggtgatggaggaagcactgtgctggggaagggttgatcttcagatsgtatctgaatatatgggagaatgaccaggtaaaggaaagggagctcacaggttaagcaccgataaggagggaggtgcacgttgtcagtggtgaagagcaagggttttggaatccagtaaaatttaaattaattagttttgacattagacattaatactaccttcttcatggggtttcgttaaagactgaatgagataatgtggaagaaatgatcggaatgcaataaataatcagtaaacagctactgtacatgagctcatctgatctatgaagttggtggaaattgcttttcctgttttacagcctaggacacggaggcttaaggggttgagccagtttctcaaggcaacacgggtagcctgtggaagaactgaggtttggacctagatgtgtcttattccaaaatccttgcgccttccactgcactaagccatctcccatgatttggctgggactctgctcctgcaaagcaattatagctgtcctgtttgctatctgcttagtagcctcattagagaaggctgtcattgtagcctattcaagttgtagggctctgcaaagtgagaggggtgaaaatgatgcttgcaaagcttcctgggagctttggatacctagaaggagcaataagatgtgggtctccaggtacccacatctgatgggtggtgacctcctccctcctagacccttggtagtttcttttttctaccttggctagggcctcaagtaaccatgaggtccaagggctccctagggatcctctcacaccacctgcaagactaaagatacctaggaaaagctttaggtgaggatatgtagctgggagaggagaacacataaaggggcttgggagtgggctagagattaggggagggaaacagtctgtccctgtgctcacaagagccctcagtcatctctgacagcagcaaggacatgggctctttttggaatcaattcctttcctgggttttgatagagaaggaatccactttgcctgaatctgtttggttcctgaatcctagagagcaagtaacaagggttcagacagtgaagaatgccagcccaaccctcctcagaattgtttattactttcctgccttcagattgtgagagtttgggtagcaatggattctcacactgcagacactcagttctacctctgagccccctcatttcacaccccctgttcatccagctctcacttataccctgccctctctaacccatcactgtgctactaactcagccactscctttctcactggatgttcgtttatttcttcaatctcttatacccacaactcatgtcacatccacccatccgtccatctgttcatctgtccatccatccatccatccacccacccacccatccatccatttatctgtccgtccatccatccaaccacccatccatttatctgtccatccatccatctgtccatccatctgtccatctgtttatcccatctctccattcatccatccacccacccgtctacccatccatccatctgtccgtctatccattcatccatccattcattcattcattcatcctcccaaccatccatccatctgttcatttttctcttccgtcatccatccatctaccctatccatctatccactcatctgtccattcatctgcccacccatccattcatccacccacccatccatccacctgtccatccatttgtcctatttgaccatccatccatccatctgtccatccattcatccatctatccatccaatctattcatccgtccgtccatccatccatgcattcgtctgtccatccattcacctgcttacttataccttcactgaatgtgttctcagctccccatgtactgggagctgggctgtgtgctattactgtacagatgaattagcattaatctggttgcatggagacagctatttaaatagacacctaaaatacctggtgacgattgacaatagagacctggacagtgtgttctgggagcaccgtggaggtggaggggagagaggaggcggcagctgtttcctatttcctcagtgagctcccacattagtcccctacctttcagttcatggagctcttgctcattaccctgttacagataccccagctcccctccaggtaattagaaaactgccaggtccattttatagatgaaaaaaatggaggctcagggagacccagccacttgcgtacatttgtgagctgcagcgctggcatgcagagaagggtggctatgcataccctggggtcattttctttgcttggcagatggccatgggcaccataggactgaccggtgcttccttctctctctgtgctcttctcgttcctggatggcttcagttctctcccaggagtgaggcggttcaccccagggtggcccctcttcctttactcccatgcagtatgttctgactcataactgaaagtgttttgctggataagacgatggggactgacaggcatgacatacctgtgatatacctgaaggaaacacacggtggtgagaatgttagacatcagacactgtcttatgtcattgcctagtcytccctgggatggacagaggtcacctggcaccaggacccctgggtcagaaccatcactctgagagatgcttgcagcatgatattgggcatgccatgtgacttgacctctagaactttgctactgaaagcttggtccatggactagcagcaactgatgccactcgggagcttgcttgcaatgccccagcccccacccgctgtgttttaacaagatccaaggtgattcttatgctcattggagtttgagaactgcctctctctaagccccaacttccttaactgtagaatgggaatagaaatattccctgaaacattagtgtgaggattaaataaatgcacttgaagatctctgtgtgatcgactgattgtcctgatttgtccaggactgaaagggttcctgcaaagcggaacattcaggtttaacattgggatgggttgtcaacctgctttcacctcagtgcttggcacgcgataagagctcctttgccatggtgctgcaaagttgtgtcatttagaagacgtggaaaaaagccacaggggagctgtttgtatttgcattagtgctgtgtttgtgggttktagtgttttgggttttgttgctgtcattgtggttgattctttcttgattacaacagccaccataatcacagctctcattaatggagctctcggtatgtgctcagagtaatacatgcattatcccaatcacaacaacctctttaaggtagggaataaaattccctccatttaaaaaaaaaaatgagaaaatggagcctcagagctagtaaggattttgtccaaggcccagacaccagtaagagaaagagctgaaatttgaaccctctatttggtaccagtgtctgtgcctttgataacaggaacatacagactcccaaagggagaagaagcaatttcttctggaacttgagcattcagagctgtttggagacatttctttgagaacactgggatatttttgaaatggacatttcgacgataatgtttaccaccagggcctgcccctagcaagtgttatgggaaagcccaagacactcctttttattgcagaaataaagctgcttccttcagttcagcagcagctcctctatgtatgatagccggagacgaaaacttaatgaacgggactggtttgctttttctctttgctggaacagcttaatgataagcgattattattggtggcaacttgtcatgtcttaagtcttggtcttggctgttgtggctgtcagagtctttgagaagaaaccaatctcagcacatattagagaaaaacaaaaaacaatgaggaaagatgaagagctcatgcagggaaaagtgagatttgtgaagagaggtgggtgtcccaggaaaaagggaagaatgatgaagaaaaagagaagaatggtaagaaaagggaaggatgatgaagagagatgcactaccctgtagtttgaattattctgattcaagttcaggaagatgagttaaacatgttacattatttttttcctagccaaagtggcatcagtaatctttgattgcaagtgacagaaaagctaatcaaattggcttaagcaaaatgaggtaattaattgggacatggaattgacaacaagagaatttgtcttcaggtgtggcttgaacaaggtgttcaacatggatatcagaacttggtaactctcgatcttacagcttaaactttgggtctgatagctttcttcttaggatggtatatagtggttgggtggctgccagaaattctggtagaacatccatccaagttcaagtctaacagtaaaagaagctgtcttttcctagtccctttcttcataaatccagaaagccactctgattagatcagattaggaaatgttccacccccgaattaattactggcactatgggccaattggcttgactgagagagaggaaaatgagggctctcagggggaattcactattaccagtaaaggaagaacagatgctcagtggtcagaataaaaaatatccaccaggtggctcagggaggcccatgcttcatgaaaaaaaagggatctgaagaaaatagtttcagaggcacagagaaggccaggggcccagtcacagttgggacttgcaaaataaagctgtttccttgtgcttaagtttatcagctcctcagagacccaaccccatggtctctggtccagtaggatttccctctggctttagtgggaatcaggcttgctttctgtgtgagattagctggacctagccccagacaatccataattgctaatgaccctgtttggaagcgtggagtcagatgctcacctgcatgttgacagagcaccaggtaaagccagcttgggtctttgctgtttccttgcataacaataagggtctgaatctcagcagggcctccttttggccagccctgctaatgatctagaaagcagggctgagttcaagagcaatgatcattgtgtggtcctaattaatgtacagtatattgggctgtcctaaatcagctgcaacgagaatcaagaaatacatttctccatgcatttatgtgttctttcctctggcattgtggacttgatagtgggaaacttggctctgggtggtaaactgggacaaggtctgaaattcccaggaaaacatggaagttctagccacaatatttgaagttagagtaccagttgactaaatgatatagcaaacgaaagatgctggctgcatctttcaagtcataacctagcaagtgttatgggaaagcctgaaagactcctttttattccagaaataaagctgcttccttcagttcagcagcaacccctctatgtatgacagcccttctatgttagtcaatgtaggcttacctattggcacagatcagaattccagagggaagaacagggttatcttacacaaaatcccccaaattccaggtttctcccaggttccctattgggagacactggtggcacatttagcagaggagttgtttgcaatacagttgacctaggaattagatacagactccctatcctgactacagggcattcattgtgtgatgtggcctctgcttcctgtcctaactcatgtctcaccactctctcttgctccttaaacttcagctgttctgactttccttctgttccctgaacttgacgaaccctcgcttaccttggcatatgtgtcttctgctggaatggctctccctactctcatctcgcccctaatctttgcctggatgactccttcttcatatcattttgatcagctccaatgtagcagatcagatgacctagagtggggctcctctctccaccccactcctgaactatgacatcatttgatttccttgaaattattctattttgttttattcaaatttttaaaatttgagatgggtcttactctggggttggccagactggtttcaaactcctggcctcaagctatccttcttccttggcctcccaaagtgctgggattacaggcatgagccaccatacccggccaattgttctatttattgatgtccttctttgtttgtctcctcccctaagaatgtaaaattcatggaatcagggtccttcactttggtagcctccttccctagattcactttcctggaacaatgcctggtacagagctggagtttgttaaatttgttgaatgaatgaaagacaatccacggatgaatgtctctttctagagtggtaggtctggcaggtctgcttaagtacatagagcatgggatcctttcctgcccacgggcagtcttgcactctaggggggatgcttgtgccagtttccttctcaaagaagtggtccagcagtctgcaaggtgctgagcagaagtcaggagggcacggtgccctaccctcaagaattgtcagtctgaaggacatgcaagattcacacctctccgcaactaggcaaccacatacgatccagattaaaatctttaatgcagggataataataagacatcccactgtatgctatatagagctacatattggatatgcccaagagagatattggctatgatgatggtcatgatgatgatggtgaggaggaggaggatggatgtgatgatgatggaggatgatgatgacagaggaagggggagggaggtgggtggtggtggagtagttgttttccagtgtgaccaattcwgcttatgtgcacgtgagaatgctatccatctgaatcctcaggcttaccaggcttatttgatgtttttacttttcctctcacccctggaaattgaaataaaatatgttgaaatgctcagttgatacactatgagagtaacagaaagcacatcagggcttaccagggctcacaagggcantcctcaacaggagaatgcaaattccccaggagtctctctggatcgttgctgagttacctccattatttccttttcttggcagacagcaggaaaataagttgtggaaatgggtgtggggttgacaatagtgaccaattctctcatgcttcttgggtgtaagcctcctgcccctctcatccttccccaagtacttatcaggcccctagtgtgtgtcagacattgtacttggctttaaagatactaacttgaatacctacttctcaaccatactgctgttgagaagagacagaggaaaaactaataaatcagctttaaagttcagatactcaggccacagagattccctttcaatcagacttgcatggggcacaatgcataggttattctttgataactcttcaagggattcatatgtgcagccaggaatgagagccactgatgtgagcaagggaaaactggatgcatctcacgatgactgagctgccatcaccatggggccatgtagatctcagggaagtcatttaacctctcatcctgtgtctttaggagaaatgccatccatgagtgttatgccacttgygttatctcttgagtagttaggatcaaagagataatgggtgtggatgggctttgtaacctttatgaatgggtaaatggaatgtaagttgctattatgctctaggaaacaccaggctttggtacccatggagtcaggtgtcaccctggggacysagcaagctctggaacattctggaacaggattgaatgctctagacctgattgaatgagtcctcagttatgatggtactgaaacacagagtctagagcagacacccagaatcccacaccctcctgcctccctcgctctgtgtttaaaacagtttgttctgtcttccgcagagcagtgagcatggggagagaagtgcttttgcttcagaaccaaagtgggtgtatgaaatctgttcctctcccccagctgcacattctaaggaagccgagtgccagaggtggtcagaggctgatatgtagaatccgaaaaatacaggctgagccatggcaggaggaggtaagtgcaggagaggtggcctctaccatcaagacagggagtggaaaggatgttcaggggctttgggctatttggcatattggacgccaggccctgggagtgtggccagattccccatcatgtcctgccagttcataaaatcaccttaggaaatcccaaagttaaatgtgagcctcttcattgctctgctatgcaattatattttgcaaataggcccttgcttctgtccctccaaggggtagatgatgcttttggtccatggtggtttttgggttgaattttaagataccaatagaaatgacagtagtacagggtaactgcatgatgcccaggaaggacattagggatggtttctctccaaagcatggattcattgctgtatggaaaggcagtttcttctttgcattatacaggctccttgggctcagaatgaatgagctggtttgcatggggtggtggggatttgaaaccagcatgtcagtggacctggagaggccagttcttgaaataggatgaggaccctcttaggtttctgacgatgtctgtgtggtctgtaggaccgaggatgtggagacaagcacccaaactgtcaaagtcaggcgtggacagatgagtctcccacttctaccttttcatcccattctcacagcagacccatgtgayggaagggtcattattcctatcttataggtaaagaaactcaggcccagaaagattaagcactttttcaaagccacggggctggctaggttagccacagtccctcagaggcaggacttgaatttaggttcaatagaccctagagctcatggtatttcaactataaagctggtgcacatagatgggtaggctagggagtctgaacttaacatggtaggcctatgggagctattgatgactatagagcagggcagtggcatggttaaaggggtgctttaagagtttcaaccaggcagctctgaacagggtgagttgttgagatgctccaagtccagagtgtggattacctcttgcaaaagatagcatgatctcctgatgtgaaatatttgctgaatacttcatacttgatgggcactacactgggtgttttgatacaagagaatcatttaattcctacaacttaatgaggaagcaccattattggcaacagcagagtgcagaggtaaaaactcgagaccctgagggcaggcaaacctgattttctacctgtacgaacctggaaaaatcaccctacttctgggtcttttttcatttgtaaaatgggcatactattagtgccaacttaataaggtggttgggggtggcattaaatgagatagcacctagaaagtgaggagcaacgtgactctcatagagtaagtatttctagcatgtttactatgatcattattaccatagccacacccattttatagatgagaaaactgagacttagaaaggctgagtgttttttttcccccccatccaaggccacataatgaggattggagctgggtagtccaaccccagaggttctagtattctccattttctgcagagaggctgcgaatggggatcagcatagtgggtaatgggagagattcagcttgggctgaagtttggcatgacagggggtggagacagcacaaagcaagggtttttgcacctactctttcacagatggcctgtgccgagctggctctgggccaattaactgctgtccctccaattatctttctcctgaggaagttcacagtgcagccatgccytcctctctacatgtagagaaccagataagatgcgtgtgcttacagctttgctctgtgcacagaccttttcatgggtaccctggtcatgtctagctcagagtacatagagcaagggtgttggaggatcccacattccatcaccatctggcatgtctgacctccacctctccaccagtaccaatcttcccaaggaagtgtctcatagaccctttttattaggttccaatggtgcctttagcgtgtgtcttgttgagagctttctgtattccttgtgtacttagtgcaagatgctgatccaccaccttttgcagtcagaaggtaactctggtgactggcttcctttgaggcatcatttacatgggagctatcacatttcttttgtaatttagaacatttttgccccatcccaagaggcgtctcacagtgtgtgaggttggcgaatataattgcctttagactctacttctgtgttgtcttctgttggtggttttttttatcttgttgccctattttggcattaatgaagttctgtggacaactgctgaggtttataggtcttctatattctcctctttatcaataaaggatacattgagatataggttgggtattggatggttgggtagttcctcagggtaggaaggtgtaggtgatgatcttgaaggttttgttttgttttgttttggacacaatattcagaatccacacaaaatacaatctcagatactgaattcccattctttccatttctggtcttaaccaaggacagtcctttaggcttcattcacatcttcattcccttgtcatccacttatgggtgtgccaagacttctgccaggttctggggacataaagatgaaaacaacaaaaatctctgcccttgaggagctcacagtcttgttgagatgtgatttaaaatggttaatcaattcaagaatattagatttctgcaaaagctactgtmgggaaaacaataattatccaaagtctttaaatctattacccactttaattaatttaattaggtaaaattcatggaactgcaatgttggaaggggcccagaagacatttattcttgtttcttctctgccttcaggccatgcttcactcaaattatcccccaaacccatgcatttcagaaaagagcagtatttcgaagaactatagcttttggcccattctgatagaacttttagtgagcacccacagggaaagtgatgtaaacttgttgaaggaattgacatgcacagctacaaagtattgttctgaaaaacatgaatggaacatccacctttcacacacacacacacacacacacactctctctctctctctctctttctctctctctctctctctctctcagtggaatccccataagttatcttgttgaggttgtgttcaatactcatggtaaatacagaacgcaaaataaaaacatggctgtaatatgatgaggaccttttgataattctttcagttccctgaaagaaatacatctcagcacttctcaaatcctgttttgctctaacacagaggcataccttctgtttagttggcatttttgcaccatgtccacaagtcaacaacgtggtttaagcatctgttccatacagatcttcagtgatcccaggaagactgtgattgagtgtcagaaagggggcaggatgcagagtcatggcactgaggtacagatgtctacttgctctgtgactgttttgagcctcgttttccctgccagcaataccaactttgtaggatcattatggggatttgatgagttagggggtatgaaggcagtttgtatattgtaccactgtatgcatcacctgccttttctaaatggaaatttgttctcacaatcgtagatgggtggagatgttagggctaatagaggccctttaacctgacataagttaccatgccactttctagggtgagagcattcagtgactctcccttatgctctgaataggccctatgtgcttggatttctgccaagctcttcaacatcgtatcgtccgcctcctttcggtgccatgatgcattcatctacagcttctgagatagtcgcagtgcatcctcgggattcctctgactgtaacatccatgcacttctcctcttcctcacctggattctccttcagcacttcatatacctcttttagctcttagtttgtagaagttgtcttccacttaattcttattaagaacacttaataaggtgttcgataaatatttgttgattgaaaaggtagatgtccacatggtatttatgatactctgtattatgtgggagccgtatgttcaagtgacagaaaccctactcaaactcyttaaatgaacatagaaactcactggcttgtataacaaaggggtccaggagaaatggcttcatacttggcagactctaggggctccaaatatatcgttagaaaactgtctttgctgatgctgttttatttccgtggcttgattttccggtcatgagctggggtgggggtcagatagagtttgttctrttagaaccatatagactcaaaggaggaaggggcaggacgaactagaggaaaatgagaagaatagatgataagcaagcaataattacagacatccttccaggacctggctatgagctcctgagtacaggggcttctgtcctctctgtatttgcaggatctgttctggagtctgggatatagtagatgctcaggaatgtctgcaaatgattgatgtgtgatttactttccttacttctaggacgcagtttgtgcttctatataaaccacctcctgcctcatcctctgttttactttcttttcactggcaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagargatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccgtaagaaagggcttgttgtctcccaaagtgggatcagagttttgctgttgtcattgtttgcttgcttacatactcattgttggaaatacgcactgaaaatgcagaatgttatgtgtttacttacgggacttttattttgctctcctctctctttctttcatctcctttgtaagaaaagtcacattagactttgtttcctgcaacttaacttttttttctactcaacaatatatcttggaaacctacacctgggattgatcgatctgtctgtctgtctatggctgtatctcaagtgtatctatattttttgtaactcataaagatttgaacccagataagtctaacctcatagccctcatcacattcttcactatgatatcatggtatcatgatttagttrtccagtctgcataatggtaggaatttasgagttaattttcttttatttaaaaaaattttgtgggtacatagtaggtatatatatttatggggtacatgagatgttttgacacaggcgtgcagtgtgaaataagcacgtcatggagaatggggtatccatcccctaagcatttattctttcagttacaaacaattcaattatattctttatgttaaaatacacaagtcatttattattgactatagtcaccctattatgctatcgtatagtaggtcttattcattctttctatgtttttttttaccctattgatcatccccacctcccgccccaacccccaatacaaaaatgtgtttatttatgggataagtgaagtattttggtacaggcatacaatgtttgataatcacatcagggtaaatggggttttcatcacctcaagaattcatcatttgtcttataaacatttaatttagggattttgaagcttcctattagaagctaaacagctgtgataatctttatacatgtctaagcacatgtgcaagtgttttttctagggttgattctaagatataggatttttgggtcctaattcatgtgcatttttaaatggaagcatctattgccagattgtcctgcaaagtaacaacaccaatttatagtcacaacaacagtttgtgaaactacccagtttcccacatcctcaccaacatgttacgctttggggaaacttcccacactagtgctcctggtctctgtttgattttgcatttgattttttcccttcttatattctaagtatttttgtaggccattggaaatcttggcaaacattactcacagaaccgcattatattccattatgtgaatgtatcataatttatttagctactcccatcttggcgaacatttaagttaaattttaggtttctgagaagtgtcattgttccttgtggcccatcattatggttcagctgttgagatttagaatgatcactcctatccckattttgcatggttttgcctgatgttcactgatttaatccacgctttattcctcagataatgagcagtgtagaactgtgattaagggcctcaactctggagttagacttgtctgggttcaaagcttgtctcgtccactttctgtwtgacttgcacatcattttacttttctgggcctcaggtgtttattgcaaagtgatgataatagcacctaatttctaggcagtggttctcaagcctcagcaggcatcagaatctctgggaggacttgttaagacacaaattactgggcctcaatctcagagtttctaatgtaatagaaaatatggggtgagcccagagaatttgcaatttctttcaagtttttgggtgatgttgatgttcttggtctaggggctgtgctttgaggaccaatgttctagagattgtcatattcattgaggtgccgcatgaaaagtactgtttagcacggtatttaccacatagtaatactaaataacttccagagtgatcagtgaagtttttggtcatcagaaattacagtcagcaggctgggtgtggtagctcatgcctgtaatcctagcactttgggaggccgaggtgggtggatcgctggaggccaggagtttgagaccagcctggtcaacatggtgaaaccctgtctatactaaaaatacaaatgttagccaggtgtggtagagcatgcctgtgatcccagctactcatgaggctgaggcaggagaatcacttgaacccaagagggagaggcagaggttgcagtgagctgagatcgcaccactgcacttcagcctgggtgacagagtgagattccatctcaaaaaaataataataataaaagggaaatacagtcaacaaaccatgttggtttattaccagcagggtactatgtcactctgaaatatttctgraaggctttaggactttgaatctgctacagttcagaggttatctctgaactggggctggaggagtgtgtgtgtgtgtgtgtgtgtgtgtgtgtgtgtgtgtgtgtgtgtgatgaagtagacagaatatacttcttacaattaacataaatctgaaaaatgaaccttgaattaagaaatcatgctcctttgacatttctccgtcctctgtccttttactctctttagtaatcctgtttctacactgccactttcagcattttaaataattgtccagatatcaggaaggaactcagataaatcagcatgagacatgggagtctcttacagaggcaggattgctgccagcccaaagacacaaacgaggctaatgaattctcacttccatcataatatgtgccctgcagctggaatattcagaaacatataattttgatggaaacataaatcaattttagggcaattgaaatataacatatacaggaaaaggaattctagaaggataattggcaagacatttagatccctttccagtgaccaccctggattctatgctttttttaaaaaattctgctgctgtgaaatgctgttgcgcaatttcccaaagttaygcctttaaacacagtaattttgtaaatggtatttcagccccagagaagcaatgcatcaagcgtggtaagtcgccatccactgcttggtgtttaatgaaacatctctccatccatgcagggctggtggtgtccacccagtgtgtaagtttggataaggcacaagcagtctctccttcccacactctcccacggtccctgacgcccaccccagggaatagtggaaacctgccaggctgcccttgacagggagctagagaaaggccaaagaaagcatttaaaaacaaaaaaacaaaaaggattatatctccttttttttttttttttttttttttttttagacagagtctcgctctgtctcccagactggagtgctgtggcacaatctcggctcactacaacctctgcctcctggattaagcaattctcccgccccaccctcctaagtaactgggactacaggtgcgcactaccacatttggctaatttttgtatttttagtagagacgaggtttcaccatgttgtctaggctggtctcaaactggtgacctcaggtgatccacccgccttggcctcccaaagtgctgggattacaggcatgagccaccacacctggtcaaggcactatattctatcctctgtctatcattgcttccaaccaacagactctgtgctagcccctgggatacatagatgaattaagatataatttctctcctcaaacaccatacagtctgatcaaggtgggggaaatttatctaaagacaaacttaggaataagaattctttttttaatattgaaaaaagaatagtacagaaaacaacagaatctgataaaatactcaacccgatattcatcatagggaacaaagctaaacctgccaaaggttaatgtttgtttcaacattttgaaagcaataaaacattaatgataatgtagaagttctgattctatctgtttccctgtcccagttttctcctgttctctccatagaagggaaaacatgataatcagtttggtttacatccaaatccatgtacatgtgttcgtactttcaatacacatacatgtgcaaccgtattcccaatgcatacttctgtctaacgtacaaaaatggtgtctaatgtgttagaacttcctttacctcaaccttatgttttcaaaatccctctatgaagataattcaattgcatttattttattgatgatattctgttgtataagtgttccatctttacacttacataattcctctttgatggacatttaggtttttttatagtaagatatttttcagtctggatagctgaaagcagagaacagacctatctgtagcctgtgttagatctaccagcttgttcaatagaagcccaggactctggagttaggagttcttcacttcaagcttaaaaattacatttgcagctggattaaggtcttactctgcaaagcatctgataaacaaatagctctcactattcctcctatgtagcagggaggttgcaaatagctccagaagaagttcagatgaggtcatacctgatatcttcgtggtgagttactgaggggatctgggatccagatttgactgnttgagaacaaagtcwtggggccagctagacatgccacttggtggtcctcatggactttatttataatctcaggcaaagagctggtgcagttaggatattgttgctcatgggctgggcgtggtaccaggggctgcttgcaagggaaggtatgttcatgaccttacacccaaccgtttctgtacatagagtttcaggcaaaaaaaagtacaggaaagggggacattttcttcatgtttaatattcctgattttacagaagacactttgaaaagagcagtcagcattttccaaagtttaaaaatagctcagccatgttatataacctccttgctactgcacagttattaaacatctgttccttcaccaagcacagaccatgtcactgttaactcccaaaattgtgaaggtaaaccwtgacctgtttggctggtggaatcccggctgttgtgtccggttccatcacaagaatctgtccagttcaggagtggccagggccccctgggaggcagtggcatcacggttaagagcatgggcactggggccaggttgcatgggttcgaacctaatctgtacttttttagacttcggaccttgggtgagtcactgaactccacgtcggctccctcaggtgtaatatggggacaagaaaagcatttgcatcttagaccagtgtgtggcgtatggaaaagcagtctgtaaatggttactactatggatgaaacttgtagatctaaagttattaggccgggcgtggtggctcatacttgtaatcccagcactttgggaggctgaggcaggcagatcacttgaggtcaggagttcgaccagcctggccaacacatggtaaaaccctatctctactaaaaaaaaaaaatacaaactttagctgggtgtggtggtgcacgcctgtagtcccagctacttgggaagctgaggcaggagaatcacttgaacctgggaggtggaggttgcagtgagctgagatcacgtcactgcattccagcctgggcgacagagcaagacccagtctctcaaaaaaaataaaataaaataaaaatgaaataaagttatgagtgaagtaagtgtctcttcatgccatagcccatgatattaccatttgttcattcaaaaaatgtctttggtgtcttacataagctaagcaccaattattcatagttggagagacacaaaaaggccatcatgtgattatcaggcggggcagggctgtcattcatctattgtttgctctgaggtttgggggccagtggaatattccatagtagaggcccagcctcccaagttggaggtataggagaaagaaaaatgtccttatgctaaagcacagcacctaacaagaggagtaggatctgggtgactcaatgctctgtgattattttccaagctgctttttggtagcttttatttatttcctctggtgcttaaagctctagccactaatgcctatttggggcttggttcaagcatatagacccaggtgaaattcatatcacattttagcctgtggttttatgaaatgcaaagcattaagtttgtgctgtgagtgctgtgtgtttgtgaatgtctacaggtgtttttgcacacatatatgtacatgggtatgtatatacacacatgtgcacacgtttacctgcatttttgtgtgcgtgtgtgtgtgtctttctctctgcatgcatatatgtgtttcttattccacagcggaggggacacattttacacttactgaagaggaggtcatagaagggagagggtggatgtttttcagaccaaaaccctcttaccaaaggattaccttgggagaaatatggccattgggaagagggcagtgtggcatcaagaaaacttcatggtctaggtagtatgacagacttgactatgaatttaccacatatttaccaagtataagttattaacaactgtgaacccaggagttttcctaaagagggtgygtgtgtaagatagacatctcttcttcttgtaacatcttaaagtatatacatttagcatggtgccaggcatggagaaggcattttacaaataactatcagrtcattattataattttatttttcttattattgtggtcatcatcatcattattataactttatacttgttacactgcaagctctgagtaagctaggaaagcaagcaatggaagtgcatttcagttctattctttaattactgaattacaactgtatgttctgtgtggttcccattttagttagggaagtaggacatggagaagttactgcactggaaatcaagtagaagagctcaagtagatctatagcacaaatgagkgggcaaaaaaagtcttatcccaggagagttatgaattagtattgaagggaagttatttggccttcattgatgacacctggcatgaccatttatgtgttttggattgacttcttgagttatgaagtcaggcttcagctttaaaaaccaacaacattgtaaattattacccctgcagaaagggaaatagaaggaagatatatatgtgagaaagagttttattcatgtctaagttacattgatactactttaaatcttcatttctaaaataacataggaaaaattcttggtttaatgacccattaagagactgtgctaaacctggttgacatatttttatttagtaatcagaatgatcactgttggttttttgtaatgccaatagaaatgcctgctcagttaattctctgagcttgaccagagttaaaacttccctaggtgaatgtgattaactctttgcaaatatttatctgggagatcaccatatgctcaacaaacacttctcgcagtgaaatcaggcacctcagaggccaagctgtcctgtgggccttygctgtacatctgattgggactctgaactcagaagtgggaaaaacagctgagtctcaaagtaaatcagcaagagatacgaggtgagagaatccagaggaacacaaatcatttttcccaaagctatgtgactttgtggaatgtagacttagacagtgctgtgttcaaaccctcttattatctgggttattctgggagagttccttaacttctttgagcctccatttccttgattgtaaacagagaaaattccaagaatagggaggatgataccacttaaatgcaggtattgtgcttagtcaagcatctaggatatagtcggcactctacaggtgttaattctcctcctctcctggactagaggcacagcttgatctaggcctgatggacccatgagagtgggctgagcttgctgggtgttcagcctgagcactaagtcaacagcctctcttcagcatcatctctgtttgtggcatctctcctggaacacagccctcccttttatggctggaagtcaaaagaaccgtatgccagccctgcaatgcaagtcaatcatttccaattggcacccaatgaatagctcgacaaatggtagaaacctgatgctggcagcttgggaggaccagaagttggccgtgcctttaccttgagggaaaggtggtttgggttgttttggggtcacacataaagcacaaatattgttcacatttgccttaggccagatgtaagtcttaggattttggaaccagaatgccgaacaaaaaggcacattgatctatttcctccagggatgaatactagagaagttttcattttgaaatttagtaatttggtgacatgtgctaattatttgttgccactctcttttgtgaaaaaacaaagcaaattaagccccatctctattactctgatgcctgctaacagagtgtatactggggctgggaggctttaatgtgtagaaacataggctggttgggagatcatagcacaggtctaggaaagaggaagtggtgacttgcattacagtaatagctgtggattcagagagaagtgggcaggcttaatgcatatttgggctataaaattgacaagacttgacagatgaatatgaggtgttaaaagagctataataataattttcctcttgtatagctgagtagatggtggtgtcttttactaaacagaagaaatgaggaaagaaatgttggggaacagagagtcagggacatccaattttagacatgttaaattagacatacttttgagatatccaagtggaaatctcagtaggcaatcagagagaagagtctgagtacaaaccgaaaatgcaatacacaggatttgagcttattgatggcagtcaaagccctacgactgggcaaggtcttgcaggggagaatgatgactcaggagggcctgggtttaaaccatraggaactttaacattaattggtaaataatcctccaagggaaaggagaatgttggagagaaagagttacgctgtaaattccaggtgctcttcccacatggagactctgttcccaatgttgattttgttttgatgcctggtgggcgtctgcacagtgtttgctccatgatagacatcgtagtaggccttccaaaaatgtgtaatctatggctatggtgaatatatctgggttgggtgcatccttgcagagttaatcctaccagcagttttatttaatcagtacattgagaaagtatggcaagtcaagttttggctttggagagataaggaagtgatgaagctttgggtctcgacggatgagggaggtgatgggtggtggagcattgggtctggagagataagaaggtaatggaactttagatctggacagatgaggaggtgatggggctttgagtctggagagatgaggaggtgatagagctttggtctggacagatgagtaagtgacgagtgatggaactttggatctggagagatgaggaggcgatggagcttttggggtctggagagatgagggagtgatagttcaggcagggggaaaacctctgtttttgtttcattctggacacgatttgggcaacatctgatattgtacaaaaagacaaagttaaaaatcctttctaccaaaagggagaagcatgcagcaaagtataaaggggcaggtgctcacgaccgattaacttatgagctatcgttggtttgctttcctgaaagagtatctgtctatgcacctctatctatatataggccaaaagctctcctgatcatcccttccaggtgggagcaagagaggcagaacgggcctctccacctgttctctgcctttgtctccttgcttctttgcttctctcacctcttgcttccatgtggatgctgcctgcctgcaggtgtgaatgagcccccgtccaggttcctggtgcctcaaatcctggcatgaatcttagggatggaggagtcacggtccagcgtgatggtgctagctgtgttctgcgtgggcatgggaggccagccacatttctacatgggyctcaaagttgggtaaatgaactggcagatctgctggtgtctggtgtaccattgtccaaatccccacagtcagcttcctgaggatctgcttcatttggttaagtcttggccaaacacaaagagtaaatccacactgcccagttttccatgtgatagaaaatagctctcctgagaaatgtgctcatttccttttcatttccatcactattaataagaggaagtttaaacaatttaatttaatcaacgcatcattatgtatgtgagggtgagtggggaaacttcaagtttcataggttatattatctaagcatatatatttttaaacgtgaaagtactctaagggtaagacctaccatgtattgacttcctcctatgtgtcaatctgtttaaatatattatctttcatccttagatgtgagttaggatgtttttactgcaggtagcaatcaagttaactcaaagttatgtgattgaattagttcccgtaacaaaaattccagaagaagtttggacttcaggtgcaatataatcaagcttctagttcttttctctatgatctcttgactctgctttttgggcagtgtgattttttttctctaactgacttcctcgttacctcaagtttgctggtaacacctgggaagacttctttgtggccaaattaggtcatgtacccatcttgggccaataatggtgattttgaaaatgccaggtactgactggcttaactccaaactcctgacccagtcacagagaaggcaaataggttaaatcaaaccagacctactcctggagctgggaatggggtaaacttcccttgagttccatagattcttacaggaggcatgaagtctcaataaaatttgagttctgttaacaatgagaaagaggtaaatgaatgctagagtaccagcaggtcaattaaaaatcatgattcatattacagataagtaaacaggactagagaagttatagaacttgaaaagagccacacaggtaatgtaaaatggagccagaagttaaatccagtttcctttggttccaaaccccacgttacgactttcagaggctgcaaattgacctgtgttgtgtgcatgtttttttttttttaaacttagagtgtttttcctgtttccaaaagtaaagtcccaatgtttaaacactatcatcagatttcacaaaaattatattttttgtttaccatgaaaaagatggagttagtgataataatcccatatcctgacctgctaatgatcaactggaagctggaagtgactgtcatctctgcgcagtacaccttagtcmccacctgggttggtttatttatccatgttacctccagggctttttaaagtattttatcccaggttgtcttgtactcatttttattatttttatcataatcatcattatgtgtatttatttccaaaacaagaacttgatgattattaagattggcagatattagaatgagcaataacagggagttttgatagctcacctccagagatcttcrtacctgagttagcacaactggaagtgtgtacaacataggtctctcttatcctatatgcttacagcattactggtcaaacattcttacttaaagctgcaggtgaaatcatataaagcactgctgggatatgattttccatgactagaggcttcccaagattggagaggcgcctctaatcttttgcccacattttctcaaaacaaagtaaaatgaacttggctttcaaaattacagctgggtgtgtctggtacatagtcatctgcgactaagtgatcatttcatgtagctgtagatcataaacctccttcttggttcaacttacaggtgagaatttgagttgtttgtgcctagagtgccttacccaaaggcaaaaacttcctgaattacccaaggagagttccccttgacagactgaattaatttgtagatgttattttaaggttggaagaaaatatttgctctggtggggtgtgcagtggcrttatgacatttgtcaagtgaatggcaaatgatggagccggatggaacccgtattacttgcttaagaaattgtcttgaaaatttccaatgtgtcatttaacgtagtaaagtatttggttccaatctgctttctttttcttagtcatactgggggtttcaatatttgctttaaaaataaatttggggtttgtaaattctaactacttggagatatgtttgagagatttaatggtcttatttaccttcaatgaattccattctattgactgctacttcagaccaagatggactgtaatatcccctacagactgaaacaaccaaaatggacaaaaaatttgaaatgattgtttttaagaccctgaatattggggaaaagaagatagaaactaaaataagtgagtttaccacattttatttatggctccactcaccaccttgagagagtttccaggctgcaacttaaggataggggattcaagtgtggcagactccctgaatggcagagacaaagttgaatctaggaaacaaaagcagctggatttcataggagagagtacctgagaaaagtgatccgcgtaaatggagatctgcctaaggcccaccttagtgttgagctgaatactgctcaacataagggtgaggacactacctaaagccaaagaaagaagcctcccaaagattgaaaataacagagcccaggactcacgtggagtgagggttagccgctagtcagactagaaaacccagttattcatgggcactgagttgagtacacagaagggggttgtctcaataatggagaaataattagctgtagactatgaattgctctcactctgcctaacaaatatcaaaagcaaaatttgaaaagatcaaactgtttccaagtaacttagtcactctagaacagagctcagtgatatttatagtaatacaaaaatatcagcacgaaaaaagttaaaatttataatttcttccatcccatcaaaagttaccaggcatgcaaagcagcagggaaatataatccataatgaaaaaatatcatgtaacaacttacccagatttaaatgaatgttggaattggcacatggggctattactatagagagtaactctaactctcaacttcataggttcaaaaattcaagtggagacatagagaatgttttttaaagaaccatatcaaactactagatataaaatctacaatgcatgagataaaaactacactggatggattaatggcaggtttgacattgaagaagaaaaaaatcagtgaacttgaaaacaaagtaatttccccaaatgaaactcttagagaaaacacaatttgaactatgcattgagcacgactgaggattttaatatatgtttaatttgaatccctgaagtaaaagggggcaggaagaattttggaaaaataatggaatgaaaaattttcaaatttaatgaaaactataaaccctcagttcaaaaaacttaaatcctgagaatgagaaatatgaagacatagcataatcaaatttctcaaaatcagttttaaagatatatcagctaaaaagatayaccacagttgaaagctgtcagagtgaaaaaagatgtcagccgacttctcgtcggaaacaatacaggttagaaaagaatgcagaaagatattttgtactgaaagaaaacaatgtaaacttagaattctttgcacagtaataatatctttccacagtgaaaatgaaatactttttagaatagaataactggaagaattagcagcagatctgcattacaaaaaaatattaaatgaagttcttcagggagaaagaaagtaataccaaacagaatatggatcatcacaaaagaatgaaaagcaattaaacaaaaactagattgttaaacgcatgaggtttttgttttttttttgttttttttttttttttttgagaccaagtctcactctgctgcccaggctggagtgcagtggtgcaatctcggctcactacaacctccaccttctcctgcctcagcctcctgagtagctgggattacaggcacatgccaccaagcccggctaatttttgtatttttagtagagatgaggtctcaccatgttggccaggctggtctcgaactcctggcctcaagtgatccacccaccttggcctcccaaagtgctgggattacagacgtgagccaccatgcccagcctcacatgaggatttttaaacaatgaaatcattttaaaagataaattacttttaaaacaaaaatactaacaatgtagcatgaggttaataggttgttaaaagtaaatatgacaacaatagcacaaagattagcagggaaatcaaagtatactatttgaaggtcttatggtatacttacgtagtatagtggtataacatcacttgaagataaccatgataaatttaaaatatatactataaactctaaacaaaccactaacattaaaaaaaccccaatgctctggctaataagccacaaaggaaataaaacagaatgataaaaaatattcaacttatcaaaagaaggtaagtagaaaggaaaaagagaacaaagattagatagaacaaatagcaagatgataggtttaaacctactgtattaataatcacattacatgtaaatagtataaacatcacaaagcaagaaccaactctaaggtgcccataagaaacccactttaaatataaaagcataaataggttgaaagttgaaatatggaaaaataygtacacactaatactaattttaaaaaactggactggctgtattaataagacactaagtagatttcagatcatgaagatttttggcattaaatattgccatttcattatgataaatgagtcaattcatcaaaaagatcaaactatgcatctagtatagcttcaaaataatgaagcaaaactgatgcaactgcaaggggaaataaattcataattatagtaggagatttcaatactcttaataattgctagaacaagcaaagttagtaaagatacagatgattttaacaatgtcacaaccaagttgacctaatatttgcttgtggaacactccacccaacaacagaacacacatttttcaaatgtatacagaaaatttatgaggatatatcatattctaggccataaaacaagttttagtatatttaaaaggattcactaacacaaagtatttctgtgaccactttgaaattaattagaatctaataactgaaagatctccagaaattccccaaatgtttgcacactaaataacaaacttctaaataacctatgggtaaaagaataaataaaaacgactctttactcaagttgtcccttggcagaaatccaagcctctttgggaaactgttcttcactcaggcatgcggtccatcttcagttaaccaagtcacagggacatttggctctttgcttggttagttgctgctcagaacagtcaggaattgatgtctacagagaggtttgtgggtatgagggcatgaagaatgtgtttcctaataaaaataatagaaaactgggtccagatgggcgtggatgtaattctcaggcaagccacattccctgccttcatccgagtttttatgaggtagtggaaataggacccaaactaagatttaagacattgggttttaatcctagcttgctcctgcatatggttgtaatctttgttaagattcttaacttttctgattctccttttttttttttaaatctgcagattgatggtgttggttacaataatctggaattgtatttcatgatgtcagagcaggcagggatgctggagatcacttaggccattaacttgtaattatttttctcctttgtacaaagcaggcttctgggtgcttttgcaatatcatcacactccctaggatgtaagtggtagctccaacccttttcttccacttaagaaagattagacggcaaatgagtgatgataatgagtctgctttaaattagatcaaagtctaatttctcttttttatgtttttaataatttataaaatttgcctcaaaatgataaaatatattattagttgtaacaacgtattttcaactggttttacaaaatcaaaataaattacttctctgtgttatgttacagatgaggaaattgaggccccaaagagacagggttaatgttttgctgtctggctcatggcaaaggcatgacagaagcacagtttttctttctcccacacctaggtgcattgcttccactacaccttctaggttctttgtggttattaataataaggtgatcatgattgatgaagatgatgatgaattccaggaaccttgtccattttacttttgtgcaccagcacccagcatagtgtagacacttaataaatatatattgaataagtcaataatgataattgctaccacagcacttattctgatctaggtggtatgttaaggattttcacatgcaccatcttatattattgtcacaacatctctgtgaaataagtagtagtgttatttctattttcacatgagaaaaagatttcagagagaagaatgaccttccgaggctcagttagtggtaggatcagtatcaagatgacctctctggctttagcacccgatcttctgattctctggcttctcaggggaaagaaaaggggtcagttgtgttttcatgcggtccgaggacgtcttccaatgctgcgaagctggtacaaagatctctcccttgtgggtaggagacatttgcttgtctttagagttaattcatcatgaaagtgtgactgatggaaattaattttataaactacaaaacctttctgaaaatgttaatgttgtcatcaatactaattattattattgtcattagcacagggatctatgtttggcattgccaataataaaacaggcagaagaataaaggggagaagctagtctttcctgggaaaatgtttataagaatcgtcaaaagctcaaatgcagaaccatcaactccctctaaattagttctggaatgagtcccttgagacatcgtgcacccctgaggaggacccatacatattaactctacagaggattgagcaaaatccccagcaagggaatcttagtaattctgactaggcagaaggaaggaaataaaaggtagaaagaaagaaggaaaccaagatttaattgtgatactgggtgcaaaccagtctataatgggcttgtctgcctggattttaaaagtttgggaggccgaggcagggggatcacgaggtcagctttctggccaacatggtgaaaccccatctactaaaatacaaaaaaattagccgggagtggtggcgtgcacctgtagtcccagctacggcaggaggctgaggcaggggaatcgtttgaacctgggaggcgaggttgcagtgagccgagatcttgtcactgcactccagcttggtgacagagcaagcaagactccatctgaaaaaaaaaaaaaaattcaattcacatatatgcagggaggccaagacactggtaaatattttccattcagtgtaaaagatgacagcaggaggagggatccatcatacttcttagctatttacttgagtttaaattttatcttgactttaataaatctttcaaaagagagcatttcttagaactctgaatgcaggactgggagagggtgtttgtcttcagccgatgaggtgaaagcaaaacaaaacaaaacacacagaataaaaacagtcccctggcatctgttacccatgttcacctagcaatttcctggaattctttcattcgttcattcattcatgcattcacccgttttcattcatttgtcttttcatgtatccatttaccctcaacagtcagctattgtgcacttgctatgggtgagaccttatagtaagtatgagacacacacagtcacgcacaaaacagaaaaaagcatgctgctcaaagctcctattctagtgagaagagagaaaataaatgaatacaggcaatgtcaatttgctattgatatgggatgggaagagaaacggagcagagagtaaagggatggagactgaaggatggttattttagacagaatggttgggaaggtgaaatttggcagatacctggatgaagtgaatgagaaagtaatatgacagtctgaggaaagagcgttttggattggggactgccaagggcaaagacctggaactgggaaattgcttggagggtctgaggagcagcatgatggtcagaacggcaggagccagaggagcatgcatttggagagaggagccaagttctctaggtcctcagagaccacgatgagagtttggaattttgtttcaagtattatgaaaagtctttggagagttttagcggggaagtaaggtactgcagtgacctctgagcttgcccaagttgtatctggagcctcattcactttttcttttccctgtgacaattcatctcctgttagacaccagcttttcctagggtggtacaaaatgtacttgcctttccagattccatttctcttctccttaccatgcaggccttggtgggtcctatttgaccacagctaatcagaataatcccatgcatctcactacagtgcttggttcaggaatgggcacactatctaatttggtctaatattaaaaatttctgagctatatgatatatggcaagtgtgtaaatgtgagacttggaatttctgctgccatttttccaccatgaaataaaccaggctgatgataaaggcaatttatacatgaggaagaactaagagaagcatggtatgaagaatgagtcagagccatgatctgactttatctgaaatctaccctatcgctgatcttttcagagagatatatatgtatttttttgagatggagtctcactgtgtcactcaggctggagtgcaggggcgtgatccaggctcactgcaacctccgcctcccgggttcaagcaattctcctgcctcggcctcctgaggagctgggattacaggcgcacaccaccacgcctggctaacttttgtatttttagtagagaccaggtttcatcatgttggtcaggatagtttcaaactcctgaccacaagtaatctgcccgttttggcytcccaaaacgctgggattacaggcatgagccaccgcgccgctccaatttcagacattaaccactaaacgcccgtagtggtttaattttgtttaagttagttttttttttttcattgcaaccaaaagaactttggttgcataatttacagtgaatgtataatattatgttaattagttgatgtattataccctttaatttacatggttacatttaacaaagctgaatgttaacaaagtgacattttaagtaagaatttgagaaacacttttgcacaagatactttggactttaatttcagacagaaaacttctcaatggacataatttgtgcttcgtatatgttagtcgcttttgaatgactcgaacctatacagtagtcccctcttatccttggtttttctttctgtgattccagttacccatagtctgaaaatattatatacaatacagtattttaagagagagaccacatttatatatcatttattctagcatattgttataattgttctattttattaataattgttgttaatctcctacagtgcctaattcatgaactttatcataggtatgtatgtctgtgtaagaagaaacatgatacatacacagttctgtactatctgcagtttcaggcatccactggggatcttggaacatattccctgtggatagggagatactgcagtacatccacaggctttggaatcaaatttcagctttttctgccacttattagctgtgagactttgagcaagcaactaaatatatctgagcttcatttttgtcatcagtaaaatagaaataatgctggtccccactcacagtgggggagtttgtgagaattaaataaagcatgtaaaacatttagctcagtacctggcccacagtaagtgatctatgaatgctggctcttatataataatataattctcggaataaccaaggaaaatagaacaaaaaatgccacctagatggcaggattgctttgcatagcttaattaagtatgtttcattattccaactccctggggcttttgagaataaaatttttaaaaatgtacaacgacagtctcattaagagagtgcagaaggagcaatctctaggcggggagtgagagggaggacgtgttgaaattgtggagcagaacgcacgagtactggtgtaaacttggtccttaaacagtaaatacacacatccaaccacacaaccatgtctttccaaaggaagtttttaaaaagttagaagaacttgggtcctgtataagagtgagatgttaacatattttatttgactgaagagtctagctattataagatctttatttcaaaaaagttaaagtgcaaaagatgtgcattttggaaccgatgcagtagaacagtggtgcattccatgtccagttttccaagtagctgtgaggtaggcgatattatcctcctttgagatgtaagaacattgaggcttaggaaagtcaagtgcctttttcaaggtcacattgttagtggacagcagtcacaattgcattcatccattcatctgaagaatttacctagtgttcagtgccaaaccccacaggggatacaccagtgaaaacaacagagcatgacccctggggttataatctcatagggaatttaaacaaaaatgagtaaggaatcaaatacataaaataattgcactatattatggctcctgtgaagggcagatatggggtactgagatggaaaacgtgaaggatggaaggaacacacctcttgcctctttgcagaagtgatgtttctactgaaagctgaagggtgaagaatcagatatgaaaagagccggagaaaagtcattccagccaaagggagcagagtgcgcaaagtccctgagatgggaaatattttagtgtttataaggtaataaaaacacttattctcatggtagactcagtttcgggtctttctcacttcagagtgtctgctatgaaccactaggcaacgctacctctgcaaaagggaaagttgggtgtttgaaggccaagagacaccatggagcagtagctgccaaaaggatgctcatcacttcctcacatcacttacttaactccccagaagaaaattcctttcatatgttaaatgaccaactccatctctgccttgtaaaagctggaggagatatttgaagggcttctgttaatatatgggatgtgggtggcggggaggaactggtggaaaagaggtcatgccttgaaaggttggaaaagggaggatggtggaaaaagagctaggagtggaccgttgactcctagtgaagaaggctgcatcaccagccacctccgaggtggaataccaggtgtctgttaatccgcagcaggatactattagaaagcccatttcacttgtcactgtatcgctgtggctctgagagttgtgccttttggttccaaattgttttcatttcagtaccttccttcccaataagtggtattgaaaatgagggaagaatgagaagacctcgatttatacgtgccggcagattcagggtgtatgaaaagctcctactcacaatttctggttctcttgagaagttgggtgatgtttaatgcaactttctcttctttttttccaaggactcatgtcatgaagcttttgactgttgggaggatctgtggggtcatgggatcactttgctttattaccctcctaattagacataattaataattattacaataatgttatatagtgttttagactcatatacaaaatcttgaatcctcataacaattctttgagttgcatgggattattccaattttacagataatgttcacagaggtgacatcatataaccaagattacacaaagagattgacctaactcttatgcctccaactccagaagacaaagttggcaaataattggcagatgagaaattgttgcagcactctcaataatcccaggaaggaagtacagatgttgattaattaacaacaaccaaaggtattatcacatctrcagtaattagcatttatcaagtgcctagagtgtgtctggcatactgtgctaaattctatttattaatcaatctaattctcacaacaaacctgtcatgtaggtgccattagtatctccatttaacagatgaaaaaacggaggctcaaagaggtgaaataacaactagtttatataagtagcaagttgcagagacagttcacaaacccaaataatttaactccagagtcagtgcttgtcaccaccacctaaactacctccattgatggtgtacttctaatattaataacaatgacatcaattacatcaattcattggacagagcaactgtgagttgtgagtcccatctcttaccattggttaaaaaaacatacaagttttaggagcaggattccattacactgtctctgttcaaataagtagaaacaagtaattggggcaatggccttgataaataatcttaccataaagctgctttcacagaaaaatacttgtttgtatgtattttctacctttattagaacatttggatagttgtgtaggtctgtgctgttcttaaggaaggtggctattattaagggtggtggacttgattcaagtcctcccagttttgatgtgttccttgaccagttgattcttatttccctgacttgtaaattgcygtcagcttcagcttgccttattaagaattctgtatagttggccgggagtggtggctcacgcctgtaatcccagcactttcggaggctgaggcgggcggatcatgaggtcaggagatcaagaccatcctagctaacatggtgaaaccccatctctactaaaaatacaaaaaattagccgggtgcagtggcagttgcctgtagtcccagctactagggaggctgaggcaggagaatggcgtgaacccgggaggcggagcttgcagtgagacgagatcgcgccactgcactccagcctggatgaaagagtgagattccgtctcattaaaaaaaaaaaaaaaaaaaaaaaaaaaaaaaaaaaaaaaaaaaaaagctgcataatcaataggctgtaaataaatggaaacatatgccccttcccacatgtggggaatgttgctgttggctcttctgccccttagctgtcttgtagcacaatgcttcagctttcagttgagtctctttgtggcttgtctaactgctgctatcatatccaggtgattaagctgttatagccttaatggcaagtttcaattcactgtcgtcttcctcagctttgggtctgggagccccttacgttcccactttgttctctctgggaccatctttccatcttcaataagcctaacttctgagccacagcaaaacaaatgcgtatgcgttgaagatagtttcagaacttgtgcattgggaaattttctgtggtttaacacggtgagaagaactggaatagcctgtgctgttcagaagccagaactgatactgaaagcaggtgcaggcctgtcagccacacagctggttgagttaactctattagacactattggacaattttgttatctgaaatagaaaccagtatggtggcaggctgtccctttgccaaatgatgcccctgctaggctggtttaggtctgcctttcttgttggtgcatctgctgggttttgctgccagcatgttgaaaactggcagttctgtaaagttttattgtcttcctaggtgtttttgtccaggaaagaaatactaagatttgccgtttttttaaatgatgacttggcattttgactcttggctgtactttagctggaagaaattagtgtctgattttattctaatactggaactgcatcttttttttttttttaaccaagaatgattttctagttctctccaaatcaaacattcttgggagcctctattctaaattgtttttcacactcagttctaatgccttcacgtaatggattttgtaattttgttcttttctttttttcttttgaaaatcagcaacaagtaaaaagaacccctgtgggtgaaatacaatatccctcccaaaggagaaatggaaaaaaaaatgttatttcaaacttcaagcccaaacgttatctgccttctacattttaagcaggctcagagccttgaggattgagtcaaagaatgcaaaacatgacctctcaaaggcaaaagctaaaaaaaaagttggacctagaacatcaaatagctcttaccaaagagtgttttgatgagtgaagtgtaaatgaagcgtagaatatagctcttttccaggatacaaggcccaatttccgaaacatgcaaacactctctcaattgaatgcattagctgcttagttccagagctgctgaagtataaaatgcgataacttatgttaaacacccagcactgtgcctagccgatgttggaccctcaatttaatattattattaattatttctatatagaggggaaacataaagaaacttgtttcaattacttatttgacctaaaatacaaggttgcacaatgcgttgtagcaaatgtctataaatctttacataaaggtccctggaatagaatctcattctgcaaattcaagatcctgtctggagaaaaagagtgaagactctatatgtatatttttgaatgaaatagagcacccatatctactatgtgtcttatgagaaatgtttccctagaggagactcataaggagtgacccaagaactggcttcagagttttaaaggactgccatccggaaattgtagtagaattagtctcctttgcttacagtagagaactagagctagtgggttgaagcttcaaggaaataactgtggttcagtgaaaggaaactcttgctgacactttaagctatcagtggaagggaccctccaaagaagtggagagaaatcatgtggacactggaatcttctggcaggaagactgggaagagtttctgcaatgtatggcgaggccaagggcagagggagcagttctgttggtttagatagataaccttaaaactcttctatgtggagactatttgggtccagctgaattatctgccttggaatcctcccatccacttttgctgaacagcacagctattactgccttttagatatgaaattcaatagcatttgttccttggctcagatcattcacctttaattgtgcccattaataccagtgataactaatgtttattcttcagttactatgttccaggctctctacaaagtgttttgtgcatattgcccttttaatacgcagagatactccatatgagtatttttattatccccattatgcagattttaaacatgaatcccagttggcacaattaaagaggcagactcataactagcaatactgagatacaaagcaaggactcttaagtccaaagcttctgttcttaaccacttctttgtactaccctccccccaccccacccacttactctgaattttaagaagagtgctttatcttttcattattccttttgcagcttcataaagcttttatatgcatttcatcaggggctacgttctgaaaatggtgtttctggaaccatggttctggaaagggcagagactaaatgatgccgacattggtatcatcgtcatcatcatcaacatcacatcattgccatcaccatttatagcatcatctccataatcactaccaccattgctatcaacatcacaccatcaccaacatcattatctatcatcattgccatcatcatcattgccataattaccaacatcttcttcctttttttccccattcttcttcttccttctccttttcctttatcgtcatcgtcattaccatcaccaccatcatcaccatcaccaccatcaccatcatcctcatcatagttaacacatattttgtgctcactgtgtgccagcacattacaggtactaactcatttaatcctcccaccaacactatgaggtagggatattaaccccatcttacagttgagaaaactaagatgcagagtgaatagcttgcccagtcatgctcttaagcacaataccttaatgcctctcaccctttaggagctgcttttcagcttgactaagggtgggaatcatcacttaaataagtcatagaaacttcccaaaagtgtaaaagtgttcactcaacctttatactcaggtttttttctgtagaattatttaaaattttctagacattataatcatgtgcttctccctgttacatgatgggtaaatggccatcacaggttaggagacagacctttgtagagctatgtttttccaaatgcacttccttgttcctaagttggagggcattgttaacattcatgggctaatattaatgagagccactggatacngggattgggatggtgctcaggactctcgatgaattctcattttatactcatgacaaacctatggcatggctgctatgattatgcccattttactgatcaagaaacaggctacggatagttaaataacttgcccaagatcgctaacactaggaactagctgagttagcatataaatttaaggttttctggctccagagctagtgcatgtaatcactgtgtttcactgttcctttcattcattttatgaccattttgtttgtttattttagagacgagcatctctctatgttacccaagctggtctcaaactcctggcctcaagtgattctcccaccttggcctcccagaatgctgtgattacaagtgtgagccaccacactcagcttatggtcattttggaaacttctctacacgggctgacctccgctaactctttgctgtcactcctatttaaggctgctgttagctcctgtgctgttagccaggcacatagtaggaatacattattttggataattctggggactataggataaaatgtgaaaattacaagatggattttttttttttagttaaagtaaagaagacctttctaaaatgtgtatctatacaccaatgatactggttgttttggagaggtactgaggtctttactccatggaagcaggcaagcagaaaaataggcccacctatctgccagaggtattgtagaaatgattcaggggcagaagattgaatcaaaagaactctaaggctgggtgcagtggctcatgcctgtaatcccagcactttgggaggccaaggcaggcagatggtctgaggtcaggagtttgaggccagactggccaacatggtgaaactccatttctactaaaaatacaaaaattagccaggtgtagtggtgggcacctgtagtcccagctactcaggaggctgaggcaggagaatcacttaaacctgggaggcagaggttgcagtgagccgagatcgcaccactgcactccagcctgggcaacggcaagactccgtctcaaaaaaaaaaaaaaaaaaaaraastctgagacttcatatgagactcaaatatgagtttaaatctcatatctcagctatgactgcttttcaactacttattgtatccttgaattagctcagttctattcagccatctgcttgctttctttgttactttcatttaaaatgattctttgttgtggaaaaatacagaaaacaaaaaatttgccattttaacaatttaaactgtataattcagtggcattaagtgcattcacaatgttgtacaaccatcaccactatctagtttcagaaccacctcattaccctacccctaaaagattctacttctagttagatacctccccaaattaaaaataggtattcaaacaaaaactgaaaaacttgtactagaatgttcctagaagcactgttcatagtaacccaaagtgtaaacctagatgtccatcaacagacatttgatggatgaacttaatgtggttttgtccatactatagaatatgagccataaaggaatgaaatatgttttccaacattgatgaaccttgaaaacattaggctacgtgaaagaggccaggcacaaaaggccacatagtgtatgattccgtttacatgaaatacatgtattactttttgctagatctgtaagccctctgtggtattgttaacatagtactttttacctacattgacctaatcttttagagacataaaattccaccatagcgtcttcttaagcaacgatatatatgaaacagtgggtttgagatgctagttccatttttccaatatacatgaaaataataaaatctaattctaaaaataaagtttgcccatgtgccatctaaatgcatctgtgtaccatctcaaatacacttaaggcatttcagaaaacagccttttgggatcctcttggcaatcaatttctccttgaatgtgatccacacagctcttttctctgtacttaagctatctgatatgacagccagccactagccatatgtggctatttaaatggaaattaagtaaaataaaatggaaaattcatatcctcagtcacactatccacatttcagttgctcaatggcaacaggtgactagtggctgccatactggatgtgacagatatattgccattgtgctagaaagatctactggacagctcaacctagggctggctttcattctttctgttgtgctagggaagctccctgatatggttnggcattgtccccacccatatctcatcttgaattaccacatgttgtgggaaggacctggtgggaggtaattgaatcataggggcgggtttttcccatgcttttcttgtgatagtgaataagtctcatgagatctgatggttttaaaaaggtggagtttccctgcacaaactctttttgcctgctcccttccatgtaagacatgacttgstcctccttgccttccaccatgattgtgaggcctccccagccacatggaattataagtccattaaacctctttttcttcccagttcaggtatgtctttatcagcagtgtgaaaaacagactaataacactccctgtctcctagatcccatgcttaagtcaacctctcactcagcatctttaattcccaccacttgctcctggctgaccattcatcccccagccagctctgaaactgacctactttcccaatgtcaccagggagggcctggtgccaggccacggtgtggtgcatcccctcactgctcccttcctgtttgctgctcgcccagctctggacgcaatccatcttgccactctctcttgctctcatcgtactgacgtgaggatctcctcccacacagccctggccagctttcctgaagggctctgctgggcttcaaactccattttgtttcattatcaagtgtaagaaaacagcccttttccttttcccacacttctccctttactctcctgttggtctgtcttcttcttctccttcttcccctgggttttcttctctttaacttctcttcttttcctctttctcctcctttgttccctctttctcttcctcctactctccccacaattatttctctgtagttgtaagattaaccctttatagctatttgggaaaaaaaactggaagaaggactatagtaaaaagaaaaaaaaagctatattctttttaccatttatacagaaaaacaaaacaaaacaaaacaaaactcctcctccacccagcagttcctttgccctttaggtggtaaacacatcattctcttctcccaccaagagggtgaccttgcaattatggatgaagatatgaatatcagagcagtgactgggacttgcagagcttagtcttttaggggacacatttccacaccagaaatccatgtccgggtgtgaaacattattactgctaatgtacatagtgctgtcaagtttcattatgaggcccggcagagttcagacctctatttaggccagaatacagtgaactctgtcctgatggttctcacatgccatccagcacaccgggacattctcaacgctgctcaggactccagctccggccagatgaaaatctgctcctgctcattcagcaaatggtcactgaccgcctaccacatgccagacactgtgcaggggtgagggcacgcagcgagggctcagacatgatccctgtttcccgggagcttaccctccagcaaagaagagaatgtatgtgtttgaaaaactctaaggtggaaatggagctgcagaggaagtgaggggagttttgaggagggagtggaggctggaagctcagtgagccttttgggaaaaggtggactctctgctcagttttggaggatttgaacatgtgaatatttaggcgagacagatctttgtatttaaatgagacttgtgattttgctttattttcttttattttttaatgaaaattttaaattttatttttaaaaataatatctagtaaaattgactgttggaggcatgactgtatgattcttggcacacagattcgtataatcatgactgcaatcaggattcagagccgttccatcacaccagcccccaaaatcccttacatgtctacttacagccacactttctgctctagtcacacaatcactgatctcttctctgtgtctgtagttttgggtttcggagaatgtcatataagatagaatcatacagtgtgtaaccttctgagggtcacttccgtcaatcagtagaatgcctctgcaattcattcaagctgttctgtgtttctataattcattgtttgtattcccatattgtatttcattgtttatccatacaacgatctcactcttaggtatttaacctatggtcacacaaaaacctgtgcacaaatgtttataatctcttttcataattgccccaaactgtaaaacacctaaatgtccttcgatggctgaatagaaaaacaagacttttgtggtcaggcatcgtgattcatgcctgtaatcccagcactttgggaggccaaggtgggcagattgctcgagtccaagggttcatgaccagcctgagcaatgtggtgaaaccctgtctacaagaaatacagaaattacctagctactaaggaggctgaggtaggaggatcacttgagccccggaggttgaggccgcagtgagctgtgattgtgccactgcactccagcctgggcaacacagcaagaccctatcttgaaaacaaaacaaaacaaaaacaaaaatttgtgattttcactgagagaaagtaaattcttgttaacttaggcacaaaaaagtgcaaaatgatttattggtccattcaactagaaaggatggacttgttatcttgcgtgtctagatccaggctcaaacggtgtcttcaggtcttcctctcctttccatatttctccctgttaaggtgagttgtttgcctccaggagatagggaatgaactcatctaaactaagtattgattcacatacttttttaatccagaaagacagtgatcccttctagttgcaataaaaaattcccagagaagaaatgtgtttgaatgagattgagtcacgtaccgatccctgaaccaatctctgtggccagagatgccctccagggttcgtgggggaagatctattatcaggaaatgaaagtaaccagaaacaacagctatgactgcatttccagtggagggaggtgtaggaacaaaagctaagaagtggaaaatcacaagactttactgggataccatgagtggtttgggtttgctccaatgcaggatactgttaagaacagttttaggatggaaggttggaaaaattaaagttgccaaggagcatggattttatttttggacagtggggatccatttcagggttttgagaagggtggcacatgatcagaactgaggtgtgggaacatttcatctggcaagtgggcttgatatgagtatggaggatgaaatgtaggaatctgaatagcagtacagatgttatagtgcaggtaggaacaaagtgaaagacattttggtagcaagcaacagaaataaagcctgattagcttaatttaattaaaaggtaatgaaggagaaacaatagaaaatattgtttggggctttactagaccttttaaaaatcaaagtataagttgagcaactaatcttggaaaggtcataaggtgaggcaacattcctcgacgaaggagagtcactattacattggtttagagccaacaattcctggtctgtgtgtcttacctatcaactttcaaattcctaggagacagaatctaattgatccgccatgggacaggtgcacccctcccccttgtatatatttttatggccagggaaacaaataagtgttctgatatacataagggaggactttttcgaagatccgggcttattgtatatccataggcacatcgctctgccccagaagggatgcagtcccgtgaactgtactggtatagaaggaagcctaggtttttgcgagaggaaggaacatgaatatttttcagttcgtttagaacagacagtccaaatgagcagccagtagatcggttttatttcatttacatttaaatgaatttgaatgcctttagctaagattttcaccactgttatcatcttgcacctggctcgttttactcattgatattatctgcccagttctgaaaagcatgagaaatttgtattctttctgataaatcaacttggtgtttgccctgaaaaaagcaagtagaaatggagtaatggaagattaaccagtattctgatgggtcaggtccccctcctaatgttcttacagcaacaggaacattagctgcagacatattgccatttattgtaattatttgcataggatctgcctttcccttaaactctaaatgattgcagagaaaggaccacacaatttttacttacctctttaattcctatactttgctagcataaagtagatgttcaatggatgtttattgaagtgatgtgtttactaagaagtagatttgaagcctttctatagctgtccttttggtatatttcttagtggatcaaactcttaatttgtggtccataatttatggttttggttttagcattgaaattttcatgccaaaggaaacacctcagtgctgggacaactgggatggttggtcacactactactggatgtcaatcaaaaacaatgtgcttatcataggaccccttctaactctcatgatgccaccatgaaacttcgcaacagtgctgtgtggttgttatggactgaaagtttatgttgaaaccctaatccccagagggatggtatctggaggtggggctttgggaggtaattagggttagatgatgtcatgagggtggggcccttgcaatggaactaatgcccttataaaaagaggaagagccaggcacggtggctcacccttgtaatcccagcactttgggaggctgaggtggacagatcacttgaggccaggagactgagagcagcctggcccacatagaaaaaccctgtcttcattaataatgcaaaaaattagctgggcttggtggtgcacacctgtaatcccagctactggggagacagagacatgagaattgcttgaacccgggaggtggaggttgcagtaagctgagatcacgctgctgcactccaggctgggtgacagagcaagactctgtctcaaaagaaaagaaaagaaaaagaaaaagaaaaagaggaggagacatgaagtagatctctctccaccatgtgagtacactttaggaagacagccttctgtaaacaggcaagagggctttcaccagacaccaaatctgctggtgccttgatcttgaactttccagcttccagaactgtgagatgcaaatgtttgttagttaagccacccacactgtgatagtttggtatagcagcctgaactggtgaaaacagcggccttacccccattgacacagaagtgagctgagtctggaataacttgatttccttaagggtataaacaccaacagttgtggatttaaaactgaacttcagtttgcctgtctctaaatccactctctctgcaactcacagtgctcccagagttcagggtactgagttatgaattcttatcctcagggagttgacagtctgggagaggtgataacattgttcaggctatgaattacacaagtccaggagcacccttcatatcagcttcatcaaacatttgtgttttattttgacagttgttttggcaaatggtagtaaagggtcttcagaaagaggtgtctttttaaaattagtcctgagtggttgggaccaacataaataaagaaggtgccctctaagtggtgtgtgccacatgaagaacaggggttgagagttggaagaggatgcgtctaacctgaaggagtcaagtaatactttgtggaagaggtattatttgagatgatcatgaggggtggccaataagcctgatgcagggaatgaacaggaattacagctgcagaaaaataatatggacaaagatttgtggcctggcttattgtccttgctcagccttccttgtgtttggtgtcaagtagggaaaaggtggtcctcgggtggagattaaggtatccctttttgaatcaagtcaataaatggtgaacatgctgtgctcaatggcaagtctgctggataaacataaatgacagaagggaagatctgacctttgctcctggtgggaccaaatgtgtgaaagtggaatcctcagagaatagcaggagrcaatgtrttgctaagtgctgtcacatgaggaatggattaagaaaaccaagagaggccgggcacggtgactcacgcctgtaatcccagcactttgggaggccgaggtggcrgatcatgaggtcaggagattgagaccatcctggctaacacagtgaaaccccgtctctactaaaaatacaaaaaaattrgctgggcatggtggcacgcgattgtagtcccagctactagagaggctaaggcaggtgaatcgcttgaatccaggaggtgggggttgcaatgagccgagatcgtaccactgcactccagcctgggcaacagagtgagactccgtcacccccacccacccccccacccccccgccaaaaaaaaaaaaaaaaaaacagaaccaagagaaggaaagattattaggaaaccccacaatgaagaaacagcttgaaatcagccttgttaaaaacaaatactgggtttagactgaagaggatgaggcagaaaggcattctgggtgggaggaacagcatatactaagagatggggttaggaccaaatgcattgtgtattcatgggagtaggggaagatgaggagagaaaattaaatatcgtagagttggaaaaataaagaagtgtgtggtaccacccccccatttttcagagagggcaactgaggtgtagggaggttaaatgagtgctggtgcrccttaattcaaagcctwtgaaatctgaaagattttggttcaaataaccagttgactgcttaactcagctaaaattatttttttaaatggcagaaattctaaaacataaaagtagcttaaagaagataggcattgaattctttcttgtgcaaaggttgtctagggctggtgtggtattccacagtgtccgggacccaggctccttctaccctgtggctctgccaccctcagccagtggcttccacatcataattcaagatggctgctactgctccagccatcatatctgcattgcaactagaaggaaggaggaaggaacaaagacgggctcacctccttcttttacagtacttcctataagttatncatatcataccttctgtcttcctattatccagaaaattgtcatagggtcatgcctagctnctagggaagctagaaatgtaagctttattattggaggttctgtgcccctctaaaaatagaatttctgttactaaggcagaagaaaagaggatattgatgaacaaccagaagtctcttgacccgtatagcttttcacaccattataaaacccacctctgttttctctctgtaaaatgagaaaatctgcacttagttctttgggtgagaattcaggtaacatatggaaagtatctggcacaccattcaacatatattagaggctaaatacattttagtcccttatccttaagtgatcgctcttactcacatattcagggagacaggacaagattctaggtctcctgatttgaagaccagagttcttttgtagcagcatggatgagcaaatatcttaattgtcttctagtttatttgtttaattgattaatataaagatattttccctggtcaggcgtgggatgtggtggctcatgcctgtaatcccagcactttgggaggccgaggcagatggagcatttgaggtcaggagtttgagaccagcctgaccaaccccttctctactaaaaatacaaacaattagccaggtgtggtgttgcacacctgtaatctcagctactcgggaggctgaggcacgagaatcacttgaacccgggatgtggagtttgcagtgagccgaggtcgcaccattgcactccagctggggtgacagacaagactgtgtctcaaaaatatatatataatatgtattttccccaaataatatcgtataaaaaagaacaacatattaacgatgtaagtggagttaggaatgttagagtcccattggcatatcacccccgacctttcctctctgcctttgagttacctcactggatgtctagttgtaattcacagaaagcaggtagacacccactggacagagagacaaagtagggctcatcatcaaaaggaaaaacgaaagaaaacaaaaagacagagagttgagacttttgttcattccacraatttgcattgagcatctactttataccaggtagtattctaggttcttcaagggagaaaaagcagcrgaaggaaaaaccaggcaaaatccctgcttttatgaattctatattccagtatgtgaatatccagaaattctgaaataaaaatcgcaccttgaattgaatgtcaattgatccatatcatctcattctatagtttttggttggaagagcaacatgcacgcacatctgccacttggagatcttgaataatttggcagcataggcacaggtgattgagtgaacttggaaatgcacgccacgttacatacatttttttctgctcatttggattagaagctcattatgtgagctggttccactggctcttgtgccagctggttcaaagtggttaggtgatccttagtcatgagaggttaatggtgacgcatttggtgctattttaacagtgttataaatactacccagcatttccagattcctcaccccaggttccaagagcagcctgagattcgaagaaccactttattaatggtcattcagaattccaataactcccaataaagtagaattaggacatgcatcttagaccctactctatacaccctgcttctagttgaaatctttggccagttgggtcaaagtttcaggtatgctctgtggagttgggaggaggagagtcatatttacagaaaaaagctttgtcctaacctacctcaagttttagacatagcggttgtattacaaaagacagcatatagggtcctctccttaaggagtcacccttgactcaggtgtgctccctgaatagagttggatgcccagggtggcacatggattacaggctttgcaccatagaagcttcatctaccagtaagcccagtccagggggtgctgtgagctctgaacaatcaaatgagctcctcctctctccttggggtagggcctagacgagctctcattgcctcccttcggggactggaattagtagccaaaatgattctccagcatttaaaagaaagcttttgaccccaaattttaggaggaagaaagacaattatataaaaccatgacaactactgctacccctaccatagtttagcagacacccataatgtgccaagcactctgctggcctttatcacgttgtgtatctcattagacgtcatttagtgtgatccctataattacccagtgacatggctgttatgacctcacttttacagaaaaggaaacaaatactctgagaactgaggatacttacctgaggttgaaagccacaaaattgaattctaactcaggctatccaattcttgcaatattgcctcttggcagttgttgtactggaatcaaatatttagtgtgcaggatcctagagacctatgcctgctcattcattttttcatttattccacagttacttttaagctctggcttaaaagtcaggacacaccctcttctaggtgttttagagttgcagtgatcagaacaaagacccctgcccttaagaagatttctattttgtgtcctaaaatctttaaaattcagtattgctcagccaagacaactaacattatttttttaattgaccacaatagaatttgtgttgaaagaataaacaatacttttctccttataaaaatccttttcttctttctgttyctttatgttgtggtttctgagcccattttagagtatctctgtgttggagttattatttttctgtcttgacttttttttttttttttttttttttttttttgagacggagttttgctcttgttgcccaggctrgagtgcaatggtgcgatctccactcaccacaacctccacctcctggattcaagtggttctcctgtctcagccacatgagtagctgggattatagatgcctgccactacgcttggctaatttttggtatttttagtagagatggagtttcaccatgttggccaggctggtctcaaactcctgacttcaggtgatccacctgccttggcatcccaaagtgctgggattacaggtgcgagccaccgcgcctggccttctctgccttgatgtttaagttctggctctgctgttaagactttttaattgttcacggggaacaggaaaccaccaatgagtactgtatatgaaattgagcaccagggcaaagaggaaggtgctgccgtcaaaagacagcgcaaggatattcagaggaagaagagaaggaggaggtggatgagttgggaattgaaaactggcaaaagtagagtgaagttgtactaaagagggatgaggattcatttgcgcccatgagggaatagttaatggaagatgagaaagcactaagatagacatcaaagttgaagggatttgcaaacaccaggagaatgcttgtaagagaaaaaaaaaaaacaaaaaaaaaacactctgtgaaaatgaaagtatcttgagaattgaaaagaggttaaagaaaactgactgtgttttcaaaaacatgtaaattaaatgacaaacgaagaaactgtgacacccaagcagttcaaggaggcatttaagggacactgtgatccaggaaacgtccctgggaacttcagaaatggcaaagtagatggaaaattaacygaaaattgagaaacamtaaatgggttatggtggcatttgtgaaacagtaagagaattaaagtctaagggggaaatagtraataataaatatgtctagagaacatctcaaataattagattttggaagttaaaggagacttatgactataagacgaaagagataaaatagaaatctggaggaatgagatattttaagtcatagttaaagaagcttatgcagcccattatggttggctgttcacacaaggacagagggactctggaaatgagtatactaaatggcaaggggaagcatggctttaaaaagcattgcatttgtagtagggtgttagaaaatatgacagggtggaaaaagagtgaaaactgcatggaaaatttgcatcaatgttaactactatttattaatagctgtataccaggcactgtgctaggcattttatgcgaactatgaagttaggttaaaccatatgaaactgtcatggctagtctgtatggtttaacttaatccatttttgcaaaaaaaaaaaaaaaaaaaaaggaaatggaggctcagtagattttaaatacgctgcccaaggtgccaggtactgtctcactgtaaagcctattctctttcctcgatgtcatgaaacctcaacaacatagaagcagcaagttattcttttattcattctgcacatgttcagmaccagctctgtggcgcacaccctgtttagcactagaaatataatactaagcaaggcagatgaggtccctgcttccatgattacagtctaccagttaaaaacaaaagcaaaagcacaaagagagtctagaacagctgttcattagaaatataatgcaagtcacatgtaacttaaattttctggtagcccattaaaaaagtgaagagaagcagataaaattaattttaataatatattttatttaacccaacwtgcctaaactactccaacatgaaatcaacctaaaattatttatgagaccttttactcttttgaaaaatacgaagtcttcaaaattctgtgtgtatttttacatggatggcacatttcaattcagactaaccacatttcaaatgctcaatagctacacgtggttggtggctggctatctaacgtgatagcaggcctagtgagaattggacaattctggccccgtttatattcaatcataatataggaaatataggaaatattgtctacctatttttcaatgttatctctgatcaccatgcatcaccattcatagagcacaaaacacaaggggaagaggaatgtttatttaacctggacttcagcttcatacacttaatactgtaaataccagaggaaatgtgtatatatatgtacgtattttatgtatttttttatatatataaaatatgtaaatatatatgtatttagtgttgtgactgtcactggcaataaaaaacaacttagcactttaccaccagtggatgacaacacagaagtcgtcttggcaaatcactagagtcttccccttctctatttgccagcatgcttctgtgtacttattgctcctgatggagatattgaagctgtaatttgaggcttagaagcagtcagaatttctgacattttatctgaccactaaagctttatgatcaattttgtagagataagcaaaacaatgacaagattttactgtttaatacaagtgcccagcaggtgttaatgggaactgatcaatgtggtgtaaaatggtatttccctaggtaaagaactctgctctggagcaagtttaaatgggaagaaagcccatggaaatatggattgtccttcctagaaattgggtgggggaattgaaggtaataggtacttgctccctgccaacttcataatgaaattactgttcagcagaaatttctgttagaggtttttttttcccccctcccaagggactgaagacttttaatagaaaaagacaatattaacattgagtatatggagtcattcacccagaatattgaatcttagaggaacacagaaaaatctgaagcatgaggatttctgcatagttattttcatataatctgaagaacagtgtttgcgtctcagtaatcactctgctaattccatctgattttactaccaaatggaagaaaagggaacaagtggagaacatgkagatgggaaattaaagaaggagattttaagtaaatccaaagaaaggtgctcaactgcgtatgctaccttcttgattaaaacaatcactgttttggctgggcatggtggctcacgcctgtaatcccagcactttgggaggccaaggcaggtggatcatttgatgtcaggagttcaaaccagcctggccaacatggtgcaaccctgtctctactaaaaatataagaattagccgggagtgrtggcaggtacctgtaatcccagctactagtgaggctgaagcaggataattgcttgaacctgggaggtgrasgttgcagtgagctgagattacaccactgcactccatcctgggtggcagagtgagaccctgtttccaaaaaaaaaaaaagttgctgtgacattcagttcatgttacgcaaccttgtgaatggctctccccaggagcaagtgtctttatcraaaccaaaacatttgttccctgatccagcatttccaaacagataacaaactggatatttccaaatttcttgataatttactaaatttttcagttttcccacatttggggcgctaggtagactcaacctgaactacattcaccccaaagtgttggataattgaaacctggcttaagatctcattgtactcaataagaaacacctcagtgagttggccaccctaattatcaacttagggcagcaggtacagagtgactggtaacttattttcgctagctgaggtaaaggccattggtggtctttgtcggtagtttttgtactgaaattccattgcagttgcctgcctatctgtccaatctcttcattccacctgttgctttctttgaccgtcgtctctattccttgcttgsgttactacaaagcctcatctgtttgcccatctgcctcttacaaacttgcatttcaagcctccattccaaataaacacargatgaagtctaaactcagtctatatagtacttgcttatctgactcctgcgtctgtctctagcgtcctctcccaagttactttcccacttgcccccaacttattgtgaactgacggcagctcattgaacacatcatgatgtttcagggttttctgccttggactttgcattttctccatgtgcatgagcaagagctgctcaacttttccttcctcttccttctcagcacaacccaaatccctttaactttgtttcctttttccagtcatggaatcaccatagaattagccactgcttctcttatgctttccaacaacttagtccatatctctatttttacacttattgttcttcgttatagttattttgtgtgtccctctccccaaccttgaaaaattaagtatttttggtcatttttgtatcattttcatggcatagttctggtacagggtgtgatacataggagatgctcaaacatgcctaatggatggaagaatggatgaacgtattaatgaatgtattgacrgatagatggatggatggatggattaatggattgatgaatgtattgatagatggatgaatggacaggtaaatgtattgatggattgatggatagatgaatgactgcattgacagatgtttggaagggtagatatatagatggatgaatgtatggatgggtggatttccctttggtgatgatctgtcaacatacttgccaaacattaactgagcccccacagtatgccagacaatgtgacggggctaaaaataaccctgggaaacggaaccaaaatgtcagcttaaaaaataaaaacagcttaacttaggctcaattagttactttgaagtcctgctaataatgaggaatttgactccagttctccactaaacagtccatgcaaatatcttctttagagtctcaataagaggtgtgaggtggagcacacctagctgtgtgtatctggaccatgttcatttagttcatcaaactccagccaggaaacatcaaaggggagaaggaagagagaaaaaaaagtttcaattgtctagataatgaatggtttttaagccgtgaacaaaaatgttcaagtcccctcaagtgcagagaagcattttcacttctgcccctattggctgcaaatctgagtatatcactcctctacttaaaatctttcctggctcaccatgaccttctgaacaaatccaaacccttcagtgtgtccattatgatctggcttcagggatcctctgcagactcatcccactgcacataacataaccatctgccttactaagccgtttcctacttcctctagcgtgtgttactacctttgctgactctttacttaagatgatgcctctgcccagaatgctttctcctgcctcaaccccttcacccattaagattccctgggaagccctccccagattccccaggttgagttagggacccttttgtctgtgttgtctcaccttcttacatttactctccatcagtgaataagtggcattataggtactgtcattgtttatgtgtctatgccattgaattataagaatgtgggtaagaaagaagacaaacactgtgttttttatttctgtatctataagacttactataagccctgacctatataccaggcatacagtaaatatgctttctttgaccgtcgtctctataataaatagagtaattagttgttaaatcaagaaaatatccttccggcaggtgtggtggctcatgcctgtaatcccagcactttgggagccagaggcaggcggatcacctgaggtcaggagttcgggaccagcctggtcaacatggcaaaaccctgtatctactaaaaatacaaaaattagctgggcatagtggtgggcacctgtaaccctagctacttggaaggctgaggcaggagaatcatttgaacctgggaggcggaggttgcagtgagccaagattgtgccaatgcactacagcctgggctacagagtgagactccgtctyaaaaaaaataacaaaaataaaaacaaaaaacaaaaaacctttctaggaagtgataagagataccccaaataaaccagatagaatagtgattatcctttgttccttctagaatagcagtgttttagttttctgtttgttaaagtatttgattgcagagaacttgaagaatacaaagatacacacacaaaaaaatgaaaaatacccataacccttttagacatagacaagccctgtttttatcctcttttctgcttctttaacattaaatagtaagcattttctctgcatcattaatttgtcttcaaaaacatgattttcaatgacccgaatggtctgttgaataaatacrcaatatttgctcttttccttttccccaatttcttcactttgtccttggaaaccagattctcccccacacaacacccccatcagtcgcttctgcaccatgctggtccagggatgtacatgtgacccattaggccagtgtctcttyttaaaatttcttgtagcctagttctcttcttcttcttctttttttttttttttttttcactttttagcatctctggatgttaatggaatatgaagcaagtgacacagtatctttctggggaagtctttgaatgcttcaatccaccatattggatgtatcttgtgtctgctgagtggccaccaccatgttgtctcagatgtctttaacgacatcacatttttctcaagctgcaaggagagcggatcccttggggaacctctcacccgaaatctgggagatgaagtctgccttggctctctgagttcagcctgagtacaggccaaggtggctttgaggagtgatgagggtataaatgttgtaaggcagatagatgttacctgcaatgaaaacacctagaccaaaaattaagtttatacatgttatataaggtagattctaggagtcatcgttgatgcctctttctcccttcccctcatctaatctttcactaaatacctcctaaatatctctccactcggtcttgtttgctgttgctttttctcttcctccttctcttcttctttggccacaaccagagtcaaagccaccattatctttgacctggtttgtaagaatagcataagtagtccctctgtacccgctctggttcccctccaatctattctctacacagccttcaattgacatgatctattacctctttgatgtcaccctcgcttctatgtcttcccatagttttttttgtttgtttgtttttctgagacagggtttcacacttgttgcccaggctggagtgcaatggcacgatctcggctcaccgtgacttctgcttcccgggttcaagcaattctcctgcctcagccttctgagtagctgggaatacaggtttgcaccaccatgcccagctaatttttttgtatttttagtagagacggggtttctccatgttggtcaggctggtctcgaactcctgacttcaggtgattcccctacctcagcctcccaaagtgctgggattacaggtgtgagccaccrtgcctgcaccttcccacggttttaagacagacatttaacatggtctctaaaatcctgcactttctgttcctattcatcttctcagcctcacctgatctcacattttcctgtctttctctgcttcagcctctctggtctgcattcagttcctggtatgcacaccacagagtctttgcacatgttgcctcttttgcctgtttgtgtcttttcttgcctagttaatgccaattgagccttcaggtcaagctgcacttcctcagccttgcctcacccctatttcactttcttatagcatactctcccgtcccttgtatcatttgtcataaatctgtgtttaatcaattcatgwctatcctcccccttagactctaaacttcttgagggtgggaatcatgttcattttcttatttaccctgaaccaactagctgagtcctgacatatagcaaatgcttcatatatattagttgaataaataatgaataatggaatgtcattttttcaacattgaatgccatgtggtttatgagcaagcagcttccttcagggaagtttgttagagtataatagaatgtgttttcagatcttcctgtaagaagatcatttgaatataggtctatgaatctggcaggacaaaaagcttacattccacgtgttaattacagtcaattactaaagcatggtcaactagcaatggttgcatggttattaatacttctgcagagaggcttcttgtgatgaatatagcattgtaagtttataatttttcagtattccattaatggtggcatccacttatttgttcgattgctctaattctttcctaaaaatttgtctttctstcttcccctttctagatttatggtcaatgttacatgggatggcaaagacttatccttcactgaggaaggctaccaggtgcaccccaggctggtggtgattgtgctgaacaaagaccgggaatgggaaaaggtgagcatccttctgtgtgctgaatgcaggggagggaagaaagcatgggcaataaaggggctcacagtgcttctttctcccacgcatttcctgttgagctgctctagatcccatctcacagccaagagcacgtctttcttgcaacaaggcagactaaatctgtaaggtgcaattggaatgctttctctgggtgaactgtggtaattgtgtggtgcgctgtatgtctgttctcaaatcccagtaggaaaggtctgaactaaggataatttaaagacagtgaagtctgggttgcagcattacactaataagtgttgactatrtagcaatgatcatagaagtttgcctaaacttcctaattgtgtaccatagtcattgccatatgaacgaaccctctgtattttcatgtactcagtcttttgctttaaataaactaattttaaaaacttaaatgtatcacttctgtaaatcatgagttagagagggaggttatttttcttataaagcatattttcaactacatgtatattagctattgaaaatacaaaaaatcgtttgcaaagaaaaaaatcatcatcttatgtaccatacatgtcatgacctgggtcagagaggagagatgtcacagggaatttacagatgatctcatacatacaatgacaatatctggttcagttgccctccctcctcctccataattaaatgcttaagttagtcgctacaatttcgtataaagagtagaataaaagggatcagaaagcctttgttgttacgttgttatcttatttttttgttatgttttttgacaagcaatgcatgacctctgaactactttagcatcttgaaatttatcttcacttagtacatcaaatggaggcctgagtgaccctagagggaaggaagatataggatgtgctgtgggagacataatgtaattgactgaaatcagggggaaatactatacaaacagaagcattgactctggggagacaatgacagattcctagaaaagaacagtgaggaggaagcttaggaaagttttgcatcctacacccagcaactataaaatgcacagcctttcgagtgcacatgggaaatccaccaaagtagactacattctggagcataaaacaaaagtctcaatgtgtttagaagaattgaaataatggagggtgcattctttgatcataacagcattaaaataaaaattagtaacaaaaatatatctrgaaaatctccaaatatttggaaatggcaacacacttctaaacctataggtcaaagaagaaatcagaaagacattagaaaatactttagtcagaatgataatgaaaacacaaaatatcaaaatttgaggaataagattgaaggcacactaagaaattcatagctttaactgcttataataaaaaaggaaagtgtgaattcagtgtcaatgatttaagcttataaatttagaagttagaaaagagcaaagtgaacaaatgaagtagaagaaaaaaatcataaatacacaagtaaaaatcaacaaggtggaacacaagccatagaaaaaaatcaacaaagccaaaagctagttctttgaaatgactaataaaattcacagtcgctagcaataatgatcacacaaaagaaagaaaacacaaataagccaatattaaaaatgcaagagggactatcacttacagacactacagatcctacaggcattaaaagataaaaagaatattatgaaaaatttatgacaacaaattcaacgatatagataaaatgggcaaattctgaagaaacacaattttctacaactgagatgtaggtattgacgatctgaatagctcatatttgctgaaaaactgaaaatatacctaaaaactttcccattttaaaaagacaaaaragaaactcctggcctagatggcttcgtctatctataacaaacatttaaaagaaataacagcactctatacaaagtttttcaatatgttactaatcataatgtaataatatattttaaaaaggataatacatcatggataagtgggggctatctgaggaatgcaagattagtttaacatttaaaaattaaattaatttaccacattaacagagtaaagggggaaatatggtcatttcaatagatgcggaaaaagcatttgacaaaattcaatatccagttatgataaagatggtaaattcctcartctgataaagggtatctatgaaaaacctataatatatatatcgatttatatatattataygcacatacgcatatcatgagatgctttatttgacaatttttaagtttttctgtcttattctaagttagactacrgtgcataaaatatatatattaaataagcttatatcttatttaatgatgaaataatgaaaatagatccacataggcacattcaaatgatttttgatcaatgattatgacaacagggaaaaggaaaatctttttaataaatggtattggataaacaggcaatctacatggaaaaaaaaaaccttgacccattgctcacattatgcatgcacacataattacctgaaatagattacaggcttaaatgtgaaagataaaactatctagaagaaaatgtaggagaatatttttgtgatctgtgagcctcagatttcttaaaccaaatatgaaaaaccattaagcagtaaataaactgtacttcatcaaaattaaaaacttttgctcatctaaagacactgttagccactgtgcccagccctcttttttattttctaacacttgtaattccaacactttgggaggccaaggcaggtggaccacctgaggtcaggagttcgagaccagcctgaccaatatggtgaaaccccgtctctactaaaaatacaaaaattagctgggcatggtggtgtgcacctgtagtcccagctgcttgggaggctgaggcacaagaatcacttgaatccgggaggtggaggttccggtgagccaagattgagctactgcactccagcctgggcgagagaacgagactccacctcagcccccctgagtagctgggattacaggcatgtgccaccacagaggctaattttttatatttttggtagagatagttgcaccatgttggccaggctggtctcagactcttgacctcaagtgatccacccgcctcagcctcccaaaktgctgagatcacaggcgtgagccacgcgcctggccaaaaactgtgtgtgtgttttttttgtttgttttttaataaacgtacacatacacacacaaatcttatccagcaattttactcctagttatttatcccaaagaaagataaacatatatccaaaaagtaatacttgtacaagaatgttcattgcaactttattcattatagcaaaacatcagaaataattcaatgtccatcaacaaggaaatgaatgaacaaattatggtatattaataaaacagaatggcctagtaatatgtacaacaacatggatgaattgaaaaacattatatggaatcaaagaaagacacgaaagattatattacgtgaagacatgaaagattatattgtgtgattccatttacataaagttcaagggaggcaaacgttccctatggggttagatatcagaatagtggttgcttctgtgggtgagtgcagttgacaggacaggggcacagggaattttctggagtgatggcagttatttcctatcttgaacatttgtcaaaaggcatcaaattatgacacaagatccattcattttgttgtatgtcattgtgcttagtttaaaaaaaaacctaaatccgggccgggcttggtggctcatgcctgtaatcctagcactttgggaggccaaggcagtcagattgcctgagctcaggagttcaagaccaacctgggcaacatgatgaaatctygtctctactgaaatacaaaaaattagcccggcatggtggtggtgcctgtaatcccagctactcaggaggctgaggcaggagaatcacttgaacctgggaggcgagggttgcagtgagctgagatcgcaccactgcacttcaacctgggtgacagagcaaggttttgtctcaaaacaaaacaacaaaaccttaaatccttcagatcgggatacccagcacaattaactaacagttttcactgagcwttcatatttaaccccctgacatgaataccaattataataacaatatccattgcttattgatcacctcttgtattgatccttcagttgatccaccggagccctgacttcatggttcgtctattcatttttttattcaacaaatagttattaagtgcctactgtgtaccaggccctatccttgatgcttggagtccatcataaacaagagaaaaaatattttctgtactcaagaaacttagatcttagtgtgtatatggagatggagtcggctgggattctatgggcttctgtcatgcttaaggaaagtgttagcatctagttaactgtccttggttttaacctcctttcttccctcttatacaccctgtagcccaccatgcaagtgatttgcaactccatgaatgtatatactgggttccttcatgcatttgggactttgaatatgcttttgttgttgttgttgcctataatattttcttatatcattactttctcttatccatctttcaaatcctgattttttttcctcttacacatgtaaagccaaaatgcaattcatgttttttttctaatcatccataggaggtagagagttggagcctttctgccttatgttgttgcattttggggttttcaaccttttgatgttacacaatctgcgattcacttttggagccaccaaatcattccctttggttggttttaaccagtcctggagcaggcttgactcacacctgtgaattttctgtgctaccttagaatctgactcatcttccagggagctggtacacaaggaggccactgcagtgcaggtgacagctgcccttgatacactccatttccagatacagaagatgccttttaatattttgtgggcctttcttcaaattcctgttgaaacatagcaatttcccataaaaggcagctttgggaattgctgctgagttgagcttagaatgcacaaatactgcctgtagttgctctatcctcttggcactcaggggatctagtgcttcagaaataactccgtgtgcttctgtctctaagaaagagaaagccagtggagcaggtaaataccagtcgtgttacccttaaagctgcccccccagcactacacgctggtacagcaggtcagcagaggggaaagactgctgaggagggagctgttattctgggactcggaggcgatttcttttcatctccgaggtcagccagtggcgtcactgaaagcagcagcatgtaatgagggtgtctgggaaaacacgacaagcccttagaggggcacttgcttttttccaggcctttgtaggtggctggtgtggattatacagacgccaaacaccaggcctgcctgtatactgcagacacagaactcagaatggagcagactttctctcacaaatcgggacttccatgccttttctctctcccttgttcttcagtgattttggtctgccttagagtttgatgagtccaaggcttcccagagatgctcaaaaacaaaaccctagatgcctcaacctcagcctcagaagaccctacagcctcaaattcctaggtgtaaggggtcttcctgccaattagcagtctaggctagtacaaccaatgccacgtgtatgccagctctgtggccagcagttcattaggtaccagggatgctacaaggatgtgtaggaaactatgtgtcttctcaagtagctcataatagagaattaagccaaccctggaacaaatggctataagtgctacataggcggagagaagggtgaacttgggccagtcaagaaattctctagccgggcacggtggctcacacctgtaatcccagcactttgggaggccgaggtgggtggatcacgaggtcaggagatggagaccatcctggctaacatgatgaaaccccgtctctactaaaaatacaaaaaaaaaattaggtgcctgtagtcccagctactctgaaggctgaggcaggagaatggcgtgaacccaggaggcggagcttgcagtgaacccagatcacaccactgcactccagcctgggccacagagtgagactccatctcaaaaaaaaaaaaaaaaagaaattctctaagtgagaatttctcacttagagaaattctttgtaaagctagaggtattggagttgagccttgagtaataaattggattgctctaggctgaactacttattctacctgaaaaaaaatgctttgagaataattctggttaccattttagggttatagtagctttgtttattttattatttatttatttatttcaagacagaatctcacactgtcacccaggctggagtacagtggcacgatctgggctcactgcaacctctgcctcccaggttcaagcaattctcctgtctcagcctcccgaatagctggcattacagacacgtgcagccactcctggctaacttttgtgtttttagtagagatgaagtttcaccatgttggccaggctggtcttgaacccctgacctcaggtgatccaccggcttcagcttcccaatgtgctgggattacaggcatgagccactgcgcctggccttacaatagctttaaaatgaaaatatatgtgtgtttatgcatacacctatatacacatacaggctagcttttaaaaatttgtttaagttaacaaataaaaattgtagatatttttagtgcacatgacgttttgatatatttgtacactgtggaaaagctaaactgaactaattagtgtatcctagacaaactttaaaagggatatatattgagaaagagagagataaataaagatttttgaagttttgactttaaatgtaaataggacaaaacacataaatattaaagtaaaacaagccttttattccccagagaagatccaattaaagatgataccgatgttccagaagacattagggagacccttccttgtgtcttcctgaaggaaatgtcccattctcgctctgatgggtctgtttttctttttgttttcaccactctgtttacatttggtttcaggtgcattttgcacagaaatacaaccagatctctccctccagcccagatctgtctcacggcctccagacttgcctacagcaccacacgtggctgacccacagacacccaatatcaccttgtccaaagtcaaactcatcatcttcctcccacggatatgtttattcgcccgtaccccaacacagaaagctttcttcttatccccggagtgtcccccaagccctagtattcagctgtcacctgctcctgatgttcctgccccttcaaacatttgtcctctttgctaaggacaccctttccattgattctatatctgggtagctcaaagtgggtctgcccttttccacttcattnctgcagacctgtatactaattcgtaagagtgttaacagcttgctttggcattgtttgcttgcctattcatcttcgcttagactagaatccccaagaggggaaggtctgttcctttcatctgtgttttttcagcttcaccacaagggtttgggcctagtgcacaaatggacccctctatgatctgttggtatcgacgacttcagctgccatttattaagagctactctgtaccaataactatgatgacaattttacattcattatctcatttagtcatctgagtaggtatttgtttaatagcacttctaaagtaggtattcttctccctgcttcagagatggaarttctggttcagagaaccagagtttctctctggttagtgaccagcttaagatctcccagctggtgtgtgatggaagaaggatgtaagtggaggtccgcctgcccccgaaggctgtgttcaccaccactacatcatgtggaacaactggcagcgggaaggaggtattctagaggagaaatttagggagttcctcctcctacccttagaaaggtgtctgcttcctttcctctcactggatgcaattgattctacctgaamccagctaattagaactcagggtataggcatttattgcatctcccagaccttgtaatttttaacttttttttagagacatggtctcactctgttaccaggctggagtgcaggcacaatcatatcccactacagcctcaaattcctgggcttaaggggtcttcctgcctcaacctcccaagtagctggggacacaagtgcacaccaccttgcctggctaatttttatttcttttgcagacacaagttctcgatatgctgcccaggctggtctcaatctcctaacctcaaacagtcctcccatcttgacctcccagagtgctggaattacaggcatgaggcaccgcacccggccccttctattttttggtctacagtagtttcatcttccaatttgtctcattaagggaggggatgcaccccatatgttatgtcttgtgtgaaataaagtagattccagttataggattcctagtacagatatgataaaggagatcttacaaaagctatgattgctctcttgagtctgtggttctgactgtggtgtatcattgtgctatcaggtctagtgaggcatagtgatgcgtggggtgcaattattacatgatgtgatttgtaattatagaatgctatagctccctcctatctaaattattgtattttagctccctctccttgccatctctttcccatcactactaccacatttagcctagyagggcccagtgagtttcaagatctcaagaaaacatgcaggttgttagtgtcagtttgcttctgtgtgtgtttgtgtgtgtgtgtgtgtgttgtgtgtgtgtatgagatatcagtagtcttcaaaaaagttcatccagccagaggatggaagtatttatgcaaacattgttcttggcttctccgcacacatcccagtgaagattgtgtaaaagaaatcatggagaaaaattgcaattgtgaggacaccagtaaatgacaattgatagaacgattatgtggattgctaaaattgaagaacattgtgacacattctaccggcagggagaaacatattacaactctctttgcttagaaagacaatagcagcccattggtaaagccatgaattctggccacggctagcactnagagctcatggtgtgttttcagtctctcctttaccattatatctctggtattcaatagcagaggctcaataaggatttggagaatgaatggaaagactcttttccccattaacttccccaaatgaggagcatcttttagtatgggctttttatacgtgtagttccttgggctacctagattagaatcaccttgggaaagatgtaaaggccttagccctgcctcaagtctatggaatcagcatttctgattctgaatctgcatgttttataagcctccctagtgattctcatgcccattaaagatgtaaagctactgctttagggcatagacttactctgtgtaaccctgaaatggtnttatttaggtcatcctgttatcaagattcttgcttcttagcttttgtgcttctttcttcctttggaatatactgctcagtagcaatgcttaggagaaactacagaggaaaaggaaagaaggaaattggaatcttgttgcatcttgaataacttctggcaaatgagagaataacaaggcaaataaaacgctgtttatagatgtagttcagtgcctgttacctagatttttctcaatagatattgttattaaatgatttttttgttaaaaatttgtcccatcaacagagataatagaacttagggtattatgtaatccatatttattcacacacttatttgtcaaagaaaatttcctgagcactcactatgtgcaagtcatatctgagggttgcaaggcagataagacatctggttttcaagagacttagagtctaacggggcactaagagatgctcgtaactgcaggagagcatgtgaggtgccataaagatgttttggcaactccaggtgtttagagaagagagatgttatagggaggcagaagaatcaagggcgtttgtatggaggatttctcgtttgaacaaggtctcacgagaataagcaagatttggatttctgaatatgtgtgaggaggccattccatgcagtgggaaaaagtcaggttcagaggcaagagtgcccaaggcccatctggagaagagttcaatgtgattggaacatagctgtgtggtatgcagaattcttagaatggtctccagtgacacttggccttttctaagcctctcccctgggagtatgtgacatgatgagctgtcactccttggttttattaggccacatggcagaaaggacttctcagttgactttgarttactcaacaaggagattattggggcgagcctcacccaatcacatgacccctttaaaagtagaaagttttgtgcagctattaggttggggcaaaagtaatcgtgggttttgccatttaaaaaaaacagcgaaaactgcaattagtttcacacaagcctratagttgcagaaagaaatttggagtgtgagaatgcttagtctgacttctacatttgaggatcgagggggctccatgataaggaatgcaggggcctctaggcactgtcagtccctagctgacctcagacatataaccccaaggaggtgagcttgcccaacaatctgagtgagcttggaagtggattcttccaagatcctccagatatgagcccagcctgggtagtgccatgattttggccttgtgacaccctgagcaaaaacccagctgagcccgctgggacttctgacctgcagaactgtgagatcataaacaggtgttgtttcaaatgggtaagtttgaggtaatttgctacacaacaacagactagtacaaatcttttgaaggaaactttatgggggtaaaggactatgctagaatttaaatgataggttatggcacttaattcagtaatcttcagggcactattgaagagcttgagatgagagaacaacataaaaaataatcatcactcacatttgtttaacatttattaggttttaagcatacatttaatcctcatatcaggactgtaatacagatacaactattaccctcttttgcaaatggagggaatgaggctcagagaaattcaataacttgctcagagtcacagagctagtaaatttcaaagccaggatttggaacccaattgtctgcactcttagacatgagctacactgcttctttaaaaggaaaatggtgattgtcaagaatctgggaaattttttaagggcctatttacgtggcttgggttagagggaagagaggtatggggaggaatagtggccgcggaatctgagagaaatttcagaaacagaactgaaagccatggcattggctgcactgattctctggcagatgcatgacagaggggaattagatagattaaaaaaatttttttttaggtgtaagtctctaattaggtattttcagattaggtatttctggaagagctttgccatgcctgtaaatgacattgttcatctctcatccttccctgtcatcctccttcctttcttctcttcttttctttcttctcccaaatccatatttaaagtcaagttcctttttataaaatgggtttggtaatatcaaccttagcagagtctgtgtggaatttaatttgtttccttatataatgatcgttaagtttctcaaatgatgtgagccatagagagggaaaattgagccattataaaacatttaaaattatcatctgtgcatcaggatttagcaaaggtgaatataaataaaataaaataatcatctgacttccctagagtcacgcatagtgactattttaaatactcacacagtacaatatgttaggtcacagtgaggaaaatatagtagatctctagcaaattaacacattcaactgaaataagtgatgccatctcccaaagcatgtgtstgtgcaactgtgtgtgcgtgtgtgtgtgtgtgtgtgtgtgtcttgcactggttcttttgttgttgctgttgttgttgttgttgttgcagttgtaacatcaacccaactccaaaaagaacagcagttgaacaggcgctctcctgcagagcaacattctgctgaaagtttttcagatttcagaacttaaaacaaaaaaaaatgcagttcatagaaaagacatctctatgggaacatacgttgatagggatactaatgataaagatgattgatgatgatggtgatgacggtgatgttcttgatggatgggatgatcatgagggcagcagctaccattagttgagttcccactgtgtgtcagacaccatgcagagtgttttcaatggataatcttgtttcagtctcccaacattctctgcattttctcatatctaaaagggaggccataatagtactgacctcctaggttgttaggataattaaacaaggtgatatatcaggtgcttagaacactgacacatagatgccagttctaagtataattatttctatcctcatgttataggagagaaattggaagcaacatgggttgaatgacttgtccaaggccatacagtggtaaaggcaggacttgagcccaagcagtattttaatagagccagagtcaaacattcggtcatatggaacattcttctccatcccagtcgcaaacccaaattgttaaggatctctctgagggtgatgggagcatgattaagctgacaggtggtataaatgtaagacaaaagctgcacccttgctagttttccattgccatcaattatgaaaatgagcaaatagattatttaaatgatctcagatgagtaaattattcaaagagcctctcagtcagaagtatttctagaaactcctgaatagaccaatgaaaaccattttggttttctgacagggtcatctgctcatctgtgttgtagagaaacgcaaagccctgaggaagcggggaaagcaggagagagagagttgggggagagggaggcagggagagggctagggagggatagcaggacagggaggggggatggggggagagggaaagagtaagggggagagtgagagcgggagggggagaaaagaggagagagggagaagagagggagaggcagagaggtgggagagggagtggaagagatagagagggcctgaagagggggaagagagaggggaagaaggggagagagaggggggagagggagagaggaagacggaactggggagaggaagggggagagagaagggggaagagggagacgagagagagagaacaaagwaacagtggactttaaggcaaattttcttttctaattatattcccttgaatgctgattcctttcagaacttagagtgccaccagggtctctgggtgggtagggggcttatgaggtaagacccaccttcaactggagatggcaaagcttcatctgattggtatgttatgttgaggttcaaagtgagcttccatttggggaaaaataaaatatttctaaaataagtttgaaagcaagtagaggaaggrgattgactgtagtagttgtctgaatatgacgtaaataaatagtaagcatttgttgagcacctattctataccaaaccttacagtatggccttctgtacttattatttcactttagccrcataataaccctgtgaagtgagtctctgatttcatatttgagtcatgcaaacttagagatgttctatgatttttaaaaaattaatagctgagaaaggattcaaatttaggtcttgtgagtctccaagtttagtgcttgttccagtactttgcacagttcctaggatgaatgatggaaattttcatataggwtgtggagattcacagggatggtatctgccttggaagttgagtggaagttgggggtatgacaatacctaggcttttgtgtggacttaactcgtattctttaggacaaagtaactatacactatgactgtctctgatgggattgaaccattttcccatccatttatccacccatgcacccagctagtcatccaaagattaatcatctaataaaccatccatccattcatcagcccatcagaccaaccgtaattcatccagccatatgggcatccattcactcttgaacccacccacttacccactattgatctgtttaccaagcattcactgattactgactcagtgccaggcctgtngnaggtacaggcgaagcagagatgactaataaaatatccccgggattttagggaatgttggggtgatcagacccaacaccaggctgtgggggctacaaantccggcagagtcaaaggaatgggaaaagacaggttaagagtatataaggtgggtccaggaggccaacgctagtgtatggaggctgcaaaggccctgagctccggaagcccacactatttattggtgatcaaacaaagaagcaggtggtgaggacgtgcggatgtgggggtaaacaggtgaggacatgaggangtaggggtagaaaggtagcagtgcatcaagcatagctgtgatggtttagcattttctttgacacatatgtaatatgctctgctacctgagataatggagaacatatttacaagcctgggagagtaagaagcaaggagccagcaagtctgtgcacattccagaggccattccagtgcaattccacaagggattttatgccctgagccttggattgtatccaagccacgaggggttttatgccctgggcttagattgtggtgtggcagggcagccttccaccctttggcacagagcttggtgttccaaaggccatgagggggtttagagcctgggcccaggacacgttccaagactcttttacattatgacagagaagctagtcctgcctcagctcttctaccaacagggaacttataatgtagtgggagggacagggaaatgcactgctagttacagcattgtgaaatgagcataaacaggagaggtgcacatggcacactgggacacctactccagcctgggcactggggaggtgaaaaaacttcctgaaagacctaagytaggaccaagtcctaaaggataaagaagagctatccaaagggtgacagtcatcttatccattctagtaactgaaccacaaacattatttttctttatttcacattgcatctgatagcagcagctagatttctcccctaccccacccacaattactggagctcagtggctgctgtctgggcctgcttctcactttctttccattgtctctgttctattatttccccatttgcctgctgatggaacagacaggaatracatctgtccctaagaaaatggacagaacagagagctgctccccccagcaatctgcttctggctacaagtggctctgtcagcctgcctctgtagctacagtttggtttcctcatctgtgccattggcagcagaagcttcccattccactaccctgtttttcttggcattggaacctggtttggaacagggggagaaatagagataaaaagaggttgcatattctcagcattggtctctaagctgtggaggatttaatgtgctttctagactctgaagaacttgtaccttgagataattacccatatgttataaaaaaaatatgatgatgattatggcctaggggctatagattcaccactttgattcccccacacacccttttttaagagacgagaggctgcagtgaggagccacctgtagtcccagctacttgtggggactgaggckagataattgcttgagcccataggtcaaggccacagcgagccatgttcatgccgctgcactccctggagtggctcactgcaggcctctacctcctgggcttgagcaattatccagcctctgcccctcaagtagctgggactacaggtgtgtgccaccacacctgcctaatttttttgtatgttttgtagagacagggttttgctagattgcccaggctggtctcaaattcctgagcccaggcaatctgcctgccttggcctcctgaagtgctgggattacaggcatgagctaccgtgcccagccttgatcctcttttaacagacattcaagatgagtatgatcactcctgccccctccctccagttacatatgaagaaactgaggctctaagatgattgctgatttgcctaaggttacaaagcaagtatatggcaaagtctagattctagctcaggtctgctagactgcaaagtccattttgtttctacagtaccttatggtagagatgggtggcgttcatatatcagtagtgaaggctgtcagtgctttaattataaaaactcatgttgggggtccccccatccctgcacagtggatgtgcccccagcgttggcaagaaggactattacaggtacaagattccctgctgaaccacatgtctgtttctgagctcggctcagagcatcccactgagatgtatgcaaatctgcctcctaatcagtctcttgcatttttgtgcaaaacgaatcagcattcctctgcacatctgaagctgtaaatcagtccccacccctgcagtaaactgttcctttattccttattactccaccgtatggtttgttatctagccattgtcttttgaaaacgtgctttaaaactcatcgaaatcatattcctggagtctatattccttccatttaaattataattctgcaaattagaaagactgagtgggcctgtttgagatgggaagagtagaggctgagccatcttgacttccctggatgtgaagaaagactccgttggaaatgcccatgagaaaaaaatctaaagttggggaaaaacaagagaatcaactcgtattcccttaaagggagttgtagaatgactcatagaaaccaatggcctctcacttaygttgtctttaactttaacattgaaacaaacaatttgaatcggaagaatcctaattcctgttgattcctaccgtgctggcctctatgtggtccagcagattatagctgatggcatatgttttctttccacaattaaagtgtgtttgaagaaactaggacaggcagatctaacataggaaagsagggcaacaattagttttgggtatcagatcctgacatccatgctgtatacagggaaagcagaaacatttacctgcttttaataggtgaagagactaagatttagagacgagacttgttcagccttcttctgcaagaatagtaaacatttcactccacttttttgttttgttttctctaagaccaggaaagattccacagatgtttcttttctgtttgtttgtttgttgttgttgttgttgttgttttttagagatggggggtgtctcactttgtttctcaggctggtctcaaactcctgagctcaagggattctcctgcctcagcctcccaaagtgctgggattacaggcatgagccactgcacccagtctcattccacttttggcattcaggttggtgacttgaatcaatacagcaagatttgggtttctttttttgtttgtttaaatgtatggggtatacaagtgtaattttgttacatgcatagattgtatagtggtgatgtcagggctttttgagtatccctctcacaaataacatacattgtatccattaagtagcttctcttcagcctcttccctcagcctcctccctcacacccacttgcctttctgagtctccattgtctatcattacacattctgcatctaactgtatgcattatttagctcccacttacaagtgagaacatgcagtatttgtccttatttctttttctttcattctttcttttttctaacacctgacacagggtcttgctttgttgcccaggctggagaatagtggtgcaatcatggctcattgcagcctcgaactcttgggctcaagtgatcttcccacctcagccccacaagtagctggaactataggcaagtgccaccatgcctggctagtttttttgtttttattttgttttgtttttgtagagatagggtttcgccatgttactcaggctagtctcaaactcctgagctcaggtgattcccccacccctccacttggcctctctaagtgctgggattaaaagcgtgagccaccacatctgtcctagtatttgtctctctgtgtctgagttgcttcacttatgatcatggcctccagttccatccatgttgctgcaaaagacgtgattggattcttttttatggctaaatagtatttcattgtgtatatataccacattttctttacccgaagatttgagtttcattaccaaaatgacatggaggctttgcattgaggcattgtcatctcactgaaaatggatgaggattcaaaaaatacagatgggacatctgtcaagttatactataaatcagtggggacaaaagctagaaacacagatgtgtctgatcagaagcccaaaatacaaaatcaatgccaagagatgaagtgactagtctacgtagacaaagagagaacagcatcatggtcagganaagtgggctggcgacttcctcccctgtytcactgagcatggcaccggttaggagctgagctgtttggrgttagagagcgagtttgatcaacatttacgctgttgagtttggccaggggtaacatttgtgagactcysgctaattctggaaatctgtcattctttgtttccaacagcaaaatggagctaatgataatacccaccccttggggttcctgtgaggatattaaagctactatttattaaatgctttttgtgagtcagaactttagatgcatgatctctcttaactcatacaaaatcctgatgatattggcactattattgcccctattttataaatgagaagtctaaggaacagagaacaagttaatttccgctaacctgaaccgtattctgaaccccatttgtctgactccgaagcccatgctttgactactaacttctgctactttcttcaatcaaattctacaaagcaagtgcaattgtgccatgytgtgggagatagagaatttaagtgggaagcgaatggagcttagttttccttgyatcattccaaaaaaaaagtgcctaatagtttttaaactgtgattccatcacaggtcctgagccaaccactttatgtacattaccacattttatgttcactacaaccccaaatggtacatattattttatagatgagaaaaatgaggaccagagaagtgaattgattggaacatggtcacccagccacttcatagctcagaggcatcataaatgatatacatgccaagtatctagcatgaggcctggaacgtagttagaaagatcttaataaacaggaactattatgcatatacaaagtgcaatctagactctagacttctagacttttaaatggcacttttagggttgttttacctttttttttttttttcattttcagtggatttctaaaagtctattgacagtgttctcttttatcaaaggacctgggtccaaagttttagagacaagtgtcttcaaggagtcctttaagtcctgcatatgtatgaatatattgcaatacatacagttaagcaagtcctcatccaggagccagaaaactgtttctggttctttcacatatttgctgtaatttgtgaatgaggcttggtggttgacaggtgaggaagtggtggattgactcaragctgggtggaaggtggtgccaggtgggtgtgacaggaggayaagatgggagcaggaaaattgtgggcgtggcaggaaatctgttgctgtgataaagagatctgggctgtaatagggaaaaaatggaaagtcacgaatgagcagattgattgggagaaaatagaggggtccagagcccagaggccaaaatgacattggaaaagagacatgagaatagtccttaaatttgaaagttacttgagccaggcgtggtggctcatgcctataatcctagcacttagggaggccgaggagggtgaattgcctgagctcaggagttcgagaccaacctgggcaacacagtgaaaccctgtctctactaaaatacaaaaaattagccaggcatggcagtgtgtgcctgtagtttcagctactcaggaggctgaggcaggagaattgcttgaacctgggaagcggaggttgcggtgagccaagatcatgccactgcactccaccttgggcaacagagcgagactccatctctacaaaaaaagaaaaaaaaaaraaaaagaaaaaaagttacttgaaggaacatcagtttaccgctctgaaaaattgtaataatatctctttcacatctatgtgactctgctgtgatggtcaagtgaaatgagaaaataaccagcaacttctagcccataaagagctatattaactctaggacttttgtattattatccacataatgacacgcagctttctggctaggatgtgtcttccagtgtgtctattatctgaaatttctatctttttttttctatttcttttcattttttccccaatacagcttcttagccaagtgaacactagcaagtgtatgcataaggtcacactgtttgacacaaggatccaagaaagcttgggttacatttatagttatgaaattaatggcatgcattaatcgtgcagaacctcaaactagcaaatggaattaaaaataattgccaggcctttggatttattggtagagtgaaaataacaccaagtggcttttggcaggaccgccttctccgtgcacagaattatattaacagatgatattttttctatccaaaatagagagccgtaagtgaaaagcagatctgtctcctcttagagcagggaaaaaaaatccaaatacatttccttagtttcattttggcatacaagccctaggcctggaattttggtaaaaacaatgccttgttcctgcctgttctggagttgtgccagtgtcctccattcagcttacaagaacatgcacattgcaggtgggaaggaaccttgactaaataccttctgtgggccagacatctgactgctggttcacaaacatgagttaatgtcatccttctaagatccctgtatataataaaacacctaatcctggttgagcagggactatgtggcagatagttcaataagtgccttgcagttactactttatttatttccatgagaataatatgatgtgattactcctattatgcccacattacatataaggaaactgatgtccaagaagtaaagttagtcaagttcatatagctggtaagcagaagagctgggaattcaggtccagatgtggctgactccaaaatccacatcattttcagggcctattaccagaagagataattatagttgataattgactgcaggaagatcatagttatggtggtcatgttggtacctctgtgtgctaacttgtctgttttatttatttagagacagagtcttgctctgttgcccaggctggagtgcattggtgtgatttaggctcattgcaacctcttcctctcgggttaaagtgattctcatgcctcagcctcccgagtagctgagattacaggcatgtaccaccacactcagctaatttttgtatttttagtagagacagagttttgccatgttgcccgggctggtctcaaactcctggcctcaagtgatcctcctgccttgccttcaaagtgctgagattgcagatgtgagccaccgctnctggctaacttgttcatttcataggtatttgtgcatctattatgtaagcagccctgggctgggtacgagggccataaaggcaaacagaacacagtcccaccctcaatgagtccactngggcagacagatgagtgtgcaggtctcacactagctagtgaggtagggaaaggagaggctacctgcccagttttatgggattagaggctgcttcccagaacagctgccctctgtgttgagttctgaaggacacataggagagtgccaggcagagagtgggaaggggttttctgggcagggtgagtagcgtgttgaaacctggcactgagagaaaagctcaatgtactcagaagcctgtgattagttctgtgtgattcatgagttgatgtggggcagggctggaaccaggagttggttgtcaaaatgaggctgtcatgaatgcagagggaagggaaggcctggggaggaggccaggtcacttagaccatggtcaggcattttcacttgattccagctgcagtggggaaccattaaaaggccacaagctggggagtggaagggccagatacacagaggtatttaaagtgacgatttgggctaggcacggtggctcatgcctgtaatcccaccactttgggaggttgaggcaggcagatcacctgaggtcaggagtttgaggccagtgtggctaacatggcaaaaccccatctctactaaaaatacaaaaattacccaggtgtggtagtgcgcacttgtaatcccagctacttgggaggctgaggcataagaatcgctcgaacccgggaggcggaggttgcagtgaactgagatagtgccactgcatccagcgtgggagacagaataagaccctgtctcaaaaaaataaaaaataaagtgatggtttgggctgctgtttggagaatgggatgaagagcaaatctaccagaagcaagaaggccagctaagaagctgagtcataaaccagtgagaggtgaaggcctggatgagggtggtggctgtgagttaggaaagcagtaaaaaatgttcaaatattagaactatcaaggcttggtgattgatttaatatatatgggggtggcagaagagagatgaattaatggatatttccatggttgggatttcaagaactcctatatggcagatgggagagaaactattttttacggtggaagataagaggctgagttcttctctaagcctactgagtttgaggtttctcggaggcagtagagaagaatgggggaaaggcagcagatcaggggctgtcaagagaggtgataactggagactgtggagcagaagaggccgaggcctgagcctggatgttctgggggcaagagggagaggaaagacaagtcagatgtgttcagagaaggagaagcttgcattttggcagagatgaatcagccaacgaggtgggaaacagttgggtaatggtagtgtcctgacagtctagggcagagaactcaagaaagatgtgagtagtcccattgtcaaatgcagaggaggggcttatgtgcagtgcacctgttggatttagtgaaaaccactggaggtcttaggtcagtttgagaggcaaggacagtgcagaagagaatgtgtctagagcccaagggctgggatgcgtgttaggctagaggagagatgcctcctttattactgaaagaggggagaagaaagacatgtgtgcagaggcaggtgagtttgtgggtgatgtgggttgtccatagagtctgaaataagaggcagattcatcagctgggagtggggctggagctggcagctttgcagtcttgtgggcaggtgtgaaggtttgaaatagtttctagggaatgggagagatgcaattaggaaaaaggaaagatttttagccagagagggagtcctaaaatttgaaatgacattaatctatgtggttatatgatattctccacctgtacttgctgctttacaggtgtggaagtggtgggattgactcagagttggggagggtgctgccaggtgggtgtgataggaagacaaagtgggggcaggaaaattgtgggtatgacaagaaatctgttaatgttatggataaagaggtctaagttggaatcgggaagaaatgaaggcatgaacraatagactaattgagagaagatagagaccagggatgacgctggagaggagacataagaatacctgaatgagagctgtggattttctgaattcagagtcatttgagtcaagcagttctaagtgaatttcccccatgggaatgggtggctacagtggactggaggttctaaatttagagtcactcaagtcaagcagttctaagtgaatttcacccataggaatgggtggctacagtggactggaggtggtcagtggagagatggtcaaaaaaactggccttcagttttatccaaatgctctgacaagtatggatgtgtttatgaaatgacatcaattacttgcaaataggacaatttcaaaatatgtaaggagtactaagtcctagccatatgtggatgaaatcaccaatattatccccaggtgttgagtcagagggatttcccaaggccaattgccaatttcaacttaaatgcaaccaaattccaatgtgcacaaagggattgtagcccaatatccaagggcttcttcagtcttgtcccatggtatccctttattcctctttccctctcttctcctttatatatttgtgtttcttcctgtttggacaacttcctagttcacaaacatgtcattaaaactcagcttctaagcttttgtgcatgctgttctctgatcctacacatcccttctttccactctgacttttcaggtcctttgcaaactgcacaactcccctccatygcactccttcatgatttcttccttccctcatcagatctgcctctcacttctgaagccctctgcatttcttgcacctttcaccctttggctgttagcattttctgttttattgtatgattaattcagagggcattgtattttatcttcctcactggtgagtggatcctttacagataaggacttagagcaggggttgacaaaacccctaactgtttatgtaaagggctggctagtaaatattttaggctttgtgggccatactctctctatggcaagcactcaactctgcatttttagtgcaaaggcaagcgttgaggctatgtaaggaaataagcatggctgtgttccaatcaagctttatttagggacactcacattcaaatcttatataattttataattgtgtcaccaaatattcttttcatttttttcaaccatttaaaaatggaaaaggaaaacccattcttagcttgtgggctgtgcagaaacagcttgcccttgggctgtggtatgctgaccccaggtttagggtctattcactgctgtgttaccagtgtgagaacagtttatggcacatagtaggcactccatgaatgaatgagcaagatgaatgcatgtgatctaaccctaaggaactgaaaacctacagaatagttctgtttattggttgtaacacttggagtaattaggaatcctgagattctgcttttggctataatttgtgtgagtttgaaaggttttgatgtgacatagctcataagtatcatagttgaacttggacttgggtcttccaactccaaatgcacggttcttttaaactgctgtgtttgccactatattaataattcagtgggaaaagcaatgctgagaggcttcctgattggtcaccatgattctcatttctcccagtggctccatagggctctcaaattgttgattactgtctgagatggggataattggtttgggtgaaattggattgacggtggtgggttacttaggcttagttttcaaaaayagcaagtcttatccatcccatcccaagggaaccctcctcttcccccagtgccttagaataatcacgtttttaactgggcaaagctgtcgttaagcttattactgttttctcactattaaatcttctgttggctttagtatttcaaatgatcctcttgttggaatactttagagctcagacaagcctggagcaaagtagttttgggccagagatgagcaaagaaaaatgattgtcaaaataccatcttatctaaggaaaattgaaattctcatcagtgtgcatttcatcataacgatgcatttcacccatgcacaacggctttggttagcatcctcataataactagcagggcctcaggcaccaacccctttcatttggaagaaggaaaatgtccatctcaaaaacttaaatttattattttgccccagatacagaagaacaaatgcccatcagagacctgctaccnagttccagacatttcacctctcacaacgcaataacttttcacaggcgagggggatgaaatgctgttccactgattgatacctccaggttctgtaaccttattgcaaaactctgcagacacagtcaatgaggttaactttgaatgttcagggctgagatccaaatggaattggctttttacataatgctgagtgaggaaatccatcagcttttgacttgttagatccttcaagtcaggtttgatgcattgaagtctcgtgcttccttagcctgcagtttaattacctggaacttatctccttttataaactgttacacactcagccccacattttaccacttttcaaggttttcatttaaaaaaaaacttgccatagagtaagagaagtcatatctatagtcatgttcagtcataattttcaggctggtaagaatgaattgattatcacaataaataaaaggctttntcagctgtcagcccaggatcacagtctacctctcttagccactttctaactcttattggcaagtttgctgagggaamaararcttcttaatatcattcaggtaaatactccccaaaagagctgtttactctgccagactgcaaatggcatttcatttattttacaattggatgttatgctgatctttgaaatttacccagaaaaagtacattagaaggtcaaacaaaaacctttaccatatttctaaattgtctttatgcaggtattaaaaaataataatagttatcactgttactgtaacaaaggactgtccttaggtcaagttctcatccaatgttatgtgtttaaccttccccagccccaattcctgtttctgtgattgtcctagttaccttcacatctcctcctaaactttttttgcagacctatatgcattctagttttctcctccaagaagcagccccttaagttcaaccaagtttatgtttgggtttttataataacagatncagatatagaaacagaattgtgttgtgttggccaacaatatctcaaatataacatgatacagaatgaagatgaaatcctcctttctaaggccccttacataatggatggagatgaccacagaggcaagggagaagtccaatcagctgctagagcattaatgacattcctcttggttgaaacccccaaattacctaattgacacatggttcacatttgaacagttgattttctctgcctgatctgctgttctgatcgccttttggatgtccgtgttggtagcagtggaattcaacatcaagcctgcaaagtagagctcagtgcagctctgctgttagaggtattttctgtggtggaattcaaggtcctcagaagagtcaattcacaggcaaatggaagaagtaaaactgtcatgagtaaaagcamactgtaagaccacctctggctgctttctccccacctcctgtgctccacatggaaagaaaatgttgccccttcccaaagtggaagactgtgcatattggggcgagaacctggcttctccaactctcaggacatcactgtgctgcatggtgctaattattaatactgtcttcccaactgatccatgaaatattcccttaagaaaccaaactgctcatgtttgccttaatatttcccaaagcaaataggatggcagccttggaaatatcaggcagtggtaacagctcctgccctgaagtccaagctcagattccaggtcttctcacttgctgtttgatcttgggcaagtcacttaaattccctgtttgccaacatacaaaacgagtctaataatggcgtttttatcagaggattgtgagggtaaaatagaaaatgcccgttggggtgatcacagtacctcaataaatgccaacaattatactcgttaattgtttaataattattattgcagcccatggaagacggactgatacggaacttgcacaatgaaggactcccaagagcaagttcaaaaaattaatccatgattatgaaagagctccttttttatttttgctgatttttcaagtctctggcattatattactccaaggtagaaccaaaagagagaaaacactattaactttttagctaattacaagaacccatcacttttaagagcacacaaagaattamaagtratccaaagaaataggactcctatctttccccagggatctggcaacaaaggaactctggaggactgaagattatacatgaactcctgaagaaaatgatggctctttgttccaaagatttttccgcttttaaatttgagattgaacaagcattgagctcttcccctgttggctgagcctcaagaggagaatggaagcagagatgcgggttgttcatggaaataacaatcaaaacacgtttctatgaattaccagatcagtactgggttctaagacagttgatgctgttatccataaagatactagattatcttgagagcagttattacgagaggaaaaaaaatctacttctccaatgtgagctgtgtaacaattaggcaattctgaaatttcaactgagaggaatttaattaaggctctaatagctgattaaactcatttagatctgctggcaattgccagtggttacataagtaacccaagaagaaagatttccatcttgttcttatgctttatttaatcctgtatgttagtcataggtcttcccctcctggtgctccttaaaatggggtccttagaccacacggagcagaatgactctaggacgctggttgaaaagtcaggatcccacaccttatcccagatctactgattccaacactccagagatacaggagtctgcattcttaatcagcttccaggaaaggttcttattcatgccaaagcttcataatcccaccacctccaatcgttgcatttaaaacagtgcattcagaggaagcaggcactttacctcaatatctgaaaagcagttcttagtttcactctgccggtagccatccaaggctcatggcagtgaagacagagcaggtttgacccacacctgctctttagtaatttctgcatagaaacttgtttgtgcataccacacaggggaaaattgagttccaaagtgacncttgatttcagcagactggttttctgggatactctttagatcaggtattggtttaaaaaacatcactgaactcaactgcaaagtcctccagatacagcatatgtcaacctaatatcaagccacagcagtggctcagatatctttattgttgtttctggatcaattacatttagatctgcttttggtttcaagcagcaacccaagacccagaattacttatgtgttaacctgtgatcggtttgtttgtgtgtcagatgtgcattcagcggcatggaagtgatgctaatccatgttgctacttatgataaatatggacactaaatcattttaaatttccttcacggccatttatctcatgtcctttggcagactttatatttcaggtggagagaaattggtctcccgtttgctttgtttttcctccttaacatcatcttcctgaagagttaattactcatgttttctccagcttgggagtaaatcactgcttattttctggagtgaaacatactccgaaggtttgcaagctcaatgtgtttgttttaaagcctgtttccccatggttatgaaaccacccaatgagctaactgggtccagccagactagagcacaggcagcctgaactctgcttctgttgttggttttaataaatttcctgtctgatttttagttttgcaatttctattgtcttgtctccaaggagagaagatgagtaaacaggcaacttccctttttaaactctgaattgtaagtaaaaatggatgatatgctacagtcagaattgaattcagttcagcggatacttcttgaactgcattgtgggtgagcactatactatatcgaacatggatcacgtggttgaggaagactggccagccatgacactctacaaaaccataattcgaggcaaactgggccctcattccccacccctacagcccatctcttttctgttgattttacactttgagttcacaccagcctgaccatcatggcctgtgtcatccagatcctgcagccatctcccagcttgtcactctgccttccgaatcttctagctacaaactctatctctgcactacattgagaagaagtgtttaatccacttctaattgggggattgatttcagtaaggtcttcagtaagtcctcatccccatcccttacatatgtcacttgcccataggataaagataaaaccccataacaggcaacctactaactcccttggtctttctttttttttttttttttttttttttgagagactcttgctctgtcacccaggctggagtgcagtggtgcaatctcagctcactgcaacctccgcctcctgggttcaagtgattctcatgcctcaacttcccgagtagctgggattacagacccatgcctggctaatttttgtatttttagtacagatggggtttcaccatgttggccaggctgatctggaactcctgatctcgagggatctgcccacctcagcttcccgaagtgctgggattacaggcgcgagccaccatgcctgtttcatatttggaagccacttcctgttagaagcattttttggattctcttccagattaggaagctgtgttcttcaacagcatcctgtgcctgctcccggcatagcatttgtctcacttcattcacttcattgctattaagctttgacttctctccaccgagactggaaactctagggataggatagacctctctgaggactgttcaccaccgtagccccagggcttccagtattacccggcacagtggaaagcactgaaggcatgtgggctcatgaataaacaagtgaggggaaagtgtgttctaaaggcaaagaaaatgcaaaaatgaattccagatggagaattaggttccatgggagtattggcatttgagctaggcctgaaaagagtgggtaggatttcagtagggggagataataaggagaagaattccaggcagaagaaatagtgtaggcataggcaggaaagtgggtgtcgttcagggtgtgttttgtgaaaagtgtatgcatcattgtagcttcatatcctctctgtgtgtgtgtgtgtgtgtgtgtgtgtgtgtgtgtagaggttcgagtatatgtgtttgtgttaggtatgtgtgtatttgtagttgtacgtgtgggtgtgagcrtatgtgattataatgtgagcgtgggtaggcatgaatgtacctgtatataagtgtgcttttatgtagaggttcatgtatagatgtataggaatatgtatacatatatgtgtaggtgtactgatggtattgcttgagttcttataatagtaaaaactgacattcactggacacttatgtatcagacacttatgtatgcacggtttttagtgctattttaattgtaataaacttcctatacacaagaggaagtttgggaaatactttttatctctattatgaatttttccatgtttaattgtgaatatgtgtaggtataagtgtgtgtgcaaaggcagatgtgtgtgtgtgttagtgtgacgatgtgtgtgagaatgagagagagaaagtgagaaaaagagaatagtgaggttgattgggcctgtattatagaagagcttttactatacagagcagtctggatttgattttgtaggcagcatgagacatggagggacttgagcatggagtagatctataattttggtgtttagatatttgttttttaggaggtggcttcagagaccaggagacctgtgatgaggttattttaattgtctcttgtaagcatttcataaatagatcaaataagataaaacactcagatctctttgaaagagccacgcacatctattaacctaatttcttccagccttttgcagccttggcaacatccctctgaatttatccggacataagaggtgtatattaacttgagacatacaatttctggagatgaaattatctctgctctaagaacatattggctgaacattttgataagtaatcactgccctttaaaaaaaatctttctaggagctgaagagcaattagtttcctaaaagcactgtatttaaattttattaataggaattaaacatcattacaaagttaatctaccctttttatatttcttttagcaaaatcacttttctccatcagcggtcaattattattattattatttttgtcgtcacaacttcagtatatttctgaaaacactcaaaggcttatcaccaaaattcagtttattttaaaggtaaagattttttttctcctcccacacaacctattttgttgaattgagaactgcttttaagtaccaaaaaaattcataatagagataaaaaagtatttccctaacttcctcttccgtatagggagtttattagaattaaaatagcactaagaatggtgcctgatacataataagtgcctagtgaatgtcaatttttactgttattataagaactcaagcaatgccatccccactttattgctttcttctctcaatttcttagccagtatttattttctgataagttgttctctcatgactgccctgttctgatagttccatcaaaagtcccagggaaaactctcattggcttagcttaggtcacatgcacattcctgagccagtcagtgtactgatttgccaaataaaggacacgtgcctattcgttaaattagggcagcatctctccaagggaaaatgaatatgctataaccaaaaatctgataaatgaatgacaggtaagcaaaacagcataaggctattgtgaaacccttgggagaaatgtggagaaaagcgtgatttatggctaaaactactgacatggtaaaaactgtgtctaaattaaactaaagttagtatcgagaaaagctcttatgaagttaaaacatgaaataatctaaattctactctaaaattgtttccccattgatttaaacaatgacaaaatagcaatacatagcacatagcattgggcattcctttatgggctttaatacattaatttagtcctctcagcaatcctgtgaattatactattaacatcatcctacttttcaggtgatgaaactgaggcaaatagatattaagaaatttgcccaagtggcacagctcacaagtggtacagctgggatttgaagccagagtggctggctccaaagtttaaactcctggcaactttgctactctgtgtctgagaacatatttgctgtttttaaaaaactctcccttttgaattcaaaaacagtttttgaataaactttttaggttaactagttttatatttacaaaaaacttgcaaagatagtccagtgacttctcacatacctaatgcccagtttctctgattattaacacctgacattagtatggtatatttgtcataatgagtcaattcgtatattattgtcaactaaaacccatgattttttcagatttccttagtttttatctaatctttttctgttccatcctgatagctgatccaggatcctatatgacatgtaattgtaatattgccttaggctcctcttgactaggacactttcttagaccttcttgttttttaatgacctttgacaatttggaggactactggtcagatatcttctagaatacccctacattggaatttttctgatagttttcttataattacaccgaggttataagacgacacaggtagaacaccacgccattatcatcacatcatattaaggatatgtactattagaatgatttatcattgtccatattggctttgaccattgagctgacatcacatctgtcacatttctgcattgtaaagttagtcttttttttttgttcagcagaaaattctagttgcattttttcacagacttaaaaatgagtcctgggttcacatcctggttctgccatatgaattggacaattacttaaaccccatgcctcagtttcctcatctatgaaatggagataataaaagtagcatgttattcatgtatctatttttaggattacagaaattattaaagctttcggaatagtagaaacggaaagacttatttttatcatctcatgtaatctttttttttttttttttttgagatggagtctcactctgtcacccaggctggagtgcagtggcgcgatctcggctcactgcaagctcggcctcccgggttcatgccattctcctgcctcagcctcccgagtagctgggactacaggagcctaccaccatgcccggcaaattttttgtattttttttttagtagagacggggtttcaccatgttagccaggatggtctcgatctcctgacctcgtgatctacccgcctcagcctcccaaagtgctgggattacaggcgtgaatcttatgtaatctttataacaactctgtggccttgttgtaacctttaaaatatgaagaaactaaatttcaaaaagggaggtagtgattaagctgtgctctagaggttttcactgactaagtttaaattcttactgtgagccttatgatctgacctgagcaagaaacataatatttttaagccctggtttcctcatcatgcaatgaggataattatagttatctatgtcctacagttgccttgaggattgagtcatataatgaatgaaaaacccttagcactgctcctggaaacacatagtaaagccctaatcagtgttaacaatggtctttgtcattattgcccactgtgccccagctaggaatggacaagtcaggatttgaactcatgcccttctttagagaatgaggaagagccagctttgagaaaagcctcagatttgagtaccactgttttttgtgcagcatggagaattactatccaagagggctctattgaccatgttcttctttcctcagtcttctaactggttctcagaaccatcctgccaccttttttagagatagcttgccatttggctgttttctgctgtcctttcaccctgggtgcaagactgccctaatatatggttgccatacagaattaaatgtcaagtaaggagtgccacctttgcccctcttctaattatgtactcattaccctgagctcaaatcaggaaagatttgggagggcagcttatccttgcattttacatagagtgctatacctgaaagaccttagagattatctgattcaaacccactcccctcattcctgttacagtgaggagaatgacacccaatcagtgaggtcaaaagtcaagggaatgccattgaagaaactcagatctccatttgtcaattagttcttctgctacagaggctcattttcctgaagataagtttaacaaatgttgaattaatgataatagttccacgtatggagacctttctgtgtgccaggaactgtgcattaagagatgtttgttgttattatcttataagtaagcstcataacagcatatgaaatggaagtgttgtttttatttggtgattgagtgaactgaggttcaaaaagattatgtggcttgttcaaggtcacatggctaaagcagtgacaagatttgaacctgttcatctgtctgatctctaagcctgtgctattaatgattctgaaccctcttgtcctgtgccatgtaaaggagagaagagaggggttctgtagcaatgaagttgatgcctgaaaactcaatgggatccatatgtgcwtatacatgtacatgtatacagcacacacacacacacacacacacacacacaagcgtgcttgcctgtcctggttgtgtataaatataaccagaagtttggcaaggtgtcctggaacttcattttccctccaagctccaaaaatagcatgtgattgacaaggactgtatgatttcacttgctctgatgcattgaaaccttattcctggaagcactgctggaggaaatggattgaaaccttactcctggaagcactgctggaggaaatgcggtgcaaccctggtattggctcacacttcagaatagcttttatgagtcaggaatgctgatctaaagttacagactcagctgagtgtggtgttcacttttatggagaggattgggaacaggaaaaaggtccagtttagagaatagcagaagagtcaccatcacgtccaaggtgggagcagagatatttttggctgccatcttcaaagtgcacagggtccttccattttggatataacttctaaataaaggcatttggagcatacatactccatgccactgtggaaatggagacaagcagaaacaatatgacagtcgaaactgaggtcttcaggattcaacccattggttctttctttctccctgaatactctggtggctggagtccctttttaaaatggtgttaggatgatgctgtttgctttctctggggaaatttaatacccaaaggctattcagacggccaccctcaatggctctgagtctcgggggctgaagttgcagtaagagcaagggagagaatacaggtccttgatacttccatattttgcctagggtacaagattccaaagctgaggcacatatggacacattaatcattctaacactttctgactcatgcacatgtaaaaaatacaggctgtatgtttattcactccaccaaaaactacccattaagtccctccatgtggcatgccctgagttagaagctgtggacatagaaaccaatcattacgcatataaaattcctggtagactgggaaatcatagtctcataagtaaaacatatacataaacacatagattattgtagattattgaggtataatattgtgaagcaaatgatgtttagatatttaaatcaaattaaggatttatgaataaattatataatgggtttttttgctgtaatatagaaggagtgagtgggagtataaatgaaacaagattggtcatgagtactaattattgaagctggacattgggaatacggaggttcattatatgattctactcttaaatacatttgaacatttccataattaaaaaaaaattggagtaggcaaagaagcttccatcttcaggcaggttatatatggacatatatccatggtgacttctataaatctttttccattctggccattgaacttgattgactcttagtccatttgggttgctgtaacagaataccatagactgggtggcttataaaccacagaaacttgtttctcatgcttctggagactgggaagtccaaatcaaggtgccagcagatttagcgtctggtgagagctgcttcctggttcatagacagcaatcttcttgttgcatactgatatggtggaaaaggcaatgggtctctctggggcctctttcataaaagcactaaccccattcatgagggctccaccttcatgacctaatcagctcccaaagacccctcctcctaacaccaccacattaggggttaggatttcaacctatgaattttggagggacgcaaatattcagtctgtagcaaacccttaaggtaaatcccaacttcttaatagagcctacaaggctttgcattttctggtctccacctatctggagtgctctttccttctctgctcctccacaattccttcccacaactgccacgatgcaactcatcctgaatttccaatttcagcttaagtgtcacctcctcagggaagatgtctctgatatcttttctcctatatgctctcttagacccatgtttcatttcttcctcccaatttgtatgaacatatgtttttgtgtaatcatttgactcatgtgtcttctcaattagcacaaaaatttcatgcaagcaaacattttatcacttccattacagtattctcagtgtctagcacagtgcttggaacctagtaaccactcaacacatatttatggaatgaatgactctgctaaacctgtctacaaacactggcctcagttatagtcccttgtaaataggaatataggcagggaaagtgaagaatgtctgttctcctttatctggtatatacgatttagtagttgagatttttggtgtttgcagtggggtgccgaagggtctatcagatgagaaaagaaggtaagagctcttgggacctagggcagtgttgacacagcagcttcagctcctgatcgagttctctctacctaccactcatcttcaacctccttggctgacccatggatacttggatgtgtcaggaacagggagtagaacttggagaagatttaggaagttattgcactctgggggctcataaacctttgcaacttttctctccatgagygagcgttggactgaaacttttgcctgactcccatggtgtgggggttgtgatgtggtcaatgacatcaccaaagattctgctagtctttgccttaatttacattatcttgggactttaggaaacatgtctgcaaggaaggaagagtgttggagctataacgtggttactgtagctcaattcacagaaacactgtacatagcgagaaagcacctttgggttcagaaagccccacgttataactctggttccaccacttattgctgtgtgagtttgtgcaagtcacataacctctctgtgtttcagtttcctgaactacgaagttggaataataatgcttaccatgtagagtttgtaggaattaaactaagtggtgatattggcacatttcctgactgtacaggagtgctcaaaagttatgtcattgaggttataatataaaatgctacggtggagatatgcgcaaagttctatattactagggaaagcaggaatgattttacaggtaaggtgacagttcagttatgttttaaatgttaacaacaatagtaaaataatagcagccaccatatgtgttacatgccatgtcaggttttgtgctctatatttttggtactttttggctcattcaaaccttactgcagtcttcaaggtcataccctgttgctctcttcattttacaaatggagaaagtgaagctcagagaggttgaatgactttcccaaggctactcagctagtggatgaagccaggatttacacttagttctgtttgacttcaaaagccattctcttacccactgaactacccaccctctctcgaaggttgtgtttgagtcttccaaggcaaatggaaagaaaagggattggtataacatgttccaaaaggaaacacttgtatatttctttatctatttgcatatttcagtatttttggtttgatctatgtcgtacaactgactgacagttccaagaaggcaagagtcattctgttttagccatcattattcctaggctggcactgggacatcgtaggtcttcaataaatctatgtcgaatgaatgaagaatttgatgcgctcarcattctccccagcctgttacatatcatagcgtgaataaatgaacatgtgtgtgtgtgtttaaccaaattgctctactcgccatcctatcttaaaaagaaakgtatcagcaatgctggacaattttgtaattagccacaggaaatgtttctttatagccagcaaaaattttccagcccatatgatgaggtaatcttagagagcactgattcttttctctcctcccaccctgtcacctctcctggtgtccggcatgtttgaattctctttaagggtttgagattcatttctggtgacacttaaacattacaggaggagaggtgagtgggtctggtcaacacagacaagcctggatttggcacttagcttttcacacgaggtgttttcctcgaggttggtattacaaataaagcggtgacctgtggtgtcaagcaatggcgtgtgggagcaggaggagaagggagaaagagcggtgcgggggcagcttcctcccagcgtgtatgtgaatagcgccaataagctgtcaaataaaattaaggttcaaaatatacagccttcaatttgattgcactaagatgccgactgctgctccgagggaatacaatcgattctattttgacaggtcttgatgtacgctaagcagtgacagtctcccctctgtgcaggattaataaaagttcaccttaatttgcaacttaaatagaactgtatctggggtcaaaatgatgcttttaatttccccacctgctccatctcttctctgtgttgtctcaacccccactcctcttcttttcactctctagcttcatcttcctctccctttttctcttttccttcatcttagcacctttttcttctttctccttttcactttctctcctttatacttagaaacaatatggagtacctatgttgtgcttttgcctttcatgcattgctttattgaattcccatggcatccttaggaagtagggggaattgtgttcattatacagatgagaaaacagaagatcttaggattaagagcttgcctagtacagctagtaagtggtacagtgggagaatcaaacccagacctctctgattctaaaagtctatgctgtttccttgccatccgtggtcctgaactctggcagaacattagaaccacctgcggggctgtaaaggtatcagtgcctgggcactgcctccagagatgcaggttgattcctctggggatgagggcggctgggatggagaactgcccyatattctgttttctctttatgcccgtttgtcttagcacagaagtagatgcatatgttgagatatgtggcagaaaggcccttgagacggatggatgtctctggcagggaaaggatttgcctctccagaaatcagcggcggaagaaagcacagctgtgtctttgtgtttgtgctgcaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctnaccgagacgtgtgtgaggaacaccgtgccatgtcggaagttcgtcaaaatcaagtgagtggcaggaatgctgtcacctgaacgtgcccaaccctttgaaatagcatggatcatcgatagtaacaatatgtgtacttgaatcacaaaatgtcatagaaaatacacgtcgttatagtaggtataatacaataatcaatttaaaaaagacttagataaattcctagagatgtgccacacttgcattcatttaattccaccagcaatatgaggtgagtagttttgcccattgtaaatatgataaaaccgagttatgggaagattatgaaacatgttcaaagccatctagctaggaaatggaagaggtaggactcaaacagtggtccaactgactccacagacatgtttttaacccttaggttgaatcaatcctccccttcagtctttctagtttaatttaatttattcatttatttatttttgaacatacatattcaaaaaatatctttatatttttaatatagaaaacatttttgtatattaaaataaatataaaacatatcttaatatattaaaatataaaacattatatataaatatatagaaattatatattttatatatttaaatatataaaacagtatattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaaatattataaaacatatattttatgtattaaatatataaaacaccatatgtttttatatattaaaaatataaaagatcatatatttttatacattaaaatatgtaaaacatcatattttatacattaaaaatataaaacatcgtatttttatatattaaaaatacatatggttggacacagtgattcacatctataatctcagcactttgggaggccaagctgggcagattacttgaggtcaggagttgaagaccagcctaggcaacatggctaaaccctgtctttcttaaaagtacaaaaattagccagctatggtggtgggcgcctgtgatcccagctactcaggaggctgaagcatgagaatcacttgaatctgggaggtggaggttgcaataagtcgagatcgagccactacactccagcctaggcaacagagtgagactctgactcaaaaataaataaataaatgaaaatagaaatatataaacattatacatttttatatattgagatatataaaacatatatttttacatattttatatataaactatttttatatataaactatatgtttatagataaaatatatagttaatgtacaagtttatatataaaatatatatttatatgttaaaatatataaaacattttcatatattaaaatatagaaaccaatatatttttatatattaaaaatatataaaccatatattttcatgttaaaaatatataaaatatatatttttatatatatataaaacatataaaaataaggcctgttttggtttggagaaaattttatcaatgaggtcacaaatgtcagcctctttgaagttgaaatcctgaatacatcatggaataaataaatatgcccctactgttatgttagaaatgtataaaacgtatgtttttatatgttaaaaatgtataaaacattatatatttttatgtgttaaaaatatataaaacattacatatttttgttaaaaaatataaaacatatatttttatgtgttaaaaatatataaaacatatatttttatgtgttaaaaatatataaaacattatatatttttatgtgttaaaaatatataaaacattaattttttttatataatgacagggtcttgctctgtcccccaggctggagtgcagtggtgtgatcacggctcactgcattcttgaactcctaggctcaagtgttcttctcacctcaacctcctgaatagctgagactacaggcctgtgccaccatgtctggctcatgttttaattaatttttttttttagagacaagagtcttgctatgttactcagcctggtctcaagctcctggccttaagtgatcctcatgccttggcctcctgagtcactgggattatagatgtgagccactgtgtccggcttcctttagtctttttaaaaataattatttagtttccacttttctggctgtccctttccttccccccacacattcttcttccatctcttttatagatcccagatctatgcttctcaagaaggttaaaaacgtctctccatttgggagtgaacacacaccttgcatgttactttctgatacaatccaggtgcaaatggaacttctggcagtttctcagctcagcaacagccagcaggcactgcatctgtgtcatttctccttttgttatgattgaagaaagagctggcattgtccattatgaggtccccttaatctacaaaccctctggggacacagaaacctccatggccacctccaaggccctgatcctggtatttcctaatgcaaacataagcaaaaacaccacctcacaggagactcacagaagaaaaaggcctgctgttggaaactttatttgttttctgagtcttttctgatctgtttcttttacctaattcttactcatcctttaagtgtagctcctgcgtccccaagctgggttagctcttcctacttccacagtacctgggtgtatctctctctaccctcatcacctgtctttacagtgtatagtttgtcttctccctggcttctgagccacctacatatagggaatgtgacttattaatatttgcaccctcagttacaagggcacagcatgacacaccaatgtttgtttcatgactaggaagagagatttttacttcctcgtttcaaactccagtctcagctattatcacacaagatgcaagtgcccagatctcagtccttgagatcaggattttaaagatataatatgtrattgctaaatgtattgtgaaggcctgttttggtttggagaaaattttatcagtgaggtcacaaatgtcagcctctttgaagttgaaatcctgaatacatcatggaataaataaatatgcccctcctaaaaaggcccttgctttctccagtgtccccactgtggctccctgggatgaagtttttttttgataagcagtcccccagcctccactctcctggagatgaggaagaggtggggcccaccaaggaagggcaagtgtacatcccatgattcatgattcataattcatcatgattcataattgtgtgaaacagaccatgttttgggrtcakgaatgttttaatgatttttgctgaattcctttacagtgaaataacacagacattgttataagtaaaattgttataaataaattgttttaatacagaatgaatgaatgtgcattaagcacagtttgcatgttaggcacattgctgggcacaggggatacatggatgaacagggagggcaaaagactaggacctttccatcatggaacttaygtggttagaaaacaattcgaccaggaagaaatgggtgaccccatgttgtaataaaccttgtgatgaacagaaagagagtggtgtgagaagagagtacatcggggtatgtggggttactttagctcacacagataagatttaaggtgatatatacaggatgagaagaagccagacatgtgaatatctgggcaaagccttccaggtagaggcaatggcaggtgcaaaggccctggggaggaaaggagcttgggagtttgggaaacggaatgaaacccagtgcagtgctagagagtgatgagttacaaggaggatggaggggatgatgtgggaaagttgtcagaggatgttctaatttgggtgggtgttctttgagcagaacttggcccgatgaagaaagcaaagtggctggcacaaagcagagtctaacttcagtgggacacctcccctatgataacaataccctctgtgtttcaatagggcaatcaactgaggccccgtgtgctccagaatcaataataggagtttagagtctttaaaatcaaaagccctggagctgaaaacaagtagatccccaagtactgagtcacatttgtatgaggaagagaaatcaaaataaattgctgtctttaaaagaattgacttttctactgaagactatcaacagcttaacaggttcaaattcacgtttttggtttctgtgaggagatagtagcttgcagctttccttcttccgcttggggatatgaggagtttactgtgtctggatgaaatgaaagtctgactcgtgagagcaatagagaattgctaggatccactaatcccaacattaaagaagattagatcaattgcatttcctatagggaacgtctttgaggaaggctgatcagttgcaaaaagaattcctgttagacaacatgattgtgtgaaacctttttgtttctcacttctggcaartggtgggatcttctaagaataccaggtaaccggaaatgagctgagaaatcttcctttctggtctgttagttgggtgataaagacatgcagagaaaattggaaaaatcatttggcctgatgtgtagcgagaaatggccatgctgtcaattaagctcccaaactgtcaaatcattggtgggaagaaaggaaatttatttttaagtgctggatgagatttgtctgagtctgcgtggtggacaggagccaacccaggacctggacacagctctgactcgcatggctgtgctcacatccaccggctatactgggaaattgtagagctggtaaactggacaatttgttggatccctttccccgtatttgtttttgtgagtcattccctctcttgggtggtggtggagcactaagagagatcacatggggaccatttctcagtctgtgtagttaagtcacatcccctgcacacccacacaagggctgtaataggaaccaacagacgttcccaattacaagctggtctgcaattccataattactgtgataaattcaactattgcctttgctgcgtgcctttttcatcctgtgtccccaaggcccagttccatgtcttgtgcacagtaggcacttagtgggtgcttgttgggtgaaaatgcgtcattgatcatttgtatttagaaatatacctcatgttcagggatatgggtgagataactcataaactggctgaggtttccagggagaccaaagaatgccactatatgcctgtgaccttgaatcttaaacctggggcacctaaaacttctctctaatcttccrgaaatcttgaccaggtgaaggaagagcctgtgataggggaagaagggaaggaacatagaatgaaggtgatacaaatgaacagaggtagggaaagggcatcagtgcatggccaacagcgaccagaaagaaaaagagaattcgattttgacacatttttcagagccatgtatactaagaaggaaatggtatctggacattccatcaactttaatgtacttaggacacatttctatcatatttgtggcagttttaactctagcccaaccccctccattctgggtaattggtggagatggagctggcacatatcccatgactgtacagtgttgaggtcactaatcatcacatgtaaatatacacagatgtggcctcctactacccccccactaagggtggtggatsacagcaggtcatccagcctctaggcaagagagtaaagtctctatggtggtctgggttgacagaagcagagtggttgagtacaagtcactgacaggatgtgggggtgggatacaatggtgaagagagtgattcaagacaggcagtctgtgatcctgagataaaggaaagcattgataagcaggtgtcatttacaacccacttctgttactcaaaattatgttttccagcttgagtatggtgtcgcacacctgtaatcccagcactttgaaaggccaaagtgggagtatcacttgaggccaggaggtccagkctgccatgagccatgatcacatcactgcaacccagcctgggcaacagagcaagagcgtgtctcttaaaaaattgttctgtcaaatctgcccaccttcatggatatagagatgatgtatatcatgtaaatcaatgttgtttgatgcgtgtgtgtgtgtctgtgttgccaattacataagtagtatgtacttactagataatttggggaaaaaccctaaaaatgtaaaaaagaaaacatgtttttcaccgttccaaaatagcttgcttctttctttctttcctttcttcctttcctcgtttcctcctttatttctttctctttctttctctcttctctctccctccctctctttctctctctctctttctttctttctatctctccctctcccccctttttctctttctgtttctctctttctttctttctttctttcttcctctctctctctctctctctttctttctttctctctttctctcgacagagtcacattctgtcacctaggctggagtgcagtggtgygatcttggctcactgcaacctctacctcccagattgaagctattcttatgcctcctgtgtagctgggattacaggtgcatgccaccatgcccagctcatttttgtatttttagtaaaaatggggtttctccatgttggccaggctggtctcaaactcccaacctcaggggatccacccaacttggcttcccaaagtgctgagattacaggaatgagccactgcacctgtcctatgcttcatatttcattgtttttccatacagttatttcataagctcatctgtttttatatagctgtgattattctgtttgtactactgtgtaacctacttttttcatatgacatggaagcataagaattttcctgtgatgatgttggatttccatagacatcactttagtgcttaggtaacactccaatgtgtggatttgccaaaaatgggatattcaaacagagaacatattcatgaaatgcataactcaaagacagggttgagctaatgggatgtccattaatcaagcatattgcccagaagaaaggctttgatcttatgtgaattgtctaagtactttttgctatccgttggatagaccagtgtttcctttctttcttttcttttttcttttttttttggagacagagtttcactcttgtcacccaggcttgagtacaacggcatgatattggctcactgcagcccccgcctcctgggttcaagtgattcttatgcctcagcctcctgagtatctggaactacaggtgcctgccaccatgcctggctaatttttgtatttttagtagagacagggtttcgccatgctggccaagctggtcttgaactcctgacctcaggtgttcacccgccacagcctccgaaagtgctgggattataggtgtgagccaccatacccggcctcctttctttttaaaggtatttttctggtttgcctgggtgtcctttgaatatgtcttgttcaggtgaatacagcaaggtggctggtacaaaacagtaagtgtagccttggtagagtatacaatagcctttaagatagtttaaattttaatggggtctttacctgatcaaggaccttgcttttagaagtgtctccttttatactacatgtcacataggtaggtagggaagatgttattaatgagccctcatgtaacatttggctctatcaagagaagttcagtgcacaaaatcaggcatggaatagaacccaggtctcctgattcttggctgaggtgttgtctgggtaccttcacttctcccctttggtttcaagcctctgtaattatagaatgaagcaaaaccttgctttctctgagaatttcacatcctcctctcttccattctctagtaagtttttatgactcagtttagatctgatgactaaactctagtctaaagttgtgtatgttataaactcttaaaaatttaagagttggtaatttttacctgtttaatgggtgtacaaatatcaactaattcagaaaatgtcatgnagattaattcaacaattagtatgaagcctttaggatagtgcttagcaaatagtaattactcaataagtgttagttcttgtcatgataactgctataattaaggacactttctgcttttgctgtcatgtactcacagtgtgtccttgggaaagccacttccccttttnaacttcagtttactcatctgaaaaataggagaagagtacagctaatgattgtgaacaaaccttccagtgctaacattctgtggtcttggggtttttntttacagcaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtaagttatcttttcatcccctaggctcttactcagacaaagggcctgcagtcctcaggaatgttagcaggaaaagtaaagtactgttgttctctctctcytttttttttttttttttttgccttgcatccaggtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctaggtgtgtgaatttcatagtgactattgctttcctataaggaattgtaggaaatcttgtttgctcagaggatgggaccagaaaggaacttgtttagctctgtttggccatggcagcatatttcagaggatgctgcatttgaattatcctatgaaagggttaggctttgggtccccacccaaatttcatcttgaattgtaatccccagctgttgagggagagacctgatgggaggtgacgggatcatggggatggtttctccccttctgttcttgtgataatgagtgagttctcatgagatctgacggtttaataaggggctctcattatattattattattataaggggtttaataaggggctcttcccccttcgcttcacttctctcacatgccgccatgtaagacgtgtctgcttcctcttctgccatgattgtaagtttcctggggactccccagccatgtggaactgtgagtcaattaaatctctttcctttataaatttacccaatctcagacagtttatttttttgagatggagtctagctctgctgcccaggcttgagtgcagtgttatgatcttggcttactgcggcctctgcctcctgggttcaagcaattctcccacctcagcctccccagtagctgggattataggtgcccaccaccatgcctggctaatttttgtgtagagatggggtttcgccatgttggccagactgatatcaaactcctgacctcaagtgatcctcgggcagttctttatagcagcgtgagagtagactaatacatcctaattcactcccctccatccccagttcacatctttcatttgtcttaaacttggaaaaagctgctgaaaaaaatatgatcacatattcagatactggtcttgactctgtagaatgtaaattaatagatatattgcttagaatattgaaaacatttaaaaataaagctgtccacagttaatttaaaccagctcatagacctttattcagcatctacatatccatcctccatcccacaaagaacagcagtcatttatttgctagatgtaagagtgaaaataatgatgactgcacgatgatttatgccaatattctgctaataggaatagtctgaaaagtatatgctgatttaaaattaatcgaatcatattttaaatgtgactacccattaagccaaatagtttgtaaagaaggaaattcttgtgatttttttaaccgtttygtaaatttatgtttttacataaaaggtgttttttttttttaaatcaaggaagagctatgttttctatcatctgcttttctctagcacttggactgtattgggtagcctggctagagttgaaatttcatggaacatagtaaagcattatttttgtctttaaaggaaagtgttgtattaactgtttggttatcataaatgagttttgactgtaactatcttgttgaatatcaygaaattcagatcactaattcccccttggcactcccatataagtgggtttgtcccaaattagggaaggttaagacaaacgtgaatctctggaggaaaactgagaggggaaaaatatgtataatttttaaaaaatttcaatagctcaggggtacaagtgatttttggttatatggacgaattatatagtggtgaagtctgggcctttagtgtacctgtcacctaaatagtgtacattgtaggtaattttccatcactcatctccctcccatcctctccctttctgagtctccagtgtccattataccacttgtgtgctttttcatacccataggttagctttcatttagaagtgagaatatgtagtattagattttccattcttgaaaaacccatcccccagttcacatctttcatttatctcaaacttagaaaaagctgctaaaaaaataagatcacatattcagatactggtcttgacactgtggaatgtaaattaatagctatattgcttagagtcttgaaaacattttaaaaataaacctgtcggtccacagttaatttaaatcagcccataaacctttattcagcatctacatacccatcctccatctcacaaagaacaacagtcatttatttgctagatgactatcatatatttagaatgatggcctccagtttcatccaagttgctgcaaaagacattgcatcattcttttttatggctgagtagtattccacaatgtatatataccacattttctttatgcaatcatcagttgatgggctcataggttgattccatatctttgcaattgtgagttgtgctctgataaacatatgtgtgcaagtgtctttttgatataataacttcttttcctttgggtagatacccagtagtgaaattgctggatcaaatggtagatctacttttagttgtttgagaaatctcccccctgggaaaacagttatattaaagtcaactaactttmttatatttttccagagacaaaaataactttatctcttaaagcaaattgtaaactgaaaccaatttgtggacaccaactccaagcccattgtcttattcttccactgtcttcatttatatgtaatgttggcatccagtgaaactttcatgtttcrttctcttcagtgaaatattgactaacaggattttggacactgccttacattcagagcgctatggatttactgttttcatttttgataatccatttaagctgttaaaatgcttgccactctctggatttgattttgcactcgttgcttcaatttttgtaacctttgttggagtaatgtggaccctgacaaatacacacctcattatgttccttttgtccctccgtctgacatggattcagatactcgtattttaataagagagcctcactatgccaggaacaatgcaaccagctgatattgacaacacatgcagaatcttaataattcttaagtggacattcactctttagtcactcctagtcatgtttcccctcattccctttcagactctttggcaggaatcctttgtcctggaggttaagaaagggttagaggaagtgagttcatggatcaaaatggaaagaaattgtttcttttcacacaaaaaagtcttgtatctctttagtgagctaragagaactctttttccaattcaatcagagagaaaaaaatatcaattggcttgtcttatgaaaatgggtcgtgaatattgaatctggcctcaacccagtttctctagatttttatcttgcttgcatttgtaaaacayttccataaaaatgtcaagtattttgctaaatttagcaaaacctctctttccccacacttttcctgctgcatttttaaaagtaaaataaattgtaaccagaggaaactattttcaaagctgtttttacccagtaggcttaatatttttcctagtcactaaattacatccctatttgattgactgtgcacccccttatttacggtcattatctacagattttgaaagtcataatgaaccagctaagctacatttttccattcactggcttagtcatctggaagagccaaaacattcaaaatctgattttattgctgttcattatttcctattttctctcctccacaaactccattaactcacatcagaagcacttgcaggtaatgcctctaagcttttgtgtaaaaatgtaaccagtggctcttcaaggacagagatggcatctcctgtaatatttctatctagttaattctgaagagtttccaaacaagttggattctttgatccaaagaaatgctgacctggtatctcctcgattgcagttccttcatggacaaatgttgaatctgttttaagccattagaagatgtaatagagagttatctaaactatttctgggtcactccttagacactatagatgttgctttaacgatgtttctttgttctggagcatgtgtgtgcattcacgtgtgtggtatcttagaatagcaacccttcagggcactgataggtacttaatttactaaaacaagactactgcagcagagtcctttgatccgtgctgtgctcacaagttaaggaacagatgtggtcaattccaagtggggagacatgtgggaacagttgcttcatcagtttccacttgattttctgactagcgtgttagtgacaaggatgcacctaccaaaaaaagttcactgcaggtttacagattcttacatgcacataggataattcagttatggtcccttctaatgtttaaaaataatgttttcacagcctgcagagaaatagacgttaccagattaataaatgtgctttttcaaaaaccagcacgcccttttcagaaccatggacagcgtattgttgccccagtatttctggctttaatcctggaatcacacagctattccactcagtatattgtctgtatattgtgtgcctcacacacgaacaaacactttcatgtatatgcttatttgctcatcataatgatcctcctccaataagacacactacgcaactcggagaattattttatctctattcttgaatatgaagtacttataaatctcctaatcatttatttatctaatttcctttttggatacaactcagtattaaattgctattatttcagggacataatattgtttattactcaagctaaagttaaaataaatttcagttgcagtttcattgatttcttggagcgcatcttgtgttacttaagtaagttgtgttacctgttgctttttaatatatttgcactatcaaatgcattagaaagcattcctcccagcttttaaattatccaatatagctaaagttaagttcggacatattagtttcttgttatacattaaactcattaaattggaatttgtggtgacctctagctgtgttaagtagtcatactctaataagaaggtggcctgctatcaacctagctctttattattataagtagcttcactaggaaaacaattttaaaataataatatgtttactattcaagaagtattattggacttattttaaccctcagaaaatatttgcttatgaggaaaagggttttaagttcattggtgtctataggcaatttcttccccatgatacattcaggtggagatgtattcatttttaaaatttattttctgttgattttatagcaaatctataccataaataaaatggctgcagtcagctaattttcatatcctcaatcaagttgaatagtaatcttattttacataatatttcttacctttctagagtgttacaaggcttagagccttatgacttggcctgcccttctaagacatccacctactgcctaagttacatgcaaatgagctgatgaaaactacttttagtggaaataaccatctatccatctactattttattgcctctaccctttaagtgatgcttttttattgaattatcatgtgaagataatatcctcaattgactttcaattgcatttaaggctgctaccaacatcaacaagattaataaagctgtaggaatctcatctatctgaggcaaaaggtgaaatggagagtgtggtagattataactttccaatatttctgtcacccatgattttataattcttttccaacaggttataattctccctttatttttggaattccctgcatatcatctttctagcatgaaaaaataaaaataaaaaccataacaatttgcaggagcctatggtttactatttgggtctagtcttttttcttcctagctttagccccctggatggttctataattacaaaggaaactatggcctgtttatttgcattctaacttgctccctctttcttatcactcttttttcttctgattatccttgacctaatttgtaaaatgtcctatgctcttctctatttttattatattatatgcaatcttatacttcaaatattttgtagaataaagaatgatttaaaatgatgaataaaaaatgtctggctggccaggagcagtggctcacgcctgtaatcccagcactttgggaggccgaggtgggcagatcacctgaggtcaggagtttgagaccagcctgggcaacatggcgaaaccccgtctcaactaaaaatacaaaaattagccaggcatggtggcacatgcctgtagtcccagctactcggaaggctgaggcaggagaattgcttgaacctggggggcggaggttgcagcaagtcgaaattgtgccactgcactccagcctgggtgacacagagagtgaagctacatctaaaaaataaaaataaaaataaaaaatgattagcttcttttgaaggatcagattcaaattagagaaaatatttttggcgagcctgcaaatggatgtctgggcttcctgctggaagtgaggaagagataactaaccacgtttccattcctttatctgtttatttgcagaaccattcagcgcctctgtctgggtgatgatgtttgtgatgctgctcattgtttctgccatagctgtttttgtctttgaatacttcagccctgttggatacaacagaaacttagccaaagggaaaggtaagggtaccttcatgagcatgattcaatgttgttgcaatttcatttacctttaatgaaaatttcagttttagaacacattactctagaccaggcatggtggctcacgcctgtaatcccagcactttgggagaccgaggtgggtggatcatgaggtcaggagttcagaaccagcctgaccaatatggtgaaacccatctctactaaaaatacaaaaattagctgggcatggtggcacacacctgtaataccagctactcatgaggcagaggcaggagaatcgcttaaaaccaggaggcagaggttgcaktgagtcgagattgtgccactgcactccagcctgagggacagagcgagactcaatcacacacacacaaagaatacattatactgcgttggtgtaccatygtatgaatggttttgggtcactgatattgcttgtaataccagaaaagtatggtttatgtacttcaactgatggataaaacaaaatgaaatattttaatcttgtcataacctgaagtcaatagttgttaggtgaaaaccactgatgttcaatttgttgggaaagcagatttgaaggaacttttctgacaattaatttaaaaaatgcttgtcaaatgctaaaattgtcatgggtttcaacttcagtctatgcaaagaaaatgactttataaaatctagtttaagaacattcctcaaactactgaatcaatttacattagtttgacaataaatataactatgaagtgatatatttccccatagggttatattttcctgttggtgatgccaggaggaaatcaagtgtgctaaaataaaatgcattgatcttagtgcattgtagttgataaagggacaatcagtagataggaaataaaattgggaggcattcgttagctataactcattaaaaggatcccactctagccagggtttatgtcatacacgttatgccattttgagtgggctttcctcagtgggcactaccttctmaatgggtgttatcagaaaagtgtcaggaccaaatctctttcccaaaaaatgacttgatatggtagaggatggaacttgaagtctcatatcccccaaaaagcagagcactttaatgtgatggatacatattcttttcacttagatgttttaatattggaaatactcaacaggtcatgggaatctattaggaacctagttttattgaaatctttcaacttcttcctcaccattgaagagtggtgattaccacataaaccatcttcaatcaaccagatactaaacaatgccataaataatgatgttgtgtttaatgggagattgcaagccttcatttaaagggtaatttaacctctaagaagatttccaacagggtggaatctgagacagtttctgtgagtgaccacactgtgatacagtagttccttatatttgcataatcagggcttgtgctgttgtgaatttacacattttctgatgaatatttatcaaatgggtactacgtgccaggaggcactatactgctgccagagataatgtggtaaatcaaatagagattttctatcaggcagtttagaatttagttgtgaaaataacatgtagacacacaaactaataatmacagattataataaatatcaagaagaagaaaaaaacatagtgacatgatagtgatggggtgcagacactacgttagataagatggtccaatgggaaaggatgttcattgagctaggacctgaagggtgacatacaattttatctgtcaaaaacagttacagtcatttcatgtaaaaggaacagcaaacagaaaggctgaaataatcttgagatgctcaagaaacagaaaaaggctgagggggtgcagtggctcatacttgtgatgtcaaggctttttgaggccaaggcaggagaattgcctgaggtcaggagtttgagaccagcctgggtaacatagcaagacctcatctctacaataaataaataaataaataaataaataaataaataaataaataaataaaataagcctggcgtgatgatgcgtgcctgtattcccggctactcagaaggctgaggtaggagaattacttgagcccaggaggtttaggttgcagtgagctatgatcacaccactgcactgcctagtcagcagagcaagaccctgtctctattaaaaaataaaataaaaagatgtgagtgaatgaggtagacaatagtataagatgaaatcagagagataggcaattgaccatgggaagcatgtcagactttcttcaaaatacaatggagggaggccaggcacggtggctcatgcctgtaatcccagcactttgggaggctgaggtgggcagatcacttgaggtcaggagtttgagaccagcctggccaatatggcaaaaccgcatccctactaaaaatacaaaaattagctgggcgtggtggtatgctcctgtagtcccagcagttcgggaggctgacacaggagaatcccttgaacccgggaagtggaggctgcagtgagccgagattgtgccactgcactgcagcctgagtgacagagcaagactccatctcaaaaaaaaaaaaagaaaaagaaaagaaaaaaaaaaaacaatggcagggagacaggtgacatacatgtacagagcaaaaaggtcactggggctactctatccagatagtgtgtggggacaacagttggaagcggggacggggagggcagttaagaaggtgtcacttttccaagagaaaggactgcaatgacttggaacttgtcaagaacaacgaaaatacagataatcaggtaaatctgagttacattttggaaggtaaaaaccacccacagcccatccttgcaatacgttctcctttgcctgaagcatgctggaaagactattgtaaaggatggcatcagttgtgcaaactcctcagcccttccattctctccaggctctctgtttccagctcatctgctgtggcaactcttgggaaatgacagctacttgtttctttgtacaaaatggttttctgttacatttcgctgcactttatgggaaaagttatatggcccagtcatagtattcatgaatcaggaattcctagaagtcttggaccgatccttctgaactgcctacatctgattcctaaatagctgtcatttctgatcagtgtgcatccctaaaaaaactaaatcgttcataaagttgactggattaactctaagttttccccaagaatttcctgcctcttgagaataagcccagaagatcacaaaactagccaaatagaaacaggagagattgagaataagagaattaactgctttctctttaatgggttgtgtcatggatattataagtacagctgtagcctgggtttggcctccaatgtgcagagagcttgcttttcctaggcttcctgcccagcacttcataacttccattaatgtgaatttgcttctgccactttatttattgcccactctgcttatattggcaggtgacatctgagtagatcattttttcatatcttcatttacttaaatgacataaaaattaacctcctgttaaagggaaaccttccctatgaaattagggcatcagttgatttttttttttttttttttttgcccatgcagaacaaagacttgaaaaccctaatatgtgtgttttacagcctgcatatgccccatcgccataaattttggcatatcattctgtctctttagttaagtctgttgcaaggaacatttaagaatcttaaaagggctgcatagctattgcgaggatatactggaaaaagtgctgtgatatgacatcagtgttcattttccatgaccctgcaatgaaatgtcttccatctgtgaagtgttggaagaattaagatctattgttccattccttaatgtctccatttggagagggttttagtttggtttaattcttatgttgtacacactttacatctgagtttgaacaggagcaattgctagggacaatcggattagaataccaaacatcagtcccgctgaattgcatggttcttatacgatagcacatccgatgaatttggaagcagtccccatgcacacatttttgtcaggctctctttatgtttattaagaaggctggtttcctcaaatgggaatcaaatccaaatttaaaacaggtcataacactacttattcaaacccccattttgcataaccattttcgtttcctttctttttttaaagaaatgtggcaaaaatccagttagatagaaatgtgagaagaatgctaatttttaaagaaaaaaataagttattgtggttctagggcaatcacaggacacaactatgatataattccatcttctggcaaccttcggtgctgctggtggctgctgcgtggttgtcatacacaaacaggcatttttttcagaaaatgctgagaatgtccttttcatcttctgcagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaaggtaaggtcaccttgctttcctctccatctgagggttggtcttaactgctctcctttcaggaggaagagattcaggtgcctctcattgagatccatcaactygaatgcacaaaagccagaaggttttttctctttaactcaaattgtcctctttctcaaagtttttgaaacagaacattaaggttagctctcctagacctaaaagattccagatctaatttggaagcctggcttccccgagtggtcgtgtttcctatttatatgatctttctgatggtgcttgtgaatgacctatgactcaagtgcttaggttgaaattcatcctttcgaatgtgtgatgttaaggaaggcccattttcctggatgagaagaaattggggtgaaggagcactgtaggctgtgggtacctcatctatgacctgaaaaaaagtcatctttaagccctacccagagacaaaattatctgacagctcctcttttccatacagccaaatcagtctcagcatcagcgcttctgactcacctgaaatgtcttcaaggcacacaaaaggagcagagagtttttttctttctttctttctgtttttttaatttcccactggttctttctactcagatatatcactaatcttcccttatagggctgtacttcccacatcagtaagrcaggagtaaaaacacctgctctctcattctccagtgaaatgaaatataacaagggttgcagggtttgagtagctattcagaaacacacattgaggaagaaaagaggtaaacygggtgcatcctcctattgagactttagttcaggaaacatcctgacttgctaagctcagcaagtgttgagattgcagcaccacaaagattttctgttctgtgtgtggggataatttgtctctcgttataaaacctcgctaacatatctttttgacataagtctacatatatccttttgccattcatcaacaaactgctgaatagaaaatcaatccatggaaagcttttacagcttatccatgatacacactgtggttgaaagaatcttgtcaagagagctgatgaggggttggggttaaagatggagtcatttccacaaaggcatgagagtgcctcacctctctctgatggcttccgattgaggcttgagtaagggtcactttacttaccatggcacacaaagccctgtgttatctcacctgctcccacgtttccttcctcttgctccatccctgtcactaagtttatttcagctcagtgtccttgtgcctcttaggccctctgcctagaatgttcttccccaatcttctcatggttggctcctcctggaatttctggccttagggaagacattacctcctcagggaagtctttcctggctactgtaataaacttggcagaatgagctcaggctcccaagaaacttaaattctagtaggaaaaaaataagcaatacacaagtaaacatcaaggaagaaacaaatttggaaatttggggcaggaataagtattataaagaagataaagctgatgagactaaaattgtctgggggaagaggccctcagggatgtagttttgatagagttattttgcactttggaggtgctcaggacactcttgctgggtgaatgaatacatgcatggtatactggacactgtgcataccccacctggatctcctgggatcccttttgcagcgctgtgtgcccagccccacctttctgtgctttgctgacaaagcctcacttcagggatcctcagcagatttttgcctttgggcactggaatggtaaatgcctggcaatttaagttccctcaatctttgtggtcacctgtaaccaaagactaatctgtgtgagaatacaaaggctaagctgctcccttgcttcgaagcaggaaaaactttaaggtacgaatcactctctggagctccctgcaggacgggactgagatggagacttggccttaaatcagacccttgatttctcccccttctccagtctttcctaactttatcctgctcccctgctgacttctcctggaacccttcactagtaaatcatgctcacccccaaatccttcacttggggtcagctactgtaagatccccgcctaaagcgggtggtatctcagaggcagcagataacacactgtgtttagagtcagaaaagttgtgtttcctctctgcctgtttcctctctgccactcgccagccagccgtataatgtttttaaagccatgtcacctcacggtgcctgctttgtctgctttgtaaatttgggagtcacaattgcagtaaggatgaaagaaagccacatatgtaaatgtatcttgtagcatatgaatccctctgcagacatgaagcgctattgtgcaagtctgtcrcattatgggatcaaaagtgcaattcctagaagtgattggaggtatggtggaagcagcaggaagcaatgtcctggaagagaggatttttcaagaaagtggttggcagcatattttgctttttgttgctatgttcaaaggcaagggcggggggaaatccttactacatagttttgggtctaaataacatgaccacttgtgggaaaactaattaaaaccactaataatttgactgaccttcactgacttggaaacacccagtaacagataccatatcctcaagagacaaagctcagtctccatgctgaaaacattagaggcaagctgatagctcttttaattaaatgtttgatacaatgagataaacagcaaaattcctggagtaaataacctatatgctcccagaagattaatagaagatacaccaagaaagtctgcaaaaaaaaatcaatattgaatcaatttattgtacactgtggttggttttgtttttgttttttgtttttgtttttttgttgtttgtttatcatgaatacctgtgtaacaactcaggtttacaatgcttttaagccattagtgcttgctgtgaaataatcatattggagcccatggtgtgctcagatgagctgggacttaaattataaataggtgaattcatgggtaagatgcttccctaggaattattaagagaaaattgcaatgttgatagggatgctttccaaaatgttgggaatcactctgacagaggaaatccatctctgggaggcagatttatgttgtgggaagagcaatatcatgtttggggtcaaatggacctgggttcaaatcctggccttgccatatgattggccttctgtatgtcagtatccccttaggcttaatttcctataaaagagaagacattatctcctttctggcaaggttgataggaggattagaaataatcctcacaccatgcctggcacatggtagatgatcctgtaatgtgttatttccttcttctaccctcctcctttccactcccccctctcattcctccccctctccttctctttgtctcccttctcctcctactccttccatcatcttcatcatcgcctgactcaaaccattcttggcttctggggcctgaaatgttattgcactgagttggtcttttgtgacaaccaatggagggaattgaggcaactgctctcagtggatgagcccaggaatgtgttctcaaggagccatgctgtctctgggcactgtgctgctgctgctgagtggtcccagttcaggcagccaggcctcctcccagctgatcctctctctgctcaaggacacacctgcttgctgctcacatcaagaagcacgtgggacttcaccaacagaagactgtactagaaataggggctccagttgccagatgtcccttatttacaggcacagaagacagatagatatttttaataaatgggtagtttttggttcacaaaaaaagaaaaaatatcttggttaattgctgcatttttctggaaattttatctccaagtgttgcatctctacctcctccatcatcaaatrcttgccatgttttagtcacttggatgaccttcagacatgcctccatattggatggaaaaaaaattagaaaataatcctctgttctccaaactgtaaggagacaggcttcattgtttggctgaaatgtcgtgggtaacaacaggtgatctatcccaagcattagaggatgccaggtgttctttcaaacactataagatttgttgcaaaagcaatctccaatttacagatagagaaattcaggctcaggagcttaactggttgctccaaatggcgcagtttctaagcagcagatgagaacctgaacttgtctcctgtaagtccaaagccaggtgaaaccagttaacctacacagcaagggaaccctgcagagaagccaggggagttcctctgactccagatattgtgattacattgttctgtggtcttgctgacaatggagacctctgtcctaccccttcctttgctaaagcccatattggattctttctgcttgcacgtggaactctctgggagaaagtcttgctaggaatcattctcgcagcaagcacggagtgtgtcctggatgtagaccctgggacttaatagatgagccatccttgccccctcactgtttttcacgctgtaggtcatgactctttagtgagccatgaaattaatctaaggattgcagacatttttttaaaaaaatagaacataatggataacctcagagtatatcacagatagaaagaatgagtgctgtgaaatttcacacatgtgcatggagtggtgatgggaaacgtattgtgagtcatgctttaaaaagtttgacagtcttcagtctagtggaaaaggttcctggagcttggtgtcaggctgaattttgtgtgggtgatggtactatccaggccagagaagcacggaaaccatcacagagactgaatatctatctctgttactgtgcaacccagacacagggaagaaagtgaatttttaaagacctatgcagctcctctgcaacagacggggagtgaagtggaaggcatttagtcaaataggccatctccggatatctctggagattgggaatggctgctacaaggagatttatgaacagcactattacctctctcctcccgagcaggcggctgccatgaggatgagcctgggcttggccttttgagcttttggtgattagttaaggcactgcttggtggagtgactgcaaaaagcattttgctgttcacatacacacacatgcacacgtggacgcacatactcccagggcaaggcacaccctggcaggaggatctcatttggaaaatggatggccacttctcccaaatccagttatgactgcatattaggcagcagcatgcctaatttagggaaaacgattttcaactggaaattttaattaacagtgaagtgaagtgtgagtctggaaaaaagaataatgtttctagctggtttgactcttgggtaaatttggacacttaccctggcggttcttagttctgtggaagacacactggtctggaagttggagagactgctgcattgtggtcctggttctgacactgattttctgggtgctcttcccctcctggggtctttaaatctttatgtctagatgaggagagagtcaatagcaatggtctctgaggaatgatagagttaagacctcagcctgtggtcagacgcatccgggtttgaattctgggccactgcttggtagttgcataatcttaaatagatcacatagcctctctgagcctcagttttcttatctgcaagaagcagcctctaagattaactacctggcatgggtttgtaaggattaaatgacctgacgtttgtaaagttcttggcatagtgctggacccaactaggttcccaaaaagtgttagtcattgttgttattactttctagttccagaattcaatgtttcatagaaaaatgaggttcaggttcctttttcactcataatgataataacagacggtaatcatagctttatttttgaatgctttctctggtccaggcactattccagttacttgacaaatgtatgttgagatcttcatggtggccccccactctacagatggaaaataaatggaggcagcatgaagtgaatgtgttatctagggttccatagcttgtatgtgatagaacccaattttccaaccagccagttcgagctcctgcttataaccacagcccgccaccatctctagtgtttagctgtatttctggaactcagatccagttctattgattcgactctcattgagtcacctgaaacatcgaagctgtggacagacagaatcatccaatccatcagagaagactggtgatgcatggactacaggcctttatggggggcttgagtgccgagtgctgcgtatccctgatagctaaagatcaacagggactctggctcaacaagtattcatggagcctgccatgcactggcaattatgcctggggaatgttaggcactagataaatagtgcctgcaggagtgaatgaatgactgagtgagtggagaatgaatgagtggtaatatatagtcattttctgggtgaggtgaaggtaattataaatggagtttagagaagggagtgattggtggagatcacagaaaatttcatcataaagtggataaatggactggactaaggtagtaccttaagttcagctcattcagcatttctaagtactgactgtgtgcctaacactgtgctagtctctgtaatggcactgaaaagttcaactcaacaaatacctatggagcacccagccgggctctgtgctaggatctgagcagtagtacagaagaaaacagatgctgtgtccaccctcctggagctcacagactggctgaagatgtgactaagtagaaagaaagaccaaaaagcaacattttattgtcatcctgccctaatgcatgcatttacctcctaacaccagacaaaatgatcactaatttattatttgttctctcctccccctcctcccttctctttcttttyctactctctctcttcctttctcgttctctctccagtttcagagacctcatgactattccccaccttttcgatttgggacagtgcctaatggaagcacggagagaaacattcgsaataactatccctacatgcatcagtacatgaccaaatttaatcagaaaggagtagaggacgccttggtcagcctgaaaacggggtaaggatggcagtttccttttcaccacaggtctgcgagcgataaaccttacagaaattgactctcggcatgcctcagttcctatctgctcccattgtatttctggagagtgactgtggtccagatgggccccagttgagggcagtttttgttaatctaatgagcatcccaggtttccttctgagttgggtgaagaaaaagcaaatccaggatgctttgaaatgcacagaaacagaggggtttcttaaactgataaagaagtttgtccaactccataggatattttaacaaatagaaagatccaagaaggccaagagtttaaagtagtgaaaacaaagatttttatcagattttaggtaggaggttttctgagtgtggggaggagtagcttgctagtaggagctttatgaaaaaactaattgtataacattgatgaaagagaaagaaaagatggsagaaaagcaatgagaactcaaatcattcaagttacagttagcattcctctctgtctgttggcattgtggagtgtaacacagactccatagctgaagatgtaaagaaaagatagcacaggggttaggagtttaggctttggagagagagtttctcatacctcatagcctcatatctaacatgggaataataataggacctaagagagaaaatctgatggaaagccttttggatgggaaatagacagtacctaaatgtgagtgttgttatttattgtaaaggttagattctattccatggactcttctgaaaagtccattgttctgtggtcttgctgacaatggagacgtctgtcctaccccttcctttgctaaagcccacattggtttctttctgcttgcatgtggaactctctgggagaaagtcttgctaggaatcattctcgtaggaagcacggagtgtgtcctggatgtagacccaggaatgcatgaaatccattttagaaaggattaaatccaataaaaatgattttattttaaatgacagagttgtttaatgaggggattttgattatccagaaaattagctcatatggggcatttcagttgtcacagattcctgcatggaaacatgactgtaggtgcattctccttgnggcttaataaataacctccttttcggctgttcggcaagcccattgtgaaggccttgctgctggctttgtgtctggtagggggagacagaggcccctctaaagcatcaaagcccagatttctgcatagaaatcccggtagttttggctgtgagcattctgtcctttcagtctgtgcctttggaatgtctttggcatctcagcaggggctgggagagcatttattcagaagttaagtctatgatttctgaaaaactcattcccacagtgctcattctggtttggaatgatttctttaaacttttgaagtataacaaaaatgcagaaaattcacaaatattaaatatgctgctttatggcttcgtacaaactgatcatccaggtcatcactccctggaaccccgccccacaccctcttccagtcaatatcttccacccgccacctgcacttctaaagccgtagattcttggtgcctgctgttttaacatagaaataaagccacactcttttcttttttgtcgtctttggctcaacattgtgtttgcaagattgttgcatgtaatttcagtgctttcattctcattgctggaatgcascacacatggatgtctctgtcctaatcttgatggacatttgggtaatgtcctattttggggccattatgaataatgcttcttttgttaatgagtgagcgcatttctgttggtatacaccgaagactgcaactgctgagccatagaatatttgtgtcttccactttcacagatacctgaaaagaccaattgttgatgactttacagtttagccatgggtttgggatttttgtttgtttccattgtggtcttttaatcaacatatactgttgttttggacagaccatgmgcacaaaygcagatgataatggttggagacagtggttratgcctagctggctttctctccctccatttattaaccagagcacaaaatgggttgttttctttctttttcaatcttttttytaatataatagcaaaaaggagagaaatggaaaccattcgtggccataaattgtacaaattggtttctggaagccatataataattataacatccatcttagaaaacgtgggcagatggcagattcattctatactcaatctcccatgtgggggatgctttgcattgttactttaaactcagaaactagagctgaaggagtacaagtctttttttttttttttttttttttttttgagacggagtttcgctcttgttgctcatgctggagtgcaatggtgcagtctctccccgctgcaacctccacctcccaggttcaaacgattctcaacacactcagctaatttttgtgtttttgtagagacagggtttcaccatgttgactaggcacatcttgaacttctgagctcaggtgatcctcctgccttggccttccaaagtgctgggattacagtcatgagccactgcacccagccacaagtcattttttaaaaaataattcaatatactcttagggatgaaagcacagcagttatcattactggagatttaatttcattggagttaatatttggggaaaccacatacatgtttaacaggctccttgattaattatttaaatttttttttttttttcagacagggtctcactctrtcacccaggttggagtacagtagtgtaatcatagcttattgcagcctggacttccctgggctcaggtaatcatcccacctcagcctcctgagtagctgggactacaggcaagcaccaccacacctggctaatgtttgtgtttcgtgtggagatgaggttttgccgtgttacccaggctgatttcaaattcagaaggctcaagccattctcctgcctcagcctctcaaagtgctgggattacaggagtgagtcactatgcccagcctaaattaaattttgaatagataagatatttatatacgtcaaaaataaaaaagtacataaaaagaaaaaaacagtgaaaagttttccctgcacactattcctcatctagtacccctccatggtaaccacatttactctgtgtatccttccaatatgttcttctgaatctttctatattaatgcataaaaagccataaagttattttttatagagtcataatctttcattatgcaaatataccatattttatttggtcaggcctctattgttggacatttaggttgtttccaatctttygctattgcaaacaaagctgtagtgaatatctttgtattgcgtcacattcagtgtagaataaatttcttgaaagagtgggtcacagttgcaattttaacagatattgccaaatctccctccaaaggaaattcatacttaccccatcagtgcatgaragagcttatttctccaaagttttgccaatacaatgtgtaattaatctttcaaaattttgctaataggtaaaaagtatgctgagatataaatttgcacttttctcagtaaattttggccatatttatatacttaagagccatcggcaattccttttttacttttattaatatttctattggtttgttggtctttttcttattaatttatatattggacagatgagccttttgtgatgtgattacaaatattttccctatttcttttttagtcttttgagcttgcttttttttttccatgcagattttatcttttttgtagtgaaatatatcaaccatttgcttatggctgttgaattttgagacgtaattcaaaagtctttcatcattctttattacaagataattacctcgtgttttcttcttttttggttgcattttttaatatttggaatttttcttggtgggtggtatgagacatgacttcaactcctcagatgattatgaaaaccagaatatgagaattaccaccacagagctacaccaagatccgatcaactttgtgttgattgtgtcttctcaacgtcccaccacgagactgcggtctttcaggtgtccacgtcaccacactcacaggccttttccttccttttcacatctcctgtttcctttttaaaattttcattatgaaatatattgctgtttaaggaataataataatacaatgaaatcttcttgtacctaccaccgagccttaaaaaaaaaaagtcattctcgtcctttaccacgaccagcatctgtagaaggttccatccctctggaaggttgaagaaggtaacctcatctgctcccgaattgctcagcttttgaacattcccccaacaccctagaatccagcaagccttgacttagaacatccagagcatgtggctcagctgctgggtctcactgctccacccacacgtttcagtaacatctgctgcctagcaaagccacgtgcatgcacaccagggtcagtgaaattgtgggttgtaattttctgggagagtcctgaacaccagacaggctttggattactgtcaagtgacagtcccagctgggtttgagtctggactcgagcattagctagctgtgtcctgggacaagtcatgtcacctctccaagtcactttctagtttccccatctaagaagtgaaatggttgaattctttgatctctaaactagttcatgagattcttttatctgtgtcaaacacttangaagactcagacaaaccacatatncaaacaactgtcagttttgcagaaaggatttagaatcatgccccaaaattgggtgcctccaagcctggccaatggaccaactgtacctgaatcacatgattacctgtcaaaatgcagattcctgggcccaggacaaggctttctctctagctatggagcctgtgaatctttattataataagcatcattccccgcagcacgccacaccacgtgattttgagacacacgaatatttgagaactactgttttagaagtccaacacactattcattgtgcaacagagctgagaactactattttaaaggagttgaagaaacacattttattgggataggcatatacagagtagacaagccaaatgcttgtctttggaatccctaattttttgaagaaaggcataggcagagaaaaacttgaaagctaagttttactgtttattgaaattcataataaatggagataaagaaattatcagacaaatcagtgagaaaaaagggtttgatgtgtaaacatcaacagagatgggatttttcaggcacagatctgttgtgccttgtgggactcctgtgaaccaaaggtggatgagcgtcagtgaccccaggtttctaggctaatgcttctcaagcatagcctgagtctgaatcagaataggtgctaataaaaatgtagattgctgagccccactgagccagttgaatcagaatctctgtaaggaggggtctgaagatctgcatggtttaacaagctcttcaggtgactccgatatgccctaatcaaattttaagaacatccactctagaagagggagctgaagctgaaatgagtggagacagatttagatttacaaatgctcagtcatcagaagctgatgtcctccaagccattttggcatgggggcaaaactgcaagcgtcgcacatatgccagatttaaattaaacaacgtccctagaactccgaagagcctaatatttcaagacacagtgggatagtttgtgtttttcttttaattgaytttcatgtacaagtctgggtgtatacatttatggaaaagtcccaatttccttagaagcctcagttttcagctctcaggatccccagtcccctgtgcgatttcattctcagcacaatgttaaaaaacaggtctctgttggtttcctttacatgcagtagttagaagaattggaagagaggattgtcttttttcccagtattttttattgtgataaaatatgcatagagtaaaatttgccatcttcacatttttaagtgtatagttcagtggtattaaatgcattcatcgtgtggtacaaccattaccaccatctgtctccaaagctctttatcttgtaaaactgcaactctctatccactaaacaaaaactcctcaacccccttttccctagcgcctggcaaccaccattctactttttgtctttatgattttgactgctctaagtacctcatctaagtggaatcatacggtatttgtctttttgtgactagcttatttcacttaccataatgttcatccatgttttggcatgtgccaaaattttattcctttttaaggctaaacagtatttcatcgtattcaggtaccacattttgctcatccattcatctttcaatggacacttgagttgtctcagcattttaactattttgaatcatgcttctgtgaacgtagatgtgtgaatatatttttgagactttggttttttttgttggtatatatgcagaagtgaaataattggatcatatgtcaattctatttttagttattgagaaacaaccatactgttttccacagtcccatttgcattcccaccaacagtgcacaagggttccaatttctccacatccttgccaatacttgttgttttctgtttttctaatagtagccatcccactgggtatgaggtggtatctcattgcagttttgatttgcatttccctaatgattagtggtatcgagcgctttttacctgcttattgggcaattgtatttattcttttgagaggtggatatgcaagtcttttggccattttacatttgggttgtttgggttttctttttttttttttttttggttgttgttaggttttaagagttctctgtatattctggatatcaatcccttatcagatatacaatttgcaaatattttttcctattccatgggttacctttttatattctagctattacattgatagtgtcttttgatgcacatttwaaaaaaaatttagggagtattgtctttttaccaataaatatttttctaaaaggcttgagttgtcctcagtgacatgtctgtaaaaacaaaagaacagtgtagtcccatctccgtgtatgtgtttgaaatgtcttcatagaaagttttgcattgaaaaacaaatgagcactgaattcctatcctagagcacaggtttgcaaagcctgtgggatttaggaatgtacctttttttttttttttttttgaaacggagtttcgctcttgttgcccgggctggagtgcaatggcacaatctcggctcaccacaacctctgccttccgggttcaagcgattctcctgcctcagccttcccgagtagctgggattacaggtatgcaacaccatgccctgtcaattttgtattttttagtagagatggggtttctccatgttggtcaggctggactcaaattcccgacatcaggtgatccacctgccttggcctcccaaattgctgggactacaggcctgagccaccgcacccgsccaagaaggtacatttttattagtgcttctagtgattcagatgtaggtagtccatgtctttgagaggttagttagttgactattgagaaatggagttctgtagtgactaaacaggacaaggaagagggaggatatttcagaaggagggtgcaggatgggtggagatgtggcaaaatgtgagtttaggtttaggcatattaagttggaagtgcctttggaacaccatcatcatatgtccaggcatctttgcacttaatgtgacctgacaattagtgagctacagacctgagcacttcatatgcctaatctcaattaatcctcacaacacccctacgatctgggtaccattaatatcccttttaagagatgaagaatgtgaagctcaacaatgttaacctaattacccaataggctattcagctaagtaactacattgcagaattagtaagtatagaagttaggcttacttccccacttggaaatgccacctaggcagttggaaatayggggttatggttcaggggagaattkaaaactaaagttagatattacatatgtgcatatattatagagtacatatcatattaattgatgatctgagaactgataaaatcacagcattatcatttctatgctcaaaagaaactggttcagggatattggcattcccaaggcaaaggtaaaccaggagagtataagggttgtcactgaggttcagttgctctgcagagcaaattttttcaaagatgccatttgagcaggttttatttgctgtattttatcagtcaaacagaatcagacacaaatggttcatttccagctgctgaattcgaaagcgggcatagacatcagggttcagtgagctgttctaaatggggtagcgtcatctccagagaaaatcagatcaacaatgacctggtttctgagatccacccccacactgcaaacaaagctcaaaaataattgcttccacatcatagagttagaaagttttttccttaataaaaactcaagtaaacacagacatcttttttttttttgcgggggggtggggttcttggaattatttcctggtaagctctattaaaacaacgttaaaggattttcaaggccacctataaaaactttttttaaagtagaaaaaaatgtctgtggggggcaggagttaaataaagtgagatcataattctttaaactcagagacggaaaaaaaaaaaaaggyaaaaaaaacagactaaaaagaaatatatcaaaatgttatcggagatgctgctaggtgattgggatgatggactttacatctttttacatttaacaaattttcagcaacacagtattacttgcaatagctagaaaaaagtttcttctgactataattctctattttttcctgcatttcattcttgtattgtcaacgcatatatacaattcatacaagttgagtcggtgcatatgcaaatttgttttgcttttctcaattaaagtagacagttctgttgtttagtttccacatttaaggaccaggtgataattncattgagctagaggaatattaattaatttagcttttactgctttgtgttttcatcatgccttaactagcactgaagggtactacaagaaatagttatttttgaaaaggttgctgatacggttattacaggacagcttgtggagaatgtcgtcctgtagcatccctcacacttctgtacgatgaagagcattgctttgttctgtttgasgcacgctttgatcttgttgacaacacaattcttataacaacttatggttttctttttgcttggattaccgcacaattcagagcttaatgcatgattcttctttcacaattgtggagcctttggcctgaaaatctgtttactgactttccctaagactgagctactattccacttctgaattcacttaactccaattgctttatccgtatgtgtaaaccttattctattctattacagtgagtgtgagctacctgaattgctttggacacaaagcaattctttgttttttaaatttttttattgtgtgtttttatttattttattgtttatttcttttttctttcttttttgtttttgttttgagacagagtckcgctctgtcacccagactggagtgcagcggtactatctcagctcagtgcaacctccatctccgaggtttgagtgattctcatgctgcagcctcccaagtagtgggattacaggggtgcaccaccacacccggttaatttttgtatttttagcagagacggggtttcgccatgttggccaggctggtcttgaactcctggcctcaggtgatcctcccacctcggcctcccaaagtgctgggattacaggcgtgagttaccgtgacyggcttaagtgaggcatttctaactaacagattccatttattgggagcttacctgagtgccaggtactgtgttaaatgctttgcctccattatctaatttaaacatcatgacaaacctatatgacggtgaccatcargattttcatccacctttgaggaaacaggcattgagagattaagcagcgtgtctgggatcaatcttacgccagagcccctgctttgagtcacaatgtaaawaaaataaaaaatatgactgttctcataatattccacaattaaggccgtttctaatggcccaccattatgcaaaacctagtaccaatttcgtcatatttttacttcaaaagttctccttttttctttaaaatctttactactgtttcaaaaggggcaatgtttcttcttccattgagataaggaaaataaatgaatgtgtggagcaagagcgtggaggaaatgaatttcttctattcgagccaagccacaggaagcacatggtcagaaaattcctcctggggaagaactgtgaagaagcaggaactccctggcaggttctatatccttagggatcacctcttgtttgtttttgtttgtttgttttttgagacagagcctcactctgtcaccagggctagagtgcagtcacgagatcttggctaactgcaacctccatctgcagggttcaagtgattctcgtgcctcagcatcccgagtactgggaccacaaatgtgcaccaccatgtctggctaatttttgcacttttagtagagacagggttttgccacgttgtaccaggctggtctcaaactcctgacctcaagtgatccgcctgtctcggcctcccaaagtgttggaattacaggcatgagccaccacacctggcccacctcttgttattgcttgctgaactcacatgggaacttcaaacatgtgacctcatttcctcctgattcaactctgccagataatcattttctccattttatagaggaggacactgaagttcaggcagaagccacagttcgtctgaaggttaacatctaatgagtagcagtgccagcattcagttgaagacccaacatcttttctgacccatgatgttgtgctaacsctctgcttgtcctgagaagggaacagctctggcaagggttgtacctatctgttacaaggtcgtggggttaggagatgcgaagttgctctcacccatgaagcatcacaggtttggaatagctcagcttcctttctccccacagtaaaattataaacacatctccactgacccaggtgctaaaaaggtcatggtgttaatgtatcagccctgtgtgttctcttgctgcagggagaagtgagttttcctggcactgggctcactcagaccatggaaagcctctaacacaggttaggagacactgtttacaccccatggaaagtgcccggggccaaccccagacagctgcctctcccaaagcaagccccacctccttcctcccatagagaaatgcaggtggaggagtgataggaactcaggtactgcaccttcaggtgtccccagtgaagtagtttcctagagtggccataaccaataacaagcatggtgggttgcaacaacagaattttattctcagttctgggggccagagtccaaaatcaaggtgttagcagggccttgctccctctgaaggctctaagcgagggccattctttgcgtcctccagtttctggtgcctccaggtgtttcttggcttgtggctgcatctctccaatctctgcctccatctccaggtgaccttcttcccttggtatgtctcctcttcttctaaggactccagccgttggagttaggacccaccctaaatccaggatgactttatctcaagatccttaaacaattatatctgcaaagacatgattttcaaataagggcatactctgatgtcccaggtgtacatgaatttggaggtatactcacctaggctgtagtgtggttttcccaacatcacctcctgataggtatccgacatcagtgctgccagtggaggctgtcctcaggtgtcttggggaccagggnaagaggccatgctgcccagtactttatctgggtgtgctgtggggagtggtggtgtattccacaggaatgcacagcacacaggtatgcaaagtggattcttgcgtgtgaactcccaccatcaggtggtaattgtgctggccaatttcccataccttccctatcccctgcctcctggtctcagttgtttaggtagccctcactccatgccaggaagtttttctttttgagacagagtctggctcattcacccaggctggagtgcaacggcgcgatctcggcccactgcaacctctacctcctaggatcaagtgattctcctgcctcagcctccagagtagctgggattacaggtgtgtgccaccatgcccagctaatttttgtacttttagtagagatggggcttcaccatcttggccagactggtctcgaactcccgacctcaggggatccaccctcctcagcctcccaaagtgttgggattactggcatgagccaccacacccggccccagcagcttttatgagtgtattacctgtaactcttagtttaatcttcacagcttctctgggaggttggcatgcccagcatctccactatacagacagcttaagtcatgacgcaggcacagtgctggtaagcttcagagctgggatttgaactggctctaggagctatgcccttaaccattaygctatattgcttctcattaaaaaatgtatcctcattgtaaaaaaaaaaaaatgaaaatacagataagcattcctttggcttggcatctcaatgccaatctgttgtctgtttgatgtacgttccatttctccaagacttttattatatgcatttgcatatgtttttgtttttctgagacagagtcttgctctgttgcccaggctggagtgcagtggtacgatcttggctcactgcaayctctgcctcccaggttcaagtgattctcctgcctcagccaccagagtagctgggtttacaggctactacaggggtgcgccatgacgcccagctgatttttgtatttttaatagagatggggtttcaccatgttgcccaggctgatctcaaactcctaaccttcagtaatccacccacttcggcctcccaaagtgctgggattacaggagtgagccaccgtgcccggtctgcatttgtatatattaatatatgtccacacagaataaaattttattctgtggaatgctatcaaactctatgcagtatgtcacagtttggttttcagtgaacgatatgttttggagagctttccattttttgccttcattctctttgactgctggaaagaactccatgatatgcatgcatcagartatttttaagcattttcttctcactagactttttttgggggggtgggatgagggctatcagtcatatggctgtgttaaggatcgttggggagtcctctgtgtacctctacaagtggttttctaggaatgaaaccaggacatagaatttctgggtggaagtatttatattttcttgaagccttcaaacttacgtagtcaatttatttgatttgcttatttttatattttctgagtggcctcttggtgcagagagtggattttggggtaagaaacgcctactttaatattcggtctctaataccagctgtgtgacctttggcaaattaaataacctctctcagcctgtttcccacatgtgtaaaatcctatttcctggaattcctctgagaaataaccaagttgacttatggaaagtaccctgcattctatctaacacataatagcattttcacaaatctcgatgtttttcggaatctctctttcactctcatgttttctggcccctgagagtccctgtctttcagtcctcctgtgtgacaagttccgtgatgtcgtcactactaacagtatgatggggtgcttaaaggataagcatcctggattcgaattcccactccagtgacatccagtgttgggaccttggacaagttattaacatcttagactccagtattccacttttataaaattatactaattgtgctgccttcacttggaaatgcactgtaaagattaaatgagatattccggcaaagagtgcagtgtccagcacatagtaaatgttcaagaaaagtctgaacaaagaaaacctttttgagccatctttctaatattataaaaacgctatgcttcgtgaaatctgcagcagaatggttaggtctgacctcaacccttgaaaagtacaatctaagaagctctataaagagtagcattccagaaagaaccaatactgttcctatgtcagagcatgagttgtggtgaagaaaatacagcatcgcatagtgctttgcaattcaccaaacaaattcatggctgggacttcattcaaccagtgcataaacataggagacagattatgttttccttcctgtcagatggggaaatcaaggcttagagaaatatttagactttcccaactttccacaaagtatgcagagccagttctctgaccctgcatcccagctgaggccttgcactgggggagcccggcaatggtgtcctgaaggcacactgctttggtgagtgacagaccggtctggaaaaattgggcggagatctctgggcctcagtgtcctcatctgaaaaatgaagagactggattacatactgtctcaactccttgggtatagtcagtttgggtccaacgttacatttaacagaaacaaagtacttacagctagatggacttggacaatcatttcaatccttccctatctttgaaattagcagtcaatagacaaagtgggtacattcatctcttgggtattctttctctttctctctctctctgtctctgtctctctttctctctgtctctcctttctctccctccctccctccctctctccctccccctctccctccccctctccctccctctccccctccacccttcctccctctctccccccactttttccccctctccctccccctctccctccctctccccctccccctcccccctccctccctctctcccctccctccctctctccccccactttttccccctctccctctccatctccctctctctctctgttagttcattttcacactgctgataaagacatacccgatactggataatttataaggaaaaagatgtttaatggactcaaagttccatgtggctggggaggcctcacaatcatggtggaaggtgaaaggcatgtcttacatggtggcaggcaagagagaatgagaaccaagtaaaagaggaaaactcttctaaaacaatmatatctcatgagacttattcactaccacaagaaccttatgggggaaactggccccatgattcatttatcccccactgggtccctcccacaacaggtgggaattatgagagctacaattcaagatgagatttgggtgggcacacagacaaaccatatcactgtcctcactccttccccgttaccttcttctatcctctttttctctctttctttccccccttttttctcttagtttcttgcaatatatctcactttttattctctccctctctgtaccttactaacatctctttctccttctctgtttctcttcctcactttctctttctcatcgtttttctctctttctgtctccgtcttcatgttttgcttggtacctccttccatctggatctcttcctcctccctagttctcttcctctcttctatcctctccccttctctgcttctctctgcctctgtcttacaaaatcactcaggatttattatcagctaaaaaaataaatattaaccatcchtcttttttgcccaattcacagtgaatattattggtaaaaaaataagccacacaaaataaactgacaagagctgaaagcacacagggtgaaatttggtattgactaaaaatccatagatgactcaaatcttcttagctaattttggatctctgtacaattttgacccaggagaaatggacttgacttggtggaaataataaccacaaaagaaaactcaaaatggcagaagttataaattagtaaaatttgttgtggtccaaatcctgatcnatgaagcaaatatttataaaatttaaacacaaaagaattgaccccagtaaaaatgtttccaaaaaagttggaaacaatttaactacgctatgcaagacatcgatcgaggaattaaattagcttaagggagtttgctttgaaaaatgcttcctttgtgaaaattcatcaatgttggtataactctgactttagagtttgtattcacaaacccagaatcaaaatgtgattctaggccattttcccaaagccagttttagaccattctgtgctgatggcaggtagtccctgtataggttgagtgtctcttgcccaagtaaacaatttcaaagcttgtcatgcctcagtggtgccatttctggggatcatgaatgcccttccccgatgggtacccggtggtgatccacacctccactgcttctctgcataatgataccaccactgccagataatctcctaaatcccaccagcatctgcaattacaagcaaaacaccttcacttccattttaatccatccaacagccagccctgtaataagttattatttatttcccatcttacagatgagaatactgaagctcagagaggtcccatgaccgggcttcactcatggagctggtgaagataaatctgaattgtgttccctgttccacagttgcccaaacatgccaactgacctcaagtgctaatgtgttcctcttcctggcaagggtttggtttgatctgaaaaaaatatattcagttatcatcaaagagatgttttaattttcagtaacacacacacacactcatgtgcacatgctggtttcattaattcatcaagacaagcagtgtcttgttaaaggcttcttgaatgttaatgaatgaataattaactttaactatataattagcctttaaatgtgctgagacccccagagagcatctgcaaacatgcataagaagatgatgagctaaaaccggaaacttttgattaggaaatgtcaagccgcttgataatacaagttcccatccctaatgtgtccatgcctctactgtggggtatagtcctccccagggtagggacaattagatttgccagtaaacagtcttggggctaggattggactttcaaggccattgtgcaggtataagagagacccactgactaaaggaatggggtcagatctacacacttgtgaaagctgtagcagctcttgagagctgtcaataaggatggcaggaaaccactaggttaaagtagcatggggcacatgtgacatccgtccttaccttgcttctttgctaatttacagagaggaggtcttatttccccctcttgttctgaattactgtcatttctaatcatttgtgctccttgaggactgccggtgatggagaaggtaatggcacccgcacagccactaagatgcctggcagggggtgagcctgtcatgtagccagcatagcatggcattcttttgagctccagcactgctccagccctcatggtgtgaagccaaggtgtctttggtctgtcgcagacattggagaagagggatcgctcctctccaacatcttctatagggagtggaggcagaaaggtggcatggaccccagtgtgtcagatggtgtctctgtcctcatcacaggcaacatcccacagttctcagacctgacctctgaacgtcctcctgcccagtgggagaaacacaaccctggtacctgggtaggaactgagaatgtggcacaaagacaaattcctcttcaaaaaaggaagagaacatgcaccaagcagagaagagtaaatgggttcccttagctgtgtgttcttaactgggctttcagttggatgctcttggttctaaggaaccagcccctcagtggtgttccaagccagtgctgcccataccaggctgcagcctaacacgtcactctgagtccagcagtcgcagctcaacccctccaaatgccattggtccacatcagaccaatactctgacactgtctactatggaaattaagcacttgaaatatggcgggcttccgtttcaggtggccttttttctctttcttaccctccatcttcaacaagaagctatggccacctatacctacatgtcttccgatggactggagtagactatgttaggggcaagagttttctatggaggtaactgcagccccttagatgactctgtggctgttgggaacgagacagatgaagtggaacaacccaccacgactattgaaactccggccgctctggccccatccttgcctcttctgtcaaaacatttggcttatttatagctaaaaccccccatctgaattttctaagtaatagagctgcctccatttactctacaagtcttatggatagcatggcttggtcacagtggttatgtcagtggtctttggtgtcagactgcataggttccaatgccacttttgacacgtatgggctgggtggtagtgctgagtcactttactgctcaatgcctcagtttctccatctgacaatggggatggcagtagtatgcccatccctgcacaaggagaaggaccaaaaaatataataatgcatataaagtatgcagaactggatttctcctataggatccataaaattggtgagcccctttggcataaaatctgaatttgattgaatgcatttatgtgtttcgagcatttgttatgttctgagcattgcacacatactttacttatataataacactttattcccarcagccctctaagggcaaatattgttggctccatttttctttcttgtttttttttttgagatggagttttgctcttgttgcccaggctggagtgcagcagtgcagtggtgcaatctcggctcactgcaacttctgcctcccgggttcaatagattcgcctgcctcagcctcccgagtagctggaattataggcatgtgccaccatgcccagctattttttttgtaattttagtagagacggggtttctccatgttggtcaagctggtctcaaactcccgacctcaggtgatccgcccacctcggcctcccaaagtgctgggactttaggcgctagccacygtgcccggcaagttggctccatttttcatagggaaaactgagcctgagaaatgcagttgctttgcccaaagtccctgttgacaaatctcagagatttaggggatttttttttctttttaacaacaggaacaattattttttccaatagaaaacggatcaaaagtagactttttgggtcagagcaaaaagggagacccagagtcctgctccctaagccttccccttgcttgccacagaacagctagggctgtgccgcaatagcccataggcacgtgggaccccctacattacaatctaaattaatgaaattaaatgaaatttacaactcatttgcactaaacatatttcaagtgctcgatatccatagtagatggtgtcagagcatttccagcattgcagaaagttctattggacagtgttgtcctagagggttttataatataaagtctggaaatatcaccaacaagccccaggctgccttaggctttctgaaccttgtctgcttatagacagaatagaaaaataataayaataataatatcttgctactggacagttgtgagncctcagtgggatgatgtctgtgaaatgctaagtattattttataaaacatcttgcagacaatggccatctcttttttwaaagtgattattagtgattccatttgttattatttattttaattcatagtttgttcctgcatcagtttgctcaggataatggtgtgcacctccattcatgtctctgcaaaggacatgatgttgttctttgtcatggctgcatagtattccatggtgtatatgtaccatattttctttatctagtctgtcactggtgggtttgattgaggttgatgccatgtctttgctattgtgaatagtgctgcagtgaacatatgtgtgcctgtgtgtttataatagaatgatttacattcctttgggtgtatacccagtataggtctttgaggaatcgccacactgctttccacaatggttgcactaatctacactcccaccatcagtgtataatcttttctttttcttcacaaccttgccagcatctgttattttttgactttttaataatagccctttctgactggtgtgagatggtatctcagacaatgaccatctctctgggaggggactgtgtatgccccaggatatttttaaacacgcagttgtctgtagcccattgtgtgtaggccccagctctctagaatctagaaaccagttcatgtggccctacagtttcctttctgtgttgtaatcacttcagttctgacatggccctaagatgacagtcaggccatggagggctggcccaattgtgtgcctccatggccagacccctctgacagcatgaccaccagcccaccccagtcatgccaatgtgtaactgctttggtcagagtcaaccacatcttttgcagctgtcctgcctctgacttttcagcattgtgcttttataaactttgttcccaaagaaaacttcctttattccttgtactcatatgtctgtctgttgctcagctcaaaaagacctgtcatgaaatatggtactgatttgaagatgtctatgcctgtccataaaataccaacttaaactgcttctggacaactcttatgtggttgctaggtacgtgtgtagatttccagcctagcagcacctcagtgcacagtggcttagcaggataggagaaggtttcaccccatgaattccaacagagggccctaatgtttgaatgtgcccatgtgtacatgtgtgtgtgtatatgtttattttttgaggaatggagagacgagagttgggtggtacttagaaagtctaaataaaaccaagtttctatatctccatggcaacatggatacgggaagtattgacgttgcaagtatctcagctttatcaagagaccaacaccttccacggccctaagtccttaggatacatgtgttatccagagtttcaatttccctatggatagccacagaatgtgactgttggctcacacaatcttagaataccacagctgaacaagtgtctcagcaagaccacaatgaacgccacctctcacagaggagaaaccagaaatccaaaaggagaaagtgactttcctgaggttgcaccatcatcctagcctagactagaactcaggttcctttcacctactactccagtgttcctgttacacaccctactcccattatacacaagttacttttgaccttgtataactctccatcccatatttctgcaggtctcactattgctggctgttcctcttgacttgctgtcatcaagccaagctctaggttgctccaggttacgtatgacagctctaggttaccatcgctgttgccaatcagtgcccagttctcttctgctgctgcttgatctgattccctttaatactctcagagcctaaaaccaagtctctgatacccctaccttgagatcaaagcttcakagtgtttctgtggatgagacaagtcctacagttttgcgccacctcaaaccattatagaaacaaaaaaaaattaaaatgaagaacacggctgtaaacctgccaaatagttttgttcccatagggagtccttcggcagctgtctctgaaaagatgcagtgtttcacatcctctctttgccatttttatttttatttttttgcttcactgttttatgttttcttgttaaagaaaggcaataaagttgagaaagtgtcatgaagttgagtcatctccgatttagttttcttacccattttagagttgagacattcatccctgcattccacagtgatcatttcagcctcgttaaataactttaacatttggaaacaatatmcaggactactgayagggatctaatcataattagcacctgtaatcccagcactttgggaagccgaggtgggtggatcacttgaggccaggagttcaagaccagcctgaccaacctggtgaaaccctgtctctactaaaaatataaaaattagccgggagtggtggcaggcacctgtaatcccagctatttgggaggctgaggcacaagaatcacttgaacccaggaggtggaggttgcagtgagctgagatcgcaccattgcactccagcctgggcaatggagtgagactccatctgaataataataataataataataataatatttaggcacagttgtgcccttggagagattacctgatgcttattttctggggtatgcataggatttctaaggaaatgataacattccacattttgaactgcatggtgatttcaaggatatatacatatgtaaaaattyatcaagcattttattacacatacgttatacctcaataaaaataagtgtatcaaaaaagaatttaaaagtgctatgtgtattcacatggaaatatattcactaggtatggaatgagagaagaaagcaatatgtgaaatagtttgtgtggcataataacattttcgggattaaaacaagggttggcaaactacagcccgtggacccatctgttttcctaaataacattttatcggaacacagcaaagttcgtttgtttacacattctctatggctgctttggcactatgtcttggtttcctagggcagccataacaaaggaatgcaacctgagcagcttaaasaacagaaatgactgtctcgcagctctggaggctagatgtccaagatcagggcatctgcaggaccacgcttccaccgaaggctccagggagggatctgttccaggcctctctcctgacttctggtagttccttggcttgcagcagcataactccagtcttcatatggcgttctccctgtgtgcatgtctgtgttcagatttctccttttaataaggacggcagccacagtggattaggggttcaccctacttctgtatgaatgttaggggtggacacagtgcagccccataacaccctacaacagcagagtttaatagctgcaacagagacggtatgtcctacaaagcctcaactatttattatcttgtctttatagaagaaagtttgccaatctctgtgtatgygtgtttgtgcatactcactaaaacatttggaaggctgttcactaacatgttaacaaaggttgaatctgagttatagaattataggtagctttaattttaattgtatttttaatacttttctatattatttggatttttwaaaattctgcaataatttctgtatgataaataagcagcacatgtatttcttttgggaggaaaaaatattcctatttagttcctttccccttcatacacactaccaccaaattcttctgccccttagtggtttattttgttctgatgcaaacctttctaaatagggcactgtcctccaccactgggagtgttaaggacaaacacttagcaaaccagcaaactcaactgtttactcacttgggtatatggatccttcatgtctttatttagctgcctcttgtaagttggagagaaaaggttctggcttttatctcctcattaaaaatagatccttttatgatgaggggatggagaggccatgagtcatcatcaccagcatgaaagaaagtgtgggatgctttcaggatcaggcctcaggagctggaccccgaggtggtacctggccacccctatgaccccctggtttcttgtcatttcaggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtaagaccccgggtgacccctttctttagggggacttgagaccctcacactcgctttgtttgctcctgggcttcccagtggatctttgcatgatgagtttgctccctaaaaatatttactgagttcctgtcacatgaaaccatggttctttaggttgcttataatggaaagcaattctagataactaaatttaacaaacaaaagtattctaaggatacagtctctctcaggggatttaggaaagagttaaataggtttagaaaaagacaagagccaggacagtcctggtgccttaagtgggaatttataggtcttctgtctagggcagtggttctcaaagggtgaagggcaattttgtccctcaggtgacatttggcaatgcctggagacacattcagtgatcacggctgggaatctgcttgctgatctaatgggtagaggccagggccagaagatgcaggaaaacaccttacagggtccaggacagccccctacatcacaaaacacaaaattatccaacctcacatgttggtaggctgtggttgagaaacgctgctgtacaaaattacataactaggctgtaatcagtcccaatttcactccagagaaaggatttctgatgcattttgaggtcaaagactctttcctagacttatcaggcatgactcacggtggagtcatgttgtaccaacatggcaactcatgttcttatcccgtggaggaatgaaggaaaggcaatctctattgcagtctaatgagactgtggcatttatagaactgtaaagccgcttgggccagctrtgtcaccagaagcatttcctcctgtctgccctttctacttcatagctggtgatctcactatagcccggggtttcctggcatggcctctagaggctggccgtggcttggaatggcaggttggtttcctttcaattgccaacacggaggaaataggaaaagcaaagtcagctcagatagcaggttaacaccaaaaatgagctcgstatgaggaggatagaaaggctcaagccagagggcagaagccccgttcaaatagtggaggctatattcagagatgattacagaacrtgttatgccaggctacaggtgggagagaaaaatctagttaccactacagtgaaatgcaatatcaaaataggcagaggttagctagtkcatagggttagtgtgaattcgaatgaagtgcacaattacttgtggcttcttatcttctttctattcacagagttaaatcctagattctcacagtgccatcaggcattctaaatgtgttttatatttaactcccaaatgagaacatgtgagtctttgaattctccatagggcatttgtacctycctcagatcactggccatgttctctgctgtgtaataatgatttgtggctgtgttggtcmgctttttgctgtgagatcttagaggcgtacaacagtaagcatttattttcctcatggtagtgcaggttgagtggagaagctctgcctggggtggggatagtgcctctgcttcctgccacaagcgtacgaatcagtggtrtggtctctgctccacacgtgtttctgctgtgtctcgggctgaaaaggtagcagctacctggggaagctcttttcctggccatggcagaagcacagaaaggaacgcctagctgcacatgcacatttcaagccactgcttggtcacgttcacgtctgctaacatccttctgtccaaagcaggtcaggtggccaagttcagggtcaagggattgcaggtatactctgcctttcatgagataggtcttgaagttttatggcaatagtgtggacactgagagtatgctgaagaattggggccaaatgttttgcctatcacaggggtggataatcacccttacaggggatgaactattcagcaaacaggagtcttatttccagcattacaacaaaacactgaacatcacaggtaaattggtcaataaaggtttgaatgaataaatacatgtatggatgaatgattgattgatgttaagatgtatttcatttggctggaaacttttaaatgtgataggtatctgtcaaataagtgagttctaactctagccccacccaccattggtgtcactctcgaagcatctattataaaacagctaacatatttagggacttgggtatgtcaatcatcatactggatgcattacatacgttcctcaatgtaatcttcgtaaccttatgaggttaaatgttgcttattcccactttacagaggaggaaattgaatctcagagggcaaatcccctagctagtaagtggcaaagcttctacttcagggaccttactctggaagggggccaattagggaagactgttgttatatttaattctctaagttatctatcaaagatgactaaactcttgagatgtataaatcctttaggaaggagtaatttagtgcacatctgaactaaatctactgtcccatttacaaatacttctatgaaagaagtgatcttttttagcctcggtttattcatctgtgaaagggtacagaaataattacctaataaggctggtgtgaagatgaaatgggagaatacatgtaaagtgcatagcttagcttagcatagaccctgtaacatacaagtggttcaataaatgttagccatcaccattgtagttacagaaaaggggtcccaatgcagacctcaagagagggttcttggatctcatgcaagaaagaattcagggcaagtccatggagtaaagtcaaagcaagtttattaagaaagttaaggaataaaagaatggctactccatagacagagcagacccaaggctgggttatttcttgatgatatgctaaacacggggtggattattcatgcctcccttttttagaccatatagggtaacttcctgatgttgccatggcatttgtaaactgtcatggcgctggtgggagtgtagcagtggggacgaccagagatccctctcatggccatcttggttttgttgggttttggccagcttctttactgcaacctgttttgtctctcagcatggtctttatgatctatatcttttgcccacctcctatctcatcttgtgacttagaatgccttaagccatttacgaatgcagcccagtaggtctcagcctcattttacccagctactatttaagatggagtgttctggttcacacgcctctgatatcattattatcattatcatcaccaccaccatcaccgtcatcatcatcatcatcatgaccattgccatcatcctcattaccacgatcatcaccaccatcatcatggccatcaccaccaccctcctcctcctcttcatccttctccttctcatcatcaccatagttgcccgtgcacaactctagtatcaaacacaacttctttagtgttgcactggcaataatgtagtcaagttagtaacacagaaacaacttttgtggtgctaaacagaaaaggtcttctttgcaccaaataaaaaataaacagtaaaagcatccagatgggccaggggtttgttcatgtacttacagaacatctaggttctcatcgatattttctgttctggctcattgccttcctggtcagacttgggtttgggaaatgtctctattcagcttcatctcttgaggccatcgggaggcataagacttgggagagaaaatgccattggtccagggggtgtctccagatgatcttcccggaaagccatgaccaattctgaatgtctctctaggagtaaatacatgaattaacacagctgcataaatatttcacttatcgtatgcagcttcagcaggattaattatgctctaaaattagacgtgtaaagagcacagtgctgagcagtacctaattattcatcctctagaatggagtgtttatctcttgttacacagtagcttcagtggacgattatgagtctaatgagtgtcaaaagtataaaaaattttcctaatgagctgtgtaaatataacctttgaatggagtgtttggttattgagggaacctcttacatgaagcctgccatgcatttccctaggaaaaaggctgttcatctgcctggaagcatacacaagatcctagcaagatgttgccttccttttccatctaattgtctgtggtctttctaaaatgatagagtgcaccatggcatctttggctctcagtactggagtaacaatgctcatgcatatgtttcagcattgctcagcatcgatacccaacatttactgagaaacagatgttttcgtaggcactgatattcccagaaggggttatcatggtctttttcttcttaccctcaatgaacttacagtccagtaggctgacaaatgtataaatgcaaaatatctaatcctaaaatcgaaacgtttctagtaattcacatatataaatttatatcacacgtgtatatatacacatatgtagacatacatatacacaygtgttatgtaygtggtatatattcttatgtatgtgtatatatatacatacatatatattcttaggtgtgttgggtagataagagaatggtcaaggagaaatacgagacataactagtatctttaagaataaaggacagaatgattcataaagaaaacacgtgtggcaagatttagacaaagaatagaatgggccagggttcacagaagmctcagccatttattcatccagcaaccagcaactctttattgagtacctcgattctgcttggtccctaaaaggtaacacttgagtgagaacctgaagactgggtaagccttggacttaaagaatggcatttctggctttgaagtaaaggtgaacaggggatcccataagtcccatctatctcatgcattttgtgattttcaaaaaaatgatngtggggtttgaagaagcagaagaaagaccataaaggtcaaacccttctcatatctgggggccagaacaaaagatactgagaagaacaagaatgcctaattttattattcagtcacaagtgatgctgagaaaagggaaggaaaaaattgttttaggtcctctcatctatggttcagcactatgccaagcacatcacatataatatcctagtaagcctttatataatattctggagtaaatcttattatctcccttgcacaaagcaggaaaatgaggctccaatgagtaaagtgaactgcagcagagctcattcagctttaccatgagcaagaatcacgtgaggatcttcctaaaacaaagactgtttcagtgggtctagggtggagcctgagacccagcatttctaacaagctgccaggtgatgctgaggctaccagccaatggacaacaccctgttcagacttttatagaggtaacaattggctctagttcatctgagtccaattctgatcatttcctactaaaccaagctgcaaggagaaacctggtttgcaggcggccaggtcagcttagctataagtaatactttttagtattgagaagcgtttaatcttcttctttgtattttgctcagttttaatggttgtggatttatttttaaactccaatagacattactcatccctgacatctagtctgaggtcatttaacacataaaattaaatgtatatatttatcatgtatgttaaaaattatgtatatggcatattcaattgcacctatatcatatttaggtatatataatagatatgtgaagtatttgaaagatatggtacacatatctctcgcattgatattatattaggctaggtgcagtggctcatgcctgtaatcttaactactcaggagcctgaggtgggaggtttgcttgaatccaggaggtcaagatcagcccaggcaacatagcaaaaacccatctctacaaaaaaattttttaaattactgggcatggtggtacatgcttgtaggcccacctactcaggaggctgaggcaggaggattgcttgagctcaggagtttgaggctgcagtgagccatgatcatgtcactgcactgcagcctgggtggcagagtgagaccttgtctccaaaaaataattacattaatagagtgaccaactcaaccaatgttgcctggactgtccaagttttaaaactagtgagtgaccccagttatatcatatttgtacatataatcatatgttaaatatttgaaagatacacacacacacacacacacacacacacaattttacttcatcaggttccctctgttccttttgtactgcaacttttgccagcaataattttaaagactcatctagattgttaacagattggagaggaccacaarccctgctctcatgttaataaggaamcttcctgcaatggactctagagttttaatagcaccattcagcataatgatgctcacagatcttggagtgggggagccttggaagtcaatggagaactcactttctccctctgagtgggtcagtgttggcatcctgagtcctttttttgttggccttgtatcttccactgaagcatacaagatagcttttgacggcaggggaccccgtgctggcaggcagaatagaaagtgtttgtgtggtcacagaagtccttgtatctaattagaattctcataaattgctctgggccgctggatgggttgctaatatcctcaacactgcccttgatcaacttcccagcttaatatctttgggctgacatccgagtctggggtagagctggacagtcccacagctcaggcagtgatgaccacacatgtgtccattctgaggacggcgtatccctgagaggccttcacagccagtcttcttagggctggcttaggaatggtatgacagtgtggactggggaaatccttgaatgccccttacccctgaatatttttccctttcaactttctacagcatccagaatttcaccatttgaaattttttttttagataagtgtggattgctgcatgcaacaccctataaaaatggaattcctccttccctcttttcctaaccccatttcctgatatgacatctcatccatccttcagcctctgcgctcctctgtgaatactcccataaagacctctaagctagataccctgcctgtgaactcccttatctctacncttgtggcatttagcaaagcaagagaagtgaaataagtaagatgaaggttctgcagtttcctagtggtgtgacctggggcaaattaatttcttagagtctcatttttctcattttaaaatcagaattctttaaggattaaatatgaaaataaacataaagaagctagtccatgcctggcacacattagatgccattgttggcctctccatgtgccctgggccacttgagtgcactgcattatagattcctcgagggcatacgctatccatgtccacccctgttgctgttcccttactgcaggactcagtggagcttggcataaacaaaatttgtttaatgaatgaacaaatgaatgaattagaaaatactgcagatacacttttgcaagtcttatgtcatcgatttaataccttctttaatgaaagggaccttattttctttagaaaggacactagatacctctagagagagagatgcaaggaggtaatcactgaatcactgccaatcttttgacagtcttcccaggcatcttacctctgtattcaccacaagatagaggcaaattcctccattgtcttatttgtatattataatagtcaaatatccctgtattatgctctttaatgcaatatatgcaatatgcatatgaggcacatatatgcacatatttaatatgtgcaatatgaggcatataaccaacagaattatataytccctggcttttacaactgtagtggatcataaattgctacttagtccagtaatatggaaactgaagccacagaggggatatgacctcacctaaagatgcacagcgagggagtgcagagttggggctcaaacccaggttctctgcctcctagacaaattatatattaaaaacaaaacaaagggaacacaaaaccagtgatggtcctttgttctgtttctttgggaaagacttgacctctgcagtagaagtaatggtcgtagaggacagttggggtatctccaggcatattggtcagcagccccatccaaatcataaaagcctccagtagaatgagccttgctgtctcccaggcaccctccttccctgcagcacagtagaggcaagacaggagaaacaatgtggactccaaaacatgtgctttgtttatttcaggcaagactgcatgctaatgggagaacagtagacaagtttcatatccatagtgttcccaggcacacaccactggtttatgtctttctttgacaaaccagccctgttcacagtttctccctttcttccatgcaaacctcttccaaactgtagctctaatgccttccccaaggaggggcttgtgaaataaagctgcgttgctccacccttgacttttgctgttcttcactgatgtggttttgttcattgcaatgtcattagcatgaatagagaattctaaaaccccaacaaccaggaatgataattgcacagttttgacttagccagaccctttgccaaactggatcgagctcctactgtgttctttgctaaacttgctgctgcagtcctaagaatttaaacactcaaaagcgtcctccttaatttatttatgtgtttgtgtgtgtgtgtgtgtatgtatgtttcatatatcttatcaaccaaggtttgttttccaaattctctaaactcagacaggaattcaggcgttcccacataatagtcagcaacataagtcagaactcatggttcttccatgtccaccagatctagggagggttctggaatatgggattcagtctctttaatcaagaacctgggagagagggactgtaccttcaggggcccagaaattagtaccatgaggctgaaatctgttctttagtctgctggtttatgatgaagagggcgaccaagaaaaaatagtatttcccttagcatttatcaaaacccatgacccaaatcccggttactgcctggttttgaaaatgaagttttattgaaacccaatcacatgtaaagcctagtcattgcaacagaaaccgtaaggcctgcaaaggccagtatgtttattatctggccttttacagaacaagtttgatggcacctagtctagactgtctggagacagataagaagggcagagaaggctgggtgcagtggctcacacctgtaatcccagcactttgagaagccgaggagggtggatcacgaggtcaggagttcgagaccagcctggccaatatggtgaaaccccttctctactaaaaaatacaaaaattagccaggtgtggtggtgggtgcctgtagtcccagctactcaggaggctgaggcaggagaattacttgaacccaggaggcggagtttgcagtgagtcgagttcgcgccactgcactctagcctgggcaacaaaatgagactctgtctcagaaaaaaaaaaaaaaaaaagaagacttaaagttggttgtccagttctcctaagagaagggagaagatgaagatgagaacaagaagaaagaaagacaaatagtgtggggaaggaaaaagggatagagatatatgagggagaaattagagggggaaaaaaggagaaggaggtggtaataataaaggataaagaagagaaaagaaggccaggcatgatggctcatgcctgtaatcccggcactttaggaggccaaggtaggtgaatcactcgaggttaggagtttgagaccagcctggccaacatggcaaaaccccatttctactaaaaatacacaaatcagccaggcatggtggtaggtacctataatcccagctactctggaggctgaggcaggagaatcacttgaacccaggaggtggaggtggcagtgagctgagatccacaccactgcactccagcctgggcaacagagcaagactccatcccaaaaaaaaagaaaaaaaatagagtcaaaaagtaaggagagagaagagaaaggaagagagagaaaaaagggaggagtaaagggagagagaggcaaagaaagaaggagtgggagaggtaagaaatgtttgctaagtgatagttcaggcaatgtttagcctgtgcatccacagagcaggctagttttattaaactgagaattagccatgctgcagatgaaattgaagatgtctcagagccatccgtgcttctcctcggctccggtgtgttggtacaaggcacagaccaccagatgactcactcctgccttggagatgtctaatctgtctttcgatggcttccctgccagcaattcttcctgacataggtccctgtgtcctcagatgactcagcaacacccattacaaccagcagcctcagcccaattaaagagataaatgcaaagtaaaaatagaggggagaggaactgcagagcatctgaaaacctcgtttgagaggatgggacagttttccatttctccacatggaagtagttcaacagctaccatgattgttatagatatttgtcataataagtaacacgagaaggataactacatgtcacaaaatcatctcagtccttgtatgtatttatccatgaagagagccaaactctgtaaaatattcgaagaaatctattctgagccaaatgtgagggccatgacccaggacacagccccccaggaggtcctgagaacaagaacatgtgcccaaggtggttgggctacagcctggttttacatgttttagggagacaaaagacatcaatcaatacctgtgaggcatgcattggtgcagtctgatagggcgggataacccgaagtggggtagagggtggggcacaagtaaaaggtagagtcaaagtccaaagattttctgatttgcaattggttgaaagagttaaattattatagaaatgcctggaatcaagagaaaggactttctgggttaagagaaggagttgtggagactagggttcttatgtgcatgaagcctcagtgttttctattcagacctctaaaagatgctggattctcagatagtctcttcaagattgggagggcctggaatggggaaagatcttgttatgttaatagagaatatatatataagatgcatttttccccaacaagaatggctttgcaggccatttaaaaatacggcaaagaaacatatttggaggtaaaatattttgacttcctcctttatctgtcatgtgatgttctgccaaagttggaaactaagccatgttatatagcatggaataaaacccctctgacaagactttattgtctgtaggatgtgactcttcaggycccttagatagggctttgggcaagagaagaaaatggtcggagtttggtccttatattaatttcatttgcccctcacaatgactaaatggcatggagttataattattcattcctatttacatatgaggaaactgagtcacaggtcagttaagtaaggtgtccaggattatccagctaagtgggagatctgagattggtacaattggtacctatgcaggagggcgccaggatctttgctttaatctttacatgatgttacttctttagctgctataaaccctcatagacatcttggaagacaggtggttttctcatctggaaaggggcaaggctgtgatttaaacacaggtaggtcacaccccagagtcagtgctccttcctcttttactaatgaaacagcatcattaccctgcagaaggtactgggcaaaatcactttgcgacagaagtttagggtgggagagaaaatgacctacactttttttccrttgttcatggtgaaggagactcgtccatgcctcaggccccagcaccgtgggagcaggcccagcctaatttttgagatcattcaaccctgccagtttggggaaaactaaggacccagaagcaggagatgagaaggaatgaaacaaggacagaatgtaattaagagaagtcagatgtttggcctcgatacaggcttgcaaagcagcctctccaggttcacaaagacctgtcttggttgctggaattgcttgttccccacagagcttcttggagctgcataatctccagaatttcagaaagttattgttccttgctaaacgtgttttaatcaaattgagacttcaaaggcagaaatcacagttggggatgagctgggctagtctgtaaattactaactttctaatcaagttaggaagaactgggtgccattgacaacccccttcccatgtattcacccatttgttcattcattcattctcccttctagtcatcgattcaacaaagaacaactgagcagcttttaaactccaggtggtgggatataaaaatgattaaacactcctgctctattgcccttgcctatggagatgcttttgacattttgcatccaatagaatcacttggcaagaaaatacagacacctaattttcacctcctgtggggcatttctacatcctttctgggtgattctaatacacattaagggttttttttattgaaacttatactttttatctagtgttctaaattgaatctccatgtacataattttataatattttataacttttaagtgaaaattcttaaagcaggcatttgctccctttacattatatatatatatatttaattatactttaagttttagggtacacgtgcacaacgtgcaggtttattacatatgtgtacatgtgccatgttggtgtgctgtacccattaactcgtcatttaacattaggtatatctcctaatgctatccctcccccctccccccaccccacaacagtccccagagtgtgatgttccccttcctgtgtccatgtgatctcattgttcaattcccacctatgagtaagaacatgtggtgtttggttttttgtccttgcgatagtttgctgagaatgatggtttccagcttcatccatgtccctacaaaggatatgaattcatcattttttatggctgcatagtattccatgttgtatatgtgccacattttccttaatccagtctatcattgttggacatttaggttggttccaagtctttgctattgtgaatagtgctgcaataaacacacgtgtgcatgtgtctttatggcagcatgatttataatcctttgggtatatacccagtaatgggatggctggctcaaatggtatttctagttctagatccctgaggaatcgccacactgacttccacaatggttgaactagtttacagtcccaccaacagtrtaagtgttcctatttctccacatcctctgcagcacctgttgtttcctgactttttaatgattgccattctaactggtgtgagatggtatctcattgtggttttgatttgcatttctctgatggccagtgatgatgagcattttttcatgtatcttttgactgcataaatgtcttcttttgagaagtgtctgttcatatgcttcacccactttttgatggggttgtttgtttttttcttgtaaatttgtttgagttcattgtagattctggatattagccctttgtcagatgagtagattgcaaaaattttctcccattctgtaggttgcccgttcactctgatggtagtttcttttgctgtgcagaagctctttagtttaattagatcccatttgtcaattttggcttttgttgccattgcttttggtgttttagacatgaagtccttgcccatgcctatgtcctgagtggtattgcctaggttttcttctagggtttttatggttttaggttttttgtttgtttgttttttttttttggttgttgttgttgttagagttttgctcttgtagcccaggctggaatgcagtggtgagatctcggcttactgtaacctctgcttcctgggttcaagcaattttcctgccttagcctcccgagtagctgggattacaggcacccaccaccacgcctggctaatttttgtatttgtagtagagactgggttttgccatgttggccaggctggtcttgaactcctgacctcaggtgatccacccacctcggcttcccaaagtgctgggattagagctgtgagccaccacacccagccatataattctttttaaaaaacttttgttggaagttcatgggtacatgtacgggtttgctatataggtaaacttgtgtcatgggggtttgttgtacagattatttcatcacccaggtattaagcccagtacccattatttgtttttcctgatcctctccctcctcctatcctccaccctccattaggccccagtgtgtgttgctcccttctatatgtctatgtgttctcatcctttagctctcccttgaaagtgagaacatggggtatttggttttctgttcctttgttagtttactgagaataatggtcttcagctccatccatanggtttaagaatcactctttaaagtaacaatatttaccatttagaaacattttatcctgtgattggcagaygttgagtacacatatcagttgccatccaatcactcagttggggtccatgatattgaatctttgccctgagttttattcattctctttctctcagggcttctaattgggtttacacagagcccttggtgattgtgaaaactagaggcataaatggtttggcacttctaagcgttagtccacatgccaaccacaataaagaacataggagatatgagggtaggctatgaatggaagacgtagtcagataagctttaatgttaagcttcctcatccaggaaggatcgaaatagacatgaaagcctttattgcttccaaagatttcattttcatttattgactataataacagtgttaaaaataaagcaggcaaaactgaaaaccccacatttgggtaaagactgagccagcacttctatcgattaaatcggatctggaactagatttggacgcaatggctatcctgattccttatacgtgtagacggggtctcatgtgaaaccacggggaaagtgcagctaaagaccgttgattgagtctaattttttatgtggatttcattattgctcccacgtatgtgggtgacttttgcatgtacataaacctcatgtatacacaaagataatacactgatgatatagacatcagaagggggtgatcattaataaccattctgatgccccaacaactaagtcacttactctcctatgacccaaaaactgtctagggcaaaccatttattcagaaatgcaacgttttcaaataagagatatgtcagttctaagcatagattagcaataaaggacttaactgcttctccattggcctgtgaccagatgataccataaaaattagacttgtttatttccctcctaattttaactagagacatatttggaataataatggaacagtacttattaagaaacagataatatccataaatatcctggagagccactgagtcttcctcagtggtaaaactccaggggatttaatctgcgtaaatttgcagtgaattccctaatgggcctgttgagattcagaatcttagtgtctgttatcaatccaacaccaggattagtacaaggtcagcatgccaggcccatgcctgacaagcagtgaattgctcaaaccagagaaagtcaaatgtcaagagaaccatcaaagtggaaataaganataatgaatggcttgttggtaagtcaaacattgatgtcacataggctngtgcaaaatttatggcatggataaacagtggccccaaatccctctcagtctatattttttaaacactttnatttggaaaggcaatatattatatatacagttgtccctcagtattgtggaggattggtttgagggtctcctacagacaccaaaatctgtggatgctcaagttcctgatataaaatggtgtagcatttgaatataatctatgcacatcttatactttaaatcatctctagtttacttataatacctaatgsaatataaatgcgatctaaatagttgttacaccgtatggtttaggaaacaatgacaagaaaaaaaagtctgtatatgtttagtgcagacaccattttctccccaaaatattttcaatctgtgatcatttgaattcacaaatacagaaagggctgactgtacatataatcaccccaatctactactttaacataattgtttttaatttatgtattatctcctgatccctgttacttgcagacacatttctttaattataattattggttatatatacttttataktccatgatttttcacttattattacattttaagcattcttatgtaactatactatctgctttcayaattattttaattttttgcataaaatgtcatcatctttattaaaccagaaaccattacattattttccaaatgctacacattttgatatttggctagtatagataacgatggaagaaatttcttcatgcctatttcttttttcttttgaactatttgcaacaaactcttagatgtagaatttaaaggttactggttctaaagatctctaggagtcttgatatatggcgtcatattgatgcccaaaaggtttgttaaccctgggtgcagtgactcatacctgtaatcccagcactttaggaggccaaggtggggggattgcttgagcccaggagttcaagactagcctgggcaacatggtgagaccccatctctacaaaaaataaagacattatctaggcatagtggcatgcacctgtggtcctagctactttggaagctgaggtgggaggatcacttgagcctgggaggttgaggctgcagagagcagtgttccttccactgcactccagcatgggtgacagaacaagaccctgtctcaaagaaaaaaaagttttgtttccatctaaagtaatagtaatagtggatcaatgtaccaattttaccactatctagcagcattaggcattacagttctttttgctattttagaaggtgcaacatgctatctcttttatataaatataaaaagttatttcatgtttcatgttttgattggttaaatcagaattctgcaaattatggcccattacatgttttttataaagttttactggaacacaaccacactcattcctgtattacgcattgtctatggctgtttttgtgctacaaaggcagagttgagtagttgtgatagagaccrtatggcctgtagtgctgaaaatatttactaattggcygtttaccataaaaaaaaaaaaaaaaagattagtgacctctggcttaaacaataaaagtgacatgttattttgaaacaattccaacaattggaagaatttaactaaacatgactggtttccccttatccttaaagaaattttctctttttgtaaagaaatatcacgcttaaaaaagtttrtatttttctctcctctggtttagaaagtctgttttcttcaactttccttattattacctcacttaacccccaaagtaaaagaacacttatacctgtactatgccactcactgtttttttctatttgttaccttctataaactatgacatacattcgttatattgcacaaatcccaatatccagttaatttttgtacagctgtgcaactcccacccagattgagctataaaatgtgaccactatcctagaaagcttcctcatggcccatgccagtcaatatgccccccacaagtaatcaacattctgtcctccatgaccatggggtggttttgtcttcttttgatcctcaaataaatggtggaatcatacaacatgtattcattgatgtctcttgtgacattgatacatattactgcatgtaaccacagctcattattttttttcgttgctgggtggtattttatcgtacaaatttatccattttgctgctgatgggcatttacatcacttttagtttttgtctgctttggatatttttgtacctttcttgtgcacaaaggcacttattggtttggaaatatacctaggaatgaaattgctgggtaatagagcgcgtctactcaactttagtagatactttgaaccagtgttctgaaaatgtaaaccaatttacattcctgccagcagtgcaggtagtttctccaatttgcaagtgctccttttcgactttctgtaagaggtaaagctggcttgtgcaacwgaactctaggtgtcttcatcagtggctgtgtggttggctgttgccaccagtcatttagagatccagattcttgccccaacatcaacattgccttattttgtgaccttggttcatgtaacctgacctcagatttaatgtcagtacaatgggggcagaggactgtggagtctgccccacttactttcctgagttagaattgatatctagcttctctgccacccgcatgtgctcttccactcatccctggccactgtctcaccccatctggtgccttagacttgggaaaagggagaggaggtcagaggagcacctccatacctggggagsgggaggatgtcatcaaaggaagagctgagagctctcctaagtcataacccagccctgcacaccaccctattaccctctatggaaagaaaaacagggtcttccttctgctttagttacggatggttctgacagctgatatagggtcccttctgtaatagttttatttctcactttctgtccttctccattcccctttttcttcctcctccttctcttccctgtcctcttttctttcctttccactctctccttctctcttcattccacaactaagtctccgatgcccattaagctccttgtgtatactaagcaatggggaatacagatcaaatggaagtgatccatttygcttctggattttacagcttcaaggaacttgttgacaacacttcrataaaaaagaaactgaaaagcagtgagataattttacttgctgaaaagaggagctatttcttggcatgtagaactgagcaacacagcataggttaccttggrgttacaagagaagcatcacacccaaatggctgaagcccctggccagagataagaactcagaggcatctccccaacctgggagaccaggctccatgctttcccactgcttcctttaaatggatcattcaggcatttgcctgcaaacttaaagtgacccgcacgctattcccttttatgtaccactagttggccacattctctctttctcgggctgactcttcattcttgccttgtgtgatgcaggagcagaaaactgtcctcttgattcattgcaccctccctgcccaggatgtgtaagtaataaatctttgagcttattttctatatggtggtgtattgaatttgcacctttcatctgaagacctaggaactaccgcagactgggttttccctcggggakactacaaggttgggcttccagtgccagagcgatgatcaggcagacataaactggacatgggtcagacaagagctgcaagggcatcagcagttataaataagttcctcctgggagagatcccctggtcatggataggaaaactaggcatgaggttgtctactaggtaaaagaagcatcctgtgaaaggcacrtgtaaacacccagatttacttcccctcrttggtcattagggcagggttgttagctgctgtagtactggaaacccagtttagccagtggctctcaaaacagcacgggatctgaagttattgctatccttttttttcttaaatctgtatgtgtttaaaacacaagaactcctttgtgatattaaaaagtcctcataaccttcccatgataagtcatcagattttgaggactattgattgagaaaatatgcaatggcaaaaagtcactatgaattcatttgtgctcacaaatgcatgtgccttttaagccatgtcagcttgaccgtctttatttgtgtgaggcagattggttaagcagattccagaagtgcttggtatataataaggtttcctggattcctacaaggtttctgccgtcttacttcaaagaattgtatctctccaacttcatccagtaatggaaaattatgaccatgtgtattgtttgatgtttgatagagttgtccaatcttttattgtccaatcctctttttaatttttcttctgaaagagacactggttgggaagctgcacaagttgtagttgggttttttgtkgttgttgtttttgagacagtttcactcttgttgcccaggctggagtgcaatggcgcgatctcagctccctgcaacctccacctcccaggttcaagtgattctactgcctcagcctcctgagtagctgggattacaggcgcccacgaccacgcccagctaattttttgtatttttagtagagatagggtttcaccatgttggccaggccggtctcaaactcctgaccccaggtgatctgcgtgcctcggcctcccagagtgctgggattacaggcgtgagccactgcacccggccagagttgggagattttatggttgggaacctgtgtgcataaaatcccccaactccatccaacttgtgcgactaatcacgtggcctgtgaaatcctgcaatgtgacaagtagcaatgaacttaacaatactcaagtttcatccayggagcagaaatctcagttggaaggtggyggtgaaacatttatgccaaagacagcctgtccctgcctctaactggatacatttaagcctagccctatttttattttggttttgtgacttctcagcattatacagaaatggaatattctgacatttaaataaggaatatttatctcccaaattcaatctatttgtgtccmgaatcttgtactatttcctatcaccaccaccatcaaaagtattttttcacttcggcaaatagttcagtgaccctctgagatcgtgagaacagaggtcacaggctccagaatattatttctgaacccagggttacttgggtcttatttttctctagctcatttttttttcttatttgtcagatttattgggcctttgttttgtccttttgagagtttttaaatttgtctttaaaacaacatgggtgttgggtcaccacagggargagagaaaggaatgagtttctcactgctgcatctgggagggtggacttgcctcacatggctttgagtcaagatggtggaattaatgaagttgggccctcaaggtcaaagctcagatggtctagctgatcttactctgctccaaggccacagaccacatccccaaatctgatacacaacttcctttcatctacaggacaactgggcaaggagaggatttggccccaattctgtgtcccccaggccatcctcaattgcaggaccacaactcagaactcagaatgaccaagtctgttgtcatcgagaacatgagcctgccaatgaatctgtgccctagatttcccataaaaaagttgttcctttgccatttccaattccaatcgggcttctgagaaacccaaagtacccaacccctgggcaagacatgaaacaggattgaaatggggtcagttaccctctcggtgttcacagcgaacccgaatgagatcagcagcaacaaccttctgacgtctttcagctatagatggaagtctgttccctgtaggaaaccaccaggctctattgctgggatctttgatgagaacatactcgcccaagagccagccttgatttctgggtttcagaatctattcctcacccctttgcctggggcttctcaaacttcttcctgtcttgggctctgaccgatcctcagatctgtggatcacaaactaatcaaggagacaggagccttgtgttatccacagttggtgcaatgtcatgaaccacatgtaccaagacctgtgccacagaytgggggtacaaggagaataaaacaagatccctgccctgaataaastcacctcccagtgacaattacgttccactgtgacaaattctatacaaaaaaaaaaaaaaaatccaggatgttatggtagaggaaaccatggcgtcatatttacattcctgkgccttcagggaagacttcctgaaggtggatacctctgagctatacaccaaagatagctattgccaagttttcagcacaaataccatgcagctggtatatccagagtagactgtaatgggttatgatattggtgacagtttacaatgaatccttgccagcagtttcttgtaagtgcgtttctcccagtcactgcataacctcggaacaggaaagcttaagctgcgtcttctgtctgactctgaaatcaggacaggactctaatagtgactgtgtcaccaggatagagttgactggtgaccttcctccacatggtagcaccattgtacacatttgcaatttgaatgagacattgcacactcactcatcacagcttacctcctattgtatgtgaggagacactggatttccaatcagggggccatgactggagaaacatgagcaacaactgaagaaccttgggtccactaagaaaatagttgggtgttcactacagatgtacatctgacggccttgctgttccctgggtaccccagacttgttagaatgaaaatcaagttcttagcattctggcttctactcttcgggctcctcctttgatcccttcttccttcccagaaatcctgaactgctctctgatctcaacactccttgtttcttcctgcctccagccctatgcaaatccaatcatctcattttgccgtaactactggttttcatgactgtctctctcacaggaatgagctcttagaggccaaagactatctgtaattcatctctatatgaaaatacagagatgtttgccacatgttaagtgctttacaaattttctcttttcaatgagtgaatgaatgagtaaagaaaaaaaacaaatgaagtcctcggaaaaccaaaaagcaacagcttccttgaccagacatgaaatagaacatcgaactcagcttctcagaaccacatactctctcttttcatctttcatcactgccttgggtcaggtgctttggcaagaaaccaagaaaaaaaaaatatgtagacgtgtgcctgtggaagctgattttagaagatatgtttcagcaaattttggacaaagcctaaagggtacaggttcaaaatggatttttcacaaatgacctcaggggagaggtacttgggaagtttgaaggctagtcacattgcttgctataaaatccattcccaaaaactgcagttcctctgggaaaggcctggaaatgagatttttggccaaaattgacaaaccaatttctccttaccttgggaaaataaataaaaaattttcctgtgaaaagctgaaaccctcttccccgggaactttcggcccttgggaatcaaaagaaaaagagggaggtttcaagggggccccaggaacccttttttttgggggcatatacaaccacccccgaagtttccctgtgtatgacgggnnnnnnnnnnnnnnnnnnnncacatgttaagtgctttacagattttctcttttcaatgagtgaatgaatgagtaaagaaaaaaaacaaatgaagtcctcggaaaaccaaaaagcaacagcttccttgaccagacatgaaatagaacatcgaactcagcttctcagaaccacatactctctcttttcatctttcatcactgccttgggtcaggtgctttggcaagaaaccaagaaaaaaaaaatatgtagacgtgtgcctgtggaagctgattttagaagatatgtttcagcaaattttggacaaagcctaaagggtacaggttcaaaatggatttttcacaaatgacctcaggggagaggtacttgggaagtttgaaggctagtcacattgcttgctataaaatccattcccaaaaactgcagttcctctggaagtgctgagaatgagtcttagggcaaatagagaactaatttctcttactttggatataagagagtctccatggagagctgaaccttctccctggacttgcgttcttggaatcatagatagagtgagttagaagggcacagagagcattatgtggtccatcccaccccccagcttccctgatttcaggcaataataatatctccagaaatactgattttgtaattagtgtatgccaggcactgtgtgtatgcaacatcgtttaattctaacaaaactcctatgagataaattctgatgtactcccatttgctcgatattaaaactgaagcttagagtgattaagcaaactccttaacctctctgcacctgcgtgccctcatctgtaaactagacaagccatattaagtttacatgagttaatttttttaaactctagtatagtacctgaaggacagtctattttatgtaattttgttaaatagaaaaataaatacatgaatggatgagcagttggatagattaaagtagagtacctggaccatgatcaaagagccggtacctgtggaagccaagagtctaatgcaggccgtctgactcagatattgagtgtattaatacctgagtgtattaatacctctgtgttactatctagaccttaccagatgactggatgtgctccccaaaatcttaagggaagggtgcttccttttatatctcattctagtgttttctacctgaaacattctttcttgtaatttgctggacagtatctagttgaattttctttcattcctttttgcaaatataaaacccctggcttccaccttgtcagtgggtggatgggtaatgggagaaactcctccactgtctgcatcctgtctgtgccttttgtctaaccagccttcttacagcctgacccaagcagccagtggaatggaatggaagcaagttggagacacacacacacaacactgcctcaattatccttgcctgttcccttttaaatggaatggaagcaagttggagacayacacacacaacactgcctcaattatccttgcctgttcccttttagattctgcatctctctgacggttgactcctgaaactctattactctgtcttttaatgttgtcagcattaggaaaagagtgaccttgacaccttgctccttctactgaacttacagctttcctcacgatggtgcagaactaagtggttagtagagatacttgtggctggaaacatctcccctgaaaacagatataggaagaacaggtgnnnnnnnnnnnnnnnnnnnnatagaaaaataaatacatgaatggatgagcagttggatagattaaagtagagtacctggaccatgatcaaagagccggtacctgtggaagccaagagtctaatgcaggccgtctgactcagatattgagtgtattaatacctgagtgtattaatacctctgtgttactatctagaccttaccagatgactggatgtgctccccaaaatcttaagggaagggtgcttccttttatatctcattctagtgttttctacctgaaacattctttcttgtaatttgctggacagtatctagttgaattttctttcattcctttttgcaaatataaaacccctggcttccaccttgtcagtgggtrgatgggtaatgggagaaactcctccactgtctgcatcctgtctgtgccttttgtctaaccagccttcttacagcctgacccaagcagccagtggaatggaatggaagcaagttggagacacacacacacaacactgcctcaattatccttgcctgttcccttttagattctgcatctctctgacggttgactcctgaaactctattactctgtcttttaatgttgtcagcattaggaaaagagtgaccttgacaccttgctccttctactgaacttacagctttcctcacratggtgcagaactaagtggttagtagagatacttgtggctggaaacatctcccctgaaaacagatataggaagaacaggtgcaagttcccatgggcgcaaagaagttctgcaaatgtgcatgagcttactgtcactggaggaggtggaaacacaaaaggagagggctttgagtgctacatggggaccagtcctctccggtggggagacaaaggcagtgtggtttgactgcaaccccaaaacttcccaggctccatctgttcccaagagagcatttagcttgtgtsttcccagcaagaatgagtctgcttcaggaaagagatttaattgccccatttatcagctctggttcacaagatcacactgacaaagatcacggcctctttttaataggagaaactggcagcagaataaatatcatagagccactccttggaaaaacgacatttgatgcttcaccctacctaaaggatgcacatttcccagccttttactctcaagcccgctgcaagttcccctttgctttgtattccttctatttatatggcagaataactcactaaacagatttgaacacttctgcaatgctgcccagtttaagcctggggatgtaagaaaagaaacagaaacagaaaatatggattcaatgctcactacgtgctgcaggccacgaaaaatatcaaaaccataaaacatggtccctgatctccctccaggagattacaatatacttgagtaaattaaaaatgaaataagaaagtatttgaactacagttcagtacgctagtcaaagagggccacgaggcaggaaatgattaatttgaaaatgattggaacaggctgtaattggtaatgagaaatgtgcatttgctcttttttttttttttttttttttgaaattgaagtctgctttaccatgttgatttcctctaaaaagaggtattgtttgggcaaagggcagaaggaaatctttttatttacatcctgaaaagaatcgagatgatgtttcttatatcagactgccctccttacaggcttacaaacctggcttggtttgaggcaacaccgaaaggaagatgttctgrgaatctgatgagtcatagtgagaagacccatttttgtgtcctcccagactccaaagggtctgagcacggtggctcacgcctgtaatcctagcactttgggaggctgagccaggtgggttgcttgagcccaggagtttgagatcatcagcctgggcaagatggtgaaacctcgtctctactaaaaatacaaaaaattagcacagcatggtggcatgtgcctgtcgtcccaactacttcggaggctgaggtgggaggatcacctgagcccaggaagttgctactgtagtgagttatgatcgcaccactgcactccagcctgggcgactgtagtgagaccccatctcaacaaaacaaaacaaaatacctccaaagggaggggggacgtcaacagcacattgtatttycaaagggatggcattggtgtttttgtgagaagaggaagcagccgtgcaggtctgaggtacatggtgggcagagaaatctggatgagtttgagatagtgttggtggacagtgagatattatttcaaagtctcccatgactttgtgactgtgcgaaagcatgggaggctgttggaagaaaaggaattgaatcaagataccctcttctcatccctttacctacacaaccrattgatcagcacccatttttgtgggtgaggaactggaaagggatggatttcctatttttttaaaaaaaaactcattaacatgtatgcttttttttctggttaatacatttgagaactttaatgagtcacttagtctgtaaaaagaaaactaggaaaatctctgtccatcaaagtgaagaaaatgcaaggaggtttaccatctgtttgaagctgtcagtaagaaattaaagcccaaatgagcatgtgagttcaaatgtatgctacttaaatggtgtagtaatcaaagtaaaaatttttccatacaaaaactcatacattgaaaattcctggaaccatggcagaagcaaacccagaaactctctatagggatgtttctgtagcctagtgttcttgggagtcccatggggcttagagggaaaataattctgcagaagattagctcatggtcaaaagttacagacgtcacaaggaagtaacccaccatgagagtcagaacacacagcaaacagaggaatgagaatcccaagaactaaggtgggggtgggggggagtaatctgaaagactagaggtttaaaattattaaatatatgaaagttttaaaaacttttaaactttatataacaaactatataacaaaaggatgggatattatgataaaaagaacaggcagaactgtaaaagaaccaaatgaatatcacaattaaaataaataaaattaaaacataaagctaaatattaccaacaaaagaataaattaacgggaaaatacatctattggaaattacccaaatgcagcacagagasaaaaaagaatgcaaatattaaaacaaggtaaataacctagaggagagaatgaaaagttccacagtattttaaagttttcaggaaaaaaaaaaaaaaagatgggactattatataccattagggaattgcaaattgaaataatgagctagcactacatccctatgagagtggctaaaaccccaaacactaacactaacactgacaatgaaaagggtggtgaggacttggagcaacaggagctctctcattcattgttgatgggagtgcaaaatagtacagccactttggaagaaagtttggcagtttcctacaaagctgaaacacagacttactgtataatctagcaataatgctcctaggtatttacccaaatgaactgtaaaaactgtaccacactaatgcaagatgttaacagggaaaaccgaagggagcggggagaggtagtatatgggaactctctgtactttctgttcagtttttctgtaactataaaaccactctaaaaaaataaaatctattaactttttaaaaaagatatgatagggagaagtaatattcaaagccatagcaggtgaatttttgccagaactaaagttctaagtattcagattgaagaatcgtactaagtccagagccgaaccaataaaacaaacccacacctagacttcacaccaaagacaaagtgaaattctcaaaagcaactagagagaaaatatagattgcatagaaagtaacgacaattagatgattagccaacttttcaacaactgccatccagatcagaggaaaatttaacatctccaaaaggtcaaggaaaaataattgtcaactttgatttttatattcagccatatcattcaagagtgagaacaaaccaaaaacaatacatgctaatttcacataacttaaaaaaagaccaatattaaatcattttgattgacttcttcaaagagaattgatataaacatttggagtatttcgttaatttttctctgcatgtccccattacatcttagagatcatgtatatacatataaaatatagtcatacttttcatttagcatacacatcttccttgatttttactgtccttgaaagatcatttttaaaggctgaatcatagtctaagtgccatagtttagtgaattgctagacagtataattgctagacatatagatcagagaattttctcctaaatggcaacaggataaaatgcacataaaagagggacagaataattctaagcatgcctactcttttcttccccccattggaaaaaaccacctggttctttaattgcctactgaagttggggggtgggtatagtttagtttgcaaggggccattcagagccagctggatgtctcttttcaattaaagttttgtgccctaagtatgctgctcatgtgtgacttttctaagtaatcctgaatgttctaaagagagagagaaaaagaaacacacatatttgaggattgccataggccaggcactgtgttaggcattttcttcacaacagtaaatagtagcaaacatactgcttatgaaaacttactatgatctgggtcctttagggattttatacattctcatctcattcaatcctcatggcgactctaggaagtatgttctattattatgcctatttcacagacaggataactgtagctccgaggccatgcagctagcagatgatcaagtcagaattgcaatgaagtctttctattgtcacgttctgcccttttattcccatgtcttgttccaagcttgggtgggtattgggggcaggggtaagggaaagcaaggtcagaaaaacataataatgaccaaaawaaaaaaaaaaaaaaagacaaaactccaaaaaacaaaaccaggaactgtgctaagttatatatattatatatgtatataatatataatatatatacatattaatagagaataagtttgctatactctctctmtatatatatattatattctctatttttatatataaattttgtcctcactgcaacaatattaggtaggctatgtaatcattattatcttcactcaagaagtgagcaaatggaaacccagcaaactcagaaacttgtcttaaggttacatagctgtgagttgcacatcgtctgttccaaacccagaagcgtctgccccaaagtgcatgttctggtcctcactgcctgtgaatgttgtgatctgtccaggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcagggtcagtacaccgggtggctactttcttgcactgcaagcaggtttagaaaagcgcttgggttcttgatgtctcagtggggtctgcacttcctccccttaccagcctttcttgggcatgtcacaagagcatccagattttgtgcattcataagmcaggtgttgcaaacttagatgactaaggaaggcagaaaggaaacgggagtgggtgcagcaggcgggacatgagaaaaatagcacagatgacgtgaaacggcagctaaacctcagtatcaaagtgagagaacgatagggaatactgaggactgtggccaattgcatgatgtttacctcaccagtagcgtggcagccatcctcaactcctgctgagtattgtcttatgggaatgtagagtcaatattatcaggtcttctagttttttaaaaagagaaaatgtcatctgattttgttagaaacctttccatttttaaatattagtaactaattccatgtaaaaattttttggccgggcacggtggctcatgcctataatcccagcactttgggaggcccaggcgggcggatcacgaggtcaggagatcgagaccatcctggctaacacggtgagaccccccccttctctactaaaaacacaaaaaattagccgggcgcctgtagtcccagctaccccggaggctgaggcaggagaatggcgtgaacccgggaagcggagcttgcagtgagccaagatagcgccactgaactccagctccagcctgggtgaaagagcgagactccgtctcacaaaaaaataaaaacaaaaaataaaaaaaaatttaaaaacactgggccagacagagccagcctgtggctcccatcactagcacccaggtatgctgtataacactactaatgctgctatgcaagatgttacaatttgtgtatgcattgtaacagaacatgcccaacaaaacaaaatctacttgcaatgctatggaatatgtatacacatctaataaaacacaaagagcatgtggaatgcaatagcacatgaaaggaaacacaggtgtaaagtaacagaagaaaatgcacacgtatcaagcagaaaacaaagtttaccttcaactcaacataaacaacagcacaaaatacatatgtatctaccttcttatctatatgtccattcattcgtttcagccatctatgcatccatctatttatccactcatctctcttatttgcccaccttgtttttttgtttgtttttttgttttgtttgtgtttttttttgtttttgtttgtttttttgccttggaagaacttcattaattaggatttgaaaaatggtgaaaactctttggttaaaaacatctaattgcagcaaaccaacacagcacatgtayacatatgtaacaaacctgcacgttgtgcacatgtaccctagaacttaaagtataataataaaaataaataaataaaaatctaattttatatgctattgtttactgagaaagctaactaattgctttaaaacagatttgtatattcttaacatttgctagtttcaagaactgtggagattcggaaggtacacattagtttagtgaggaagatttattttctccattcacttgcactccaaactcgggttctgtgcaaatacatatttcctaattagcttgatggcatctaaacacatagattgcttaaaaataacaacgtacgtgcatagagctaggtattatgccaactttaagctaattctcccagccaattaccaaaggcttttcatatccaaatgattctgggattagcaccaaacaaatgcacactgttgcgtttacttctaaatcttgcttgtttttggaagagcatttcctctatctatctaaaacactgctaaggaagccaagttgatttatcaacattttaagaaatgaagtaaatccatatcttcctttccaaaggatgggaatggaaggcaaactgggcagcacagggcaggcattgttggtggagtcccttgatcatctagaatttgaactttggcctctccatccctaggggagaaggaccccaagttttatgggagcaatgtgcttttattgattgattgattgatttgatttgatttatttacttatttatttttttgagatggagtctccctctgttgcccaggctggagcgcagtggctcatttgtaagatttccacatccacagtctggatgctccagcagctctggaagcagtgatggcaggggcagatgttattttgtggcaggacaaacagccaaccacacattatatatagaaggagaccacagataagtttgcaggaatgcaggaaaggatgtaatgccagtgccctgagcctcagggggccttcaccaaccatgaagcctggggtggagaggatcagagaaagagcagctcaaacttgcaactgtaggcttttgtgtttacggttccttgaaggctggagtggagagactgtctactacaagaaaaatgtagcagtgaaaatgagttgaggctgtcacagttccgtgagcatccctgcagggtgagcttgtccccaccatgggggaccgatggagccaccattatcagagtccacagttaatcacacttactttcctgtagtttatgccaaagtcagcagccactgccaattctgccctacaaaccccttcatagtttggctccctgtcagccttgggaagaccaggtcaaatcctgcagccttgatctgactgtttcctgtaggtacggctgctgaaatctggggtaggagtggggagaagcaggggaagccacagatcaaaatgttccagacgtccttttgcctgttattgtggtaggaatcaagggctcttcccttgataacagttgaacagctacttttaagtgaacgtaaacagttgttttctaaaagaaagaaagagtagaaaatgagaagacatatagatggaggtgcttgtatttgggctgcccaggagcccttaagtcattcagttccctggatggatttaaaggyggtgtcactgtgtcatcagaactcttcactgtgactagtaactaaaacccagttctaactacattgaatagactcacacacaaacaaacacacaaggaatagattgagtcgattaagtaaaaaagttcaagggagtggctccaggggtttaaaccatgtctttctctatctcttgggctctacttttcactgcaatggcttcactgataggctcacacccccacatgatggtaagtctgcaactccttctatccaagcatccacatctatcccccnctcaaagagtatgatgagcctcacatgaatttcatgccttcctttagatgaatcaatgtgtgcatggagaagagattttctgattggccacttaggacacattctttgattgttagcttttgcataagagtaggggtaattccagaaaagaattaacaatggatgatcctttcatgctgactgtgtttgtcagtagttaactctctggtgcctaaactttcaaagatgatgctgggaaactttaatgaaagcttggattggtgacccgggtgctgggaggctcagttatctgttcttatatgccactttggagacactgaggcattgacagttgtatgagcatcggttgataccttttctcaaactccatgtgtgactctttgcaaaggtgtcagctaatcttgagccagagcaataagataaaccctatgctttgcaacttgtctcatacctttaagagacattatcaggattcagactgaattttgctgtttctccagggctcctgcaagaagtgcaaatctcacctttgcaggtaaagttcaagtgcaaagtggtttcatgttcactgctgctgctgctgacagtgctttatgttgctcccctacagggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttstggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtgcgattgacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctancctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagagacagagaggggaatacttatgcatggggagcctgttagcacagtgcctgccacaaaaacaagtgcccccgacaagatagttgctatgttatgacactttctcagatcaggattttctagtttaaaaattaaatatcataaaaccagcaaataatattaactaaaccttttatatagttctactctgttaattagtgtatttcatgtacatgaatatttttgaagtatttgggataactagccatcagtgtttgcagaagacctcagtctgttttgggccattacggaaacactaagctaatgtagactcgcctggccatttcctggtttcctcctgcattctgctttacattcttgaagaaagggataaagtggcaggttgaaaaattatcccatttcttctcctcatggtgtgcgttctgttttgtaagtattattttcttgcatgtgggcaagtgtcagggatgattcccttaaagctcaaggatgcatggaatagctccatctttgggaaagtacacctgacctacagtgttcctataatgaaaagtggttgcaataaatttcagggtcaatcatagggagacagagggaggcagtgggtgagaggagcttcctttcatttttgaaaggcagaaggggctgactaggtgctggggatgcatgtgcttgaaaatgacattttatttcccggatgctgtacctctgctgccccaagacccagccatggagaagcctggatcgaagggcccagaatagtcaccccaacatctgatcctaaatctgaatctccatgactgtgtagccttttagccctttctaccttctgcccttccagtgcattccagaccttaatccaccccagcaaggatcgcctccatttcctcatgagtctgggatgttttgacatgaatgaattaaaaagtcttcccagaatacagaagagtgatttgtcgtcaagccaaagaggctttctgtcttcctctggtgtcctctaaacccagggggctgccaaatgccacagagacctccagggagagtgagagttatacttggactgacttcatcggtcagaaagccttcccctaacagcagcattatttctgctattaaccccatacatctctggataaagaaactgaaaacgtggcctttggaagaatcaacagtaatgttgtgaaaaaaatatatattcttttcactgaccgaagtgttttttcaaataaataatcagaaatgttatgctacacaaagtttatggtatcccttctctactaattcaatgactcttcaatgtgatgatcccaagcaaaaaaaaaaaaaaaaaaaaaaaaatcaactactgatcagatggtcaatttctaaggaaaagatgtagagttattcaaaggtcatctaagtcagttcagtctttgcaaaaagaatatcaggaatgtaacgtccagtggtaaatggaacccacagtatgagaagtaacaagaattaaataggaagcctggaagcctgagactatagatctatcacagaagattcccgtaacatatcccagctctgagttcttagatttgttgatgtcaaggagcccaaatttctgaacacaaatgcctgagtttcagctggcttaagtcagagctggcatccataatgatattttgttaattctaattggttttccccacttgagaaggacccaactagtcctcagataggtacacttgaatgcaaacggttgggtctctgtccatgggtaatagcacgcacatgcaaccaatttaaaatactctgggtaagagagtcttctagagcataaactgtacttgagaaacctttgtgcttctggaaaatgggtttcatcatccttacatctgcaggttcttaggccacttatggtttcaatgctctgagctggcaagtccctataggtctatctttctgccagagagacttgcaggattataatctcacaatctcaccactcattactgttatgtcctctgcaaatctctctgcgttattttagccagcaccatgactgggcatccacggattactcttgattttctcttccctgattcacaggatgccagagagtctgagtatttagtttttctggtgaaagcattaaaattcacacattgcagcaaaatctgtcaaatcatttcacgcttattttctggggagaaaaatagaaaattacaccttgtttacaaatgaaatagtttcacttaaatgggactctagccaaggcagttaattagtcaaaagatccacagctgtcatatagtcacacattgtttattctatttgctatgtcgaccactgatgtgtatttaatattctgcatccttcacaggaaatgacaaatgccctgaattatttgcaaatagaattgctaatgaaaaagaaaaaaaatgttgatgttaattaaatggtgattaaaaatttatctcctttaaatctaaaaagtgcagctttaataatcagttgtcatataaataagtaccttgtactgaaatcccttgcggtttaagacctaaataaacactaatttgagaactctaaataccttacagaggagctggatatattcgttaacattatgcacattcctgtactgtttctttgtgcatagctgttgtgcatgaatccttgaaaaggggacatgcgttgtttctgaaatggagcctgtttgtattaaccatggctatagtagacatgattggactcaaagaaaaagaagtttgagtaggtggaagctaaatgtgttgcttgatatttaatgagtgaagggttctatgtaaaggcaattttccttccaaaagtactgtttattttcactggagacaaaattagacctttccagataccccatctctttttggtgaacagggttgaaagtgctgtggggtctatacttgaaaagttctcccaatatgcagttactgtttcccattcaatccctatacattgtactgtgttcatatctaattgtatcagatgaggtcagcttgccacttgatatagatcagagatgatcaaatgcacttatcctgtgaatacaactgcttgtgtacacatgtatataatatacatgcttgatttctacaattcacacgtaagtgtattatccaaataaaattgtacatattgtaaagtttatgttaaaaattaaatggtgatgatggtattaacacatggaaaacccattctggttatttttatgggaggatatttctgtagagagggcactatatttttttaatctcagttgtagggaggatgacagagcctaagtagaatatgggtgttggcgttcttggccccttctttaaaaaacaaaactctgggatgaggggtatagaatatattctgctcgcatttgcttctgaagacaatgccgatatggacttgtgtgtgatttccttaaacacatcaaagggcatagatttcctatttaaattccttatcctctttcctcacctgcactctttctgtgcccagcagtactttcagtatagtattagctagaagtgcctgcccagaagggtcttagaaaaatagagttcgtagaaccacaccaaaagttaggagaaggggaggagagatgagaaaaatgaagtttacaaatgggcagttgcctgtttaagatcatcaagttagagagtatcagagcgaggattagatccaagacatggttcaatttctggctcgattctctgaccgggctgacttatttctaggtttctttcaaggggaaactcctgagtagctctggaataagagccagagatccccataaggctgccctggtttttgttttgttttgttttttgtttttgccacttgccccagaaagacctacccatgcttctttgaatttggttttcctttaaactccctcacaatccctgtcttaaagttcctagaagagaaaacttttctcagagaccgtctccttaggaaaaatcaacagggatattgtttaaaacctcaaactgaagataaaaggctggcagtgaccattgaaataattgaggtctatgtatcatgcattgaggaagaaccaagcacattgaccagctaataggacttcactgaatgtccactttattttgaaagccagtttgggattgtgggggaggggatgcaaaataaatagaaaatatagtctcttcccataagtagcttatggtttagaagttcagttctctaatacaaaggataaccaaggacccatgcaatgcaaacagagactaaacagcaaaaattagaaatgacaactaaagttgtagccaggaaaaaaaaaataatctgattctatgagcataccttttttaaaaaaaaaaaaaaagtccttccctaaacctttaagtaactctggagaatagagttagtggtcccggaaatgcagttgatttattttaatcttcaaataatggacttaggagacccaggagctgctaaccaggtgaacacactcacactcctacatttttgcacaggaaggcttttgtctggttccaaccagttctccagtccttgccaaatcatgcctcctcccagccttgcattatgacatgtgcctcaagaaaaggttgaaaaaattccccaaaggattagaaaatagaccatgatgtaaaaagacgaagcatttccctaaagcttttttgtttggttttgtttttgacatttgaagaacccttctgatacaccagggtatgaatgtatcagggaagcatagagggaaaattctttatcaagttccaagtgcctactgctgtggctgacagaaagcatcaggttccctagagagaaaacggggcaaagagatggcaaaaggaatagaggtgtatttcaggaaggatggcgaggtggagagggagcttttgtcactctgtctatcccattctgtgcattcttggaatgttacattttctgcttatcgcaagtacttgccatggatctgcacctgaatttgaaaatatcaaaatatatctaaattgagtgtaggcgatattctaggcatatcctagaatgtgatcctcaaaacaaccttaagatataaatatgattgctcccattttacagataaggaaactgaggctcaggtttttctcaacctcgtcagcaactagaattagctagtaaatccctaacgttagacatattttcaaagtgcctggtctcctccagggaggtcagaatagaagtcagaaagagaggtgtgctcttttgaggttcctgggcatatacccttgagtatcagcctctgtgacagggaagtctgttagggtcttacccctcattgcctgatctgtgtgtatggagaacttctggggatctcacctctgttcatagttccttctgagacttgaacactgtttgtgtctccctttcatatgcttgcacttagcatttaaaaaaatttctggggagttattttctctacttagcatgtgcctaatcktaaatatctctttcctaatgtctcatctttttatcagtcaacatcagggctaattccattaaacatatatacatagtacatgctctcatgtgtgtgggtatgcacacacacacacacagccatgtgaccctccattaaagtcctcctaaatattgtgacccatgttcaaagaggtgatattatttgcaagttgactattcctcctatttcatgtctatgtttggttatctttgccaggcagatggaatgagtttcagaggtgggacagggaataggaaatagagtttctgcatgaatgatggagagctttggtagtcagaatgattgaggaccagctattaaaatgttgttgttgttttccttcttggtctgttcctttttttttttcttttccaaattgtcttagagataattcccggctcacttagcattaggataatgacggttattctgtcccactgaagagtgttgaactggaacgcttccaccgggctttataggtacccagaatggcctaatgtttaacatatcctgcaggcatgcccctgagcacacactgcctttcctgcattcccccctctccatggtctaagccacatttctttcctggcatttatatttactgagaggtgaggggtgcattaggcccatttgatggatgaggacactagcggggatttgaaggaatgtctttctgggagtctccatgaattctctggagagttagctaacttaatgcaagttaagtgctagtctatgagaaaaatttctcagctgttttcatctttcaagctggcagtaaaaagccttttaagacagaaagattattatttgttatttggagatcctgttgttgggtctacaagtgcgtgaccatgttctccttggaatgttgagctatgcagaaatggagcactccaaagaacgatttgaccaatagcatttcttctctgggggttgtatttcaaagcatgcaactctccagggaaccagaactaaattgcttaaaatgaagtcattcctcagattaacttcctcagataaagtgtcagcggtctgcagaaacgaagaagacaaaactgagattatcactcataattctcttacttactatgtcagtgaaacaatgagtttgcatttttgcaatcctagaacattcttcattagccctgggtcatgacctcttccagttaattctctttcacacctttaggaaagatttaagatgaaccttcaataggatattaacataactcatagccaataccacagctgcctttcaaattaatgaggttaattgttctccagcaaacatgagtttgtctttggcattttaaatgcttcccattgatctgacattttgctgtttcaagttttaaagggctcaaatcaaagactattgataactgagcaaagagcgaagatccagaaatacgaaaacattgtctttttttttccatgaaaaacaatcatagccttttgaattcaatcgaagtttctacattagccatctaagacttatttaattatttctgttctcagtcaagctaattcaagtgaatgaacagtattgacttttaaaatcttttttaaatttttttaaatctttagtttattaagtttgtagm

SEQ ID NO: 10553 - DNA, 318752 bp, Homo sapiens
  misc_feature (1)...(318752): n = A,T,C or G, or insertion/deletion polymorphism (see Tables 1-2)
cccccacacatatatgcacctcaaaaatggggaaaaagtctatttgccttcatatgatgttatctggcatgatgctgactcagttcctaacctccagtcatgtaagtttcagaatccagagtcaacttccaattttcataagtacttcaaaaaatggaaatttttccagttgagtataaagcataactcctcaaacaattggcaccaataattcctcaacatctctagaactctcaaatctactcaaacatgcaacccctccccaggtagggctgggaggaggggctagttttagtttgggggttaatttccccctgacttgcctatgctgtttcccagtgatcattttttaactttcccagaggggtaaaatggtatacattaataaaaatgtcaasaatattatctctgggaggtaacctggaataattcacaataaattaacacttcccatcagagggacattgcagcttataagaatgtcactttgtgagaagygggagtcctgaagccatgtgatttccatctacagtttttaagcccattcagagtctaccaggggataattacttgctaagatgtaaccatcccagcagaatgtatttattatgattcagttctatccacatcctcagtatcacagcatgaaggaaactctggtctggtgaataaagccctagagggataagaaatgccaatccttaacacatggctgtatgaccttgggctattcacttaacctctctgattcctcagtttcatagtctgtagagtgacacctctgcttatcctgaggagaatgtgtggaggaatctctagatttttacctgaaagtctctagaagcctatttgcctagaaaagaaattatttctatattagtttctcaccctgcactctcaatataacataactctgttaagaacagaattaaaatatcaggcagatgcatcttgaactaaatttagggggctgagctactaaagtaacagaaggatctcaccattgaggagtctacctacaacagaccaaagacaaaccattttggcaagtcttcaggggcctgtagacacttgaagaataaaattattaccacccacaattcccagggagcaggccttcaggaagacagggatgtcagtggttattgtgattgtttcccaacctccatatctctctccctcattgtgtatcaatcatgtaatttggtggtggtgggaagactgaccctacactaaactgcacagatgggtcataatcctggtcccctatgtcatggctactggttcaggtaattcaggcctaagcatggcattacctggccacaagattggatcatgaatagtcacatgattcactgccaactaatacaagatgatgtgacatagatatgaagccaagaaatcctacagccattttgccatcttcagggaaacagaaaggagagaggaaaagaaattaggtttttgatgaaattgttgaaatattgagtctaatgaattctcaagtcagccatacctttggcccttccagttatgtgagccaatgtgtctcccttagtgtttatatcagttttagtggatttgttcttgtctgcagcatgaagtattctaactgatataggaccattcaaagcatggtcactaaccctgagggtgcttaaaggaggtggtgtgaaagtgtttagtccagagaggaaggtgttggaagagaggtacaaaaaataccaggtcatttccaattaattgctcctccaaatggctcctggggatgtcttcagggaaaacatggagttctaaatacccttatgtataaaaagcaagctaatctgaaaatgatttaggataaacaattgctcccatagccactactcacttggtgtaactgtctccttctagaagtttcggtggatcgatttctggacatattaaatccaaattaataaggtttttcctctgactcatagatacacttccaacagaagcaactccaactaggcctgtgtctgaaattttagcttctcagggatgtagatttatttaacaacatggaggccaacacttagatagaagatttccacagaggtttctggaggggtgatataatggagaaaatggaactatagagaagtaggtcagaggacctaagctttcttagaagtcatacccaacctgaatctccagatatggctaaactctctattcttcccaaataatctggaagtgacagtgcaaaagatggccacaaagaatcagttgtatctagcttagttcctttattagagtctaggctaaagtttggacagtttttctaaccccaaaataatctcacctcatggaatcataggatgatcaaacataaaagcaagacgggtacttagaaaccactttgttctatcttgtgtttgtaagggtttgggataagggaagtaccttgtttcagatagttaaacaccatcctctgtgctgccatggtacctggtgcttaccattttcagagcacttgccatattgcattgtcattgccagtgaatacatctgctcctcctttgaacttgacattcatgaaaagcagaaactgttccttgcttccttacattcctggtgcttagcaaagtctgcctatagtaggtggtcaataaatgttgaagaaatcaaagtatcaagtcaaatggttagaaaattatgctcccattaggcaaaggatatagtatcttggtttcattttcttcgaagggtatagcagtttccttccaatgaaataggatgatttctgttgttgttttcctgatttttatgaagttggcaagtatgaggctcactgtacggtatagatcacctcttagaattccactggccaacagttctttatgcttatccaagtgcacctctcaagcctgaaacaagcacaaagctcatgaagagaagtacactttttactttttgataaaaactgcaatggttattttcttgctatttaaactatatcatagagctcatttaaaagtacagatcataggtactaaggctagcaggtaatcctaaattcagcagggatactcttaaccacagagggagagctaggtttggggctttgttggcaacttctggtggctatgatgctgctagtataatctctaacccctcgttggaaaatcaaagttgaagtttataaagtgtctccctgctcttttgggtgaggaatcgattgctaaagaatttgcatgtattatacaggcttttcaaccaacagcaatatgcttagtctaccactgtgcccctgctggctcagatgagagtagtccaactctgccaacagctgccactgacagctaaaaattgaaagagtggcagcagataaaagagaggggaaaaaggtattgggcaggggaggatgacaatggaagggatgggtggcatttacattcatgacttcgagggttttcaagtgcataggcaccaaaatacttttctgcctctcatctttagttactgagccaccctcatcactcttcaagccaaatgacagtgaagatggccacagatcttttcttccacctcctcttacngctggccaagcatggmtggggacgtggctactttcaggagtgaagtgagacatgctgaaagtcactttctcctcgtacaaaatatattgttcactcacatgaaatcaaaactaaaacctcctcattaaagttgttcctttgggacaaggcattgaaggctcctattaaaatgcaactgtgttatctaaaaggagaaacacctagtgcctggcacagagtaaaggttctttaaatgtgacatttttaatattaaattgtcattgcctgccattagaatcttagtaaagattgtctcccgggccttttgaggagccacaatggaaagattttaatgtggaacattggcatagacttgatagcagagtctgaagttatgtggaatatgaggagagaggaggatgacagcatgaggaaacttgggggacaagagggcacttttactaggtgagaaagagggaagggagtttggaaattaacatttattgatttttctctgaggcaggcactgaattagatgctttcatatcaattatcttacttaattttcacaactgccttataaagaaagatattaatattcccattttgaagatgagagaactggggttcagattaacaaagttgttcaaggtcacacactgcctgtatgtgatgggacttagactcgaacctggacgtgtatgcctcctaagcccatgttcccgaataatgctatgtccctgtctacatttggcaggggatgaccaaccttacctctgctacccgctttgccctaatgcttcttccactgaaaagatgagtctcctcagactctcatgtttctccttcactcctgtccatgaaatatcaaaatggagacaaaagatttctatgagtggtgggtgggaggaaattatgcattatcagaatgaatagaaatttgggaagagcctaggacaatttttctggtttgaagccattttgttccattgttccaggctccagactacgtctcgccaaatccaaagttctgtagcaactgatatactagctgggctccagggtccttctatcccctgtatattcccaattttatccccgatgtatatcagttcgctttacactggcaggagagttcatgttccacttagaccaggaggagaggatatgaaaaggaaaatagcaggtgtggggaggataaaacccatgccttctacagtaactgtaaagtaaaagtgaaaaacgtgagagataaagaggattctttttcctcattgcgggagaaaggggctagggagaggagtctatagcccaggaggttcatccgcagcatgctatggagaaggccaccgtcactgaaatccggtctgtactgtaggacttcataggttctttgctcgccttagagcagaggggaagaagagtcagaaagaattgataacctctgaggtcatcagtcaggggcctaggctgctaagtccagaggcaacaccaagggatcaatgcagctaggtacagttttctccagcctcaactttcaatccccaccccmagaccagctcattcccacacctccctcctccttggtcagtgagcctgagcgtccttttcattaaccttttagttactacctctacgcacatactttttcctatgccctccaaagaagtcagccccatactgcccatcactgctcagcaccgcccaccccatgcccccgcaagccggcctcagcactagtttaaggggagggacacgcctcccaaagctgcggggatggggktgggggttgctcactcgccctcggatctctgctgtaaaagcggagcggcagagaccgggcatgcgcagcatcttcgggcgcattgtgatgggaactgcttctctgagtctctacaaagactccggagtaaccactaatggccctcctaaggccccccttctttaagacagacacacaaacacagaggcaatgcagctatttttttttaaagggtgggaggacgttgcagcttgaaaggttgatccacgttaggagtggtgtatttctattgatcccatctccggtgttgacaaacgccagcgcctaggctttgcagtccggggctgcagtttgcagtagagctaagcggtgtgcggctttaattccacgtcagatcaactttgatcaatatccccctactggcccaattggaagagcccaattcaccggcactgagccttttcgctctttcctttttttccccccctctttagacctaccatcttttgcgggggggggggggcgcggagagagtctcagattgtcttgataatttattctttcgttctctttcttttgcttctctatttttgtttttcagtgttttgcttgttttgttctgttttaggattttattctctctctctctctctctctctctctctctctctctctctatcatagggacagaaatcgctttggcaaacccagcttgcagccaatgaacccgccttccagattggtgtgaagacagaagtgaggtggggggaagggagggggtgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaaraaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtcygtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagnggatgggggtaacatactctgcaagaaatatgacagttgtcagctttaagaaaattttagctgaagatacagatccttatatgaacrtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggnaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagamgatagaattccataactttgggggagactaataaacatgcttatccagatgatttccctgtcaacttcttagattgagactgcaaaataaatttgaaggacctttcataaaaccatctatcttcantgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagartggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtggragagaagctatctctccagctgtaagtttcctttccctgggatggtatgtggaatgccacgtttaagaggtaacatccctctcaccgtcactaaatagtatctctggaggtatttggaagygtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggnatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactsctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaarccccgtgtctactaaaaayacaaaaattagccaggtgtggtggtgtrtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtggrccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaamagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaraggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaattttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacayacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctarggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtggggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagaygttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcrtggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggakaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggttggtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcargggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtrttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctgggggscagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaacwgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgccmaggctggagtgcagtggcgcgatctcggctcactgcaagctccgcctccyaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgatarcattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttaraacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgyttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccartaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgmacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtctgaactttccstgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgsctggcctcagtgatgccttctggtattaaggatccattcaaaagcagatgtctaaatctgaggttttatgacaatgcctcaccatatccaaaatcattcactstcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaaactatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcktcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctagaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccacttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaagcaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacatragcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcntatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctnccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcaagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaargaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccacgcctgactcctgagtcccaatgcttaaccatattatctcgatataaaagrgcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcrtgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcrtgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatctcccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgakccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcrggtrgatcacctgaggtcgggagttcgagaccagcctgaccaacatggagaaacctcgtctctactaaatatacaaaaattagccgggcatggtggcrcatgcctgtattcccagctacttgggaggctgaggtaagagaattgcttgaacctgggaggcrgaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaytaagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaasctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctcygcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatcygcctgccttggcctcccraagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgttttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtyactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttrgtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgckattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccatwgttgaaaaagaacgcctcccccatcaaaaattttatctggtctaaaatgtatgaagtaaaagcagcttagtctaagtagagagaggcttaaattggaaagtattggaaaattaatcctgtcagaaactgtaattatccccatttcatagatgagatagctaaagtccaagtgctttttcatacagcagtttaaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgmtcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaamtcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctacaaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagarttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggmttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccrtgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttcttyctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggagaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaasaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaangcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaanaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggtygttgtgagagtttaacaagataatgcctctaaagcctttatcatcaagctgaacacagtaacaccccatgctcaatganttttagctcttattattttattaccattatggaacagtggtcctcaatagagagtgagggtaattttcccccntcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcractccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaataaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacaraaatgattcattaacacgtattttatatgctatatctattatatactgtattcttacaataaagtgagctagagaaaagaaaatgtcattaagaaaatcataaagaagagaaaatatrtttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacayccatttgtcaaacaggtagaaaggttaaaggtacactgcatggatctagggcagaaggagcctagtgactttctcagcatcatcatgttctaattaaatgaactaaccaccactgggctcttgaaagtatcctagaactangaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcatttkcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaaktgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctngctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagasaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatmtggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggaygtccacacagaaaccccatctgaaggtcaycaacarcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaycagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccgrcatttgattggtgtacctcaaagtgacagggasaatggaaccaagttggaaaacactattcaggatactatccaggagaacttccccaacctagcaagacaggccaacattcaaattcaggaaatacagagaacaccacaaagwtactcctcgmgaagagcaaccccaagacacataatcatcagaytcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacrrtattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaagcargggttgcagtcctagtctctgataaaacagactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaacyctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcartgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcrggccaatatccctgatgaacrtcgatrcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacragcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacakaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagyattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgwtcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacragtgggagttgaacaatgagaacacatggacacagaaaggggaacatcacacgctggggcctttcagggtctggggcactaggggagggatagcattaggagaaatacmtaatgtagatgatgagttgatgagtgcagcaaatcaccatggcacgtgtatacctatgtaacaaacctgcacgttctgcwcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttaaaggttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttatcgcacatttgagcccccagaatcagagtcgtgcttcacactacctatcataacaaatggcatggaggggttctttatgttacaggttactgagttggatatttaaatagcacattcggaagtgttctgagatatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataartaagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacratattgattcttcctatccatgagtatggaatgtttttccrtttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctytggggctgagactatggaattttctagatataggatcatgtcatctgccaacagggatagtttgacttcctctcttcctatttggatgccctttatttmtttctcttgcctgattgccctggccagaacttccaatactatgctgaataggagtggtgagagaaggcatccttgtcttgtgctgattttcaagggggaatgcttctcactttttcccattcagtatgarattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgarggattagtttttmgatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcatgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacactaagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagctctcttctgtatgaccttgagacagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaaraatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttactcatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttaggnaaaaaaaaatgatttcaaaaggagcgggtgatatcagggatttagtaaaagtgacagtctccttgggctgctccagggtcagtacacatttagccagttgcctccattttaacttctacagtcctgggtaatgaatacccagwatrttcagaaagatgaccctgagacattgtaatatccttgggcaccaaaaaagattctgcaatattcagttggttatatttatcaaggaagaaaagtgggcttacatattttatagaaactttcaatggcatttcaataacaaccaccaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagaytttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaacccygtytctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcaraatagctggtactaattagancgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacmttagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactrggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttaytcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggyacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccagdcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttctycctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagwtctctagggcaagggcaaaatgccaccagtctctttgytaamacataacaagagtcacctttgmtccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgctyccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagamtcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacayccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcmgctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacaygttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgnccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttyccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcrtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatagagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcnaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagaggacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcntagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtgctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggkttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgrtactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacraatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcrgctcactgcaacrtcyrcctccygggttcaagtgaytctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcrgcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacamaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttkgtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttmtaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagcygagatcgtgccactgcactccagcctgggtgacggagyaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctcwcwcacacacacacacacacacacacacayacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctyaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatayctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacatyggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccmttttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccatyaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtyaaagatcagatggttgtagatgtgtggtrttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatgnggatggcattgaatctataaattaccttgggcartatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaatacygcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtctkgctctgtcgcccaggctggagtgcaatggcgctatctcggctcactggaagctccgcctcccgggttcacgccattctcctgcctcagcctcccgagcagctgggactataggcgcccgccaccatgcccggctaattttttttrtatttttagtagagacggggtttcaccgtgttagccaggatggtctcsatctcctgaccttgtgatccgcccgcctcggcctcccaaagtgctggtaktacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattayagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagayrsagtctcactctgtcrcccaggctggagtgcagtggcatgatctcagytcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaatyaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaaygtgcaggtttgttacatatgtatacatgtgccatgttggtgtgctgcacccattaactygtcatttagcattaggtatatctcctactgctatccctccccctccccccaccccacaacaggcccyggtgtgtgaygttccccttcctgtgtccatgtgttctcattgttcaattcccacctatgagtgagaayatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcaytgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctargttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctytaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctactatgaaatacacaatacattgttgttaactataattaccctactctgctattgaacaagagaacttttcccttctatctaactgtatgtttatactcattaaccagcctctcttcatcctgccccctctctcacccttcccagcccctactaavtatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtrcatgtgcaggtttgttatataggtaaacttgtatcacaggagtttgttttgtaaattattttgtcacccaggtactaagcctaggacccaatagtwattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggycaacatggtgaaaccccgtctytactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgygtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagtaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatgrtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaycacgcccggstaatttttttgtatttttagtagagacgaagtttcaccatgttagccaggatggtctcgatctcctgacctcgtgatcctcctgccttggcctcccaaagtgctgggatyacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatrtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttytacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccrtggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacrccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacrtacaacttcccacaatcatgatcctntcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacatyatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcarcgagtagatgtgtcccggagaggaagtgctggagactgcttagcaaatcctgctgtgccctggagtcaaggaattgatattgagagagctctgaaaatggtaaagaccacaatgggttmttggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagangggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctcyatggcttagctctcttgtctgttacctgtctgtagctgagtgtgggttaaataagagggaaagctcatccctgtcactgtagtagctggcaaatgtgtaamcctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattrtataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaangagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttcngttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccncggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacmaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgataycttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagcnccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgctyttatatgtaatttaatcctcacaacacgcctctggggaaggtgycattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcacygcaamctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacancagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaayatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcntaagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtctttkgtgatttcagaagtacttcaaactaggaatggccttctttgggaatctgttcttttgatgaatgttcctgggaatcagacaacaaaaagtcctgctttatccatctggccaygtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaaygtgcaggtttgttacataggtatacatgtgccatgttggtttgctgcaccaatcaacacgtcatttacgttaggcatttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggtttccagcttcatccatgtccctgcaaaggacrtgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgrccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcytccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcagttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgntggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattmatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggrtcacctgaggtcaggatttcaagaccagcctggccaacrtggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagascaaaactcagtcycaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcrtgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagaganaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatascatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactayatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggsgtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgngtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacntgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctactncattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattncttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacragctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccmgggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctctyatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacrtcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgatycatctttagctattcctttgtggcctgcagattcaacaacttcaatatgcacaatttagagctgccsttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtnagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaancttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaaggtcctggggcagaaacaatcctggaatgtttaaaggaaggaagaaaaccactgtggctgaagaatagtagcctacattagaattatagtgatggagactgngtgaaggaatcagatttatgattcattttsgaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttamacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcrcaatctcagctcactgaaacctctgcctcctgggttcaagcaattatcctgcctcagcytcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgantctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatcncatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatayaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagayaaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttraagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctstgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcntacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaacncttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggaygtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacatanggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttytaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatrgcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctytcagtttctctcttctaagttctttacgattcaacatggcttccttctgcagtttgactatttatcttcactgaataaaggtgatagytgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggacctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcrtgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccmaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggcttkggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacaygtatgtttattgcgacactattcacaatagcaaagacttggaaccaacccaaatgtccatcaatgatagactggattaagaaaatgtggcacatatacaccatggaatactaygcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacrtatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacamaaacttctcctccatacccaattaatgtgtccaccattaggctatcattcctttagctgtggtttgatcctrtgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttaygatgggttttcttacttaaagatggcttaatcaaagtccatatagcagagtttctcaaccttagcaccnttgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactragaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacacygttctcagtgctggggagtaagcagtgaaaaaacaatagctactgcacccacctcacagggctgctgtggggtttaaatgagatggtgtgtgttaaatcaccctggcacccagaaagctttatgsaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtangaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaaytgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatrtaatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaanaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctcncctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcracctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaakaaagaaagaaagaaagaaagagagaraaagaaagaaaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttrcaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcmtccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactsartgarcaaggcmtcttrgacaarytgaaaaacaaatggtggtacgayaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaamaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcarttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatgrcttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcatttggcccttggcacatgaggctgatccccattgatcagaagtggcaaaagtgttgtccaagtgctggattcacctttttgcctaatttcatctagcattgaagcaaatgtttttcaaaatatatacctaaggcaatggcattcatatatatatatatatatatatatatatatatgactatttgtatgtcctgtctaacatcactgctggaagggcagatgtgatgtgtagatgctagaatgtatgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacbtgtaatcccagsactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagcmgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagcattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagactttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggcaaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggggtacggttaaggtctagtaaactaatcagctttactttactgtatgtcaatctctttttttcttctttttttttttttttagtttggtttattgttcaaagcattgtctctttgcaaccatttgattctttgaaaacaatggttgtgctttcttgtcaggcagtggtgcttttctaatagaatggttgtaattaaattgtggtctgtgacccaaaaggaaatacaattctccagaacatcattgttcaatagaaaatatatgcaagccacatacatgagccacgtgtgcaattttaaatgttctagtagtcatatgttaaaaagtaaaacaagtgaaattaattttaatgatacattttatttaacccaatatatccaaaatatgatcctttcaacatgttatcaatacaaaaaaaagaatgacaaattttacattcttcacgctaatcttgcaaatctggggtatattttatgcttatggtacatcttgactcatactagttacatatcaaatgttcagtagtcacacatggccagtggttattgtattggacaatgcatctctagagaaagcagctgctctggaacagatattaaaattaggggccgggcacggtggctcacgcctgtaatcccagcactttgggaggctgaggcgggtggatcacgcagtcaggagatcgagaccatcttggctaacacggtgaaascctgtctstactaaaaatacaaaaaattaggcgggcatagtggcaggcgcctgtagtcccagctactcgggaggctgaggcaggagaatggcgtgaacctgggaggtggagcttgcagtgagccgagatmgygccactgcactccagcctgggtgacagtgtgagactccatctcaaaaaaaaaaaattargtacacaggtgaaacactgccacctcaagtaatacagcacttccatagggagaggtggttcttttaagtaaasagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcctatctgaagtggaacagaacaataagcaacttcataccccttattttaggcaattttgacctcatgagtaaatgtcaatatgctgggatttctacaagtgcatttgtgttttgttgttgttgttgttgttgttttgttttggggtttttttggggggtgttctgttttgttttgtttttgaggcggaatttcactctatcgcccaggctggagtgcagtgacgcgatctcagctcattgcaacctccacatcccgggttcaagcgattctcccgcctcascctcccaagtagctgggattacaggcacttgccaccatgcccagctaatttttttctatttttagtagagacagagtttcaccatgttggccaggctggtctccaactcttgacttcaagtgatccgcctgcgtcagcctcccaaagtgctgggattacaggcgtgagccaccatgcccggctgcatttgtgttttggccttcttatagttcacactgtggatttacatttagccaatttttaaataatatttcattcaaataaatcatttgtcttggtcatggaaaacataattttgtccagtgaagttgctggttgttccttcttcctgccttttgccacaacatattcagcacactgcaccaatccgctgacagtgttcccattgcattggtggatgtacaatacatggattcatctgtaattgcattgtttgcatgcaagcatttaatgtttcaatgtgcttaaaatgttttactcttgagtaggtgccataggcccattacaatttggggcatatgtttttataggataatattaatacatgattcataatccattttcaaagtgatccactttctttctgtagcctacacatagacaggcttgctggacatgagcaatttcaatctaacttaattatcccaaattttgaggtgctggcctccaaataaataatacacctgaaatttgtgtagcagtcatccaagtgttctcacatctattggctcatttgagataagatggatcaggcaattatcagtaagacccagcccatgaagtgacttactcaaggcaacacagttaggtagtggcagttctgggactagaacccagcccttcttctgcctatagccatatctttgctaaaccatgctacttctaaccacccatggcctgatgtcccccaggaaacttgaaatcctaatgggatcctgtcaaatggagagcagatcttgagtttctgttccacttgtccacaaaaaaagtcttgagaaacttcaccaagcctccatatgccccattccttatgcactccacacaagattgaatattcaatcactcctactttccccagaaagaatctttctgaaacaggattacatcaaggctcagggtcacatgacctccagactctttatcaacgattccatctgagaatttatgtccctactatccaattactatagcctcagactcttattaaagccccagagcagtattcatcaaacattagtgtgcatgcaactcatgtgggaaccttctaaaaatatagatcctgatccagcaggtctgggatggggcctgagggtctagatttctcacaaactcccaggtcatgcagatgctgctggtcccaggagtagaaagattctagagaaaataaactcagagaatgtaacttaagaaaagaaaggaaggaagaaaagagggatagagatacaggaagaaagaggaagaaaggaaggagggaaggaaggaaggatggaggcagggaggcagggaggggggaaaagaaagaaagagggaaggaaggagggaaggaaggaaggaaagaagaaagggagggagggagggagggaggaactgaaaggaaatgaaaggaaagaaactgggatcagcaaacctttgttaggacataatgttgccatccaaaagtggcggcctggaacatcaaacctgaggggaaagtctcagaaactaatatgccacaacttctggctttcctttactcatctgagttgatccacttttgtgaagcaaaattcaggctacttgaggcaacactcacattttaatagactcccatgccagtgtggttatagcccaattacctagcaccttggcaaccatctccagggtgaaagaaaggttgggaagagcatctgcaaacaaatctgtcctccaagcctgtacaaagtctccagacaagaagcaaaagcctcatacgacgccaggaaaacctcacttgtgttagtcaagaggcataaagcaagctgctttgaaacctctctgttgtcctcagccaatttggtgatgtgattaggggaatgttggttaagtgaagagtgagatcttcacccactcatcttttatttcccaagaaggtctggaatatctcctggtgacttctaatttgttacctagttattaggcttccagttctctgagttggcctaaatctgtcaaggtctatccaggggcaccgacatcaagaggtaccctgagattttacttctattactaattatcagagcccaccttgggagtttatagtaccagtaattgttcaggaaaaatgactcagggcaaatcacctgcaaaaatgtgatctagtgaaatctggttaataaaagggcatccttgaaagatgagggagtcgtttctcattttctatgggtgatagtcacatcaggattactgggcttattgtgggaacatgtgcctcggcctcagatcatgtttagctcccactagggagcagaaagcctcttgactacctggtgcctctctgggttactgaccagccactggaagtgtatcctcccaagcatgccttggcaggtgactgcccatcaagtgctccagattcactgcaccctagggttgactgtgctaattgttttaggaagttatttctcatttcctaattgcagttcagaagtacttctggcttctttggtttcttcaaaaatatttttgaaatctctgtcctttacaagacctcaacatgcctgaagttaggggaaaagattttcatttttcttgtaggagttttctgtttagtcatcctaaaaatattagctttgtggatgcagcccattttcaaagtgatccactttccttctgtagcctatgcataggcatgcttactggagacattttgctgctgaaaagaattcacgttatgttaagtatgaaaaaaaaaagcattctggataaccaaggtgatgatgttctttctcccaagggacttttacatcagtgataatagttcatttgaccccatttaaaagtggaaacagaggcactgagaggttgggttcctttcccaaagtcatgccactagttagtgatgtcccatgcccactggggagacagggggagactttattctttctgccagatacaaaacttctccaagcttctgcgatacatatgactcaggacttaggggtgccaaggaagaggtttgtctactttcatgttagtcttattctaccatccttggatgcttttggccttcaggtgcatatttgacattcttcttacagatacttttactacagggccagtggtagatcataattacgtcattcttttgggataaaattcggtgttagcttagaagaaaaggaagtgtttcattagtgcagaatgaaaggataaagagagggatgtaaacttgaagaggaggtaagaaagtgtcctacagtattcagaatcaggggcaaatgaatcccctgcactagttagtgcctccaaaaagaagacactatcagcatttcaatcaggcctatatgtcagggcaaagaccgcattgatgccaagtccccttcatgggtatcactgctctggcctcttcctagaatctgctgtctctttaaagtcccagagctattttcagactttaataactaaggttgtaggtactaagagaaacaattgctcacttttctagcaataagcaaaatattttcttctcacagttaaaatggatttcaattcagtaagccatagaacactgtttaccctctgtcctgggtgaacaatcctttgtcatagtttctgcaatcagaatacactcttttagttcttgtgaatatctgtattaaaatgccatggaaactttctggtatacctacatcataagtgattaaagccttgaattaaacttcctgcaacacctgcatattccttagtacaatacatatagtagagaatgtaaccagacctgtcacctaaagccagtcaaataaatgaggtgcaaccccagaaatgccaatttcagaaaacagccatagttttgtccaagatagactgagccattataaacttctcaattcctaataggaagccccttcaaatttaaatatccccttgcctttgcagatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcrtaatttgcatgtgtgggcataaactacagagcctcattgccatgaggtattgtacaaagttttaatacattttgtaaataaaattgtaaagaaagaattctgtttctgtgctttggctagatgtttaaaatttacttggatgcagatgccaagaagttattcactaactgacttcccctagaagctttgccaatgatgtaacagtcaccttactggtgactttcacaaaggattactcctctccccaccccaactgcaactgtagtcaggcgcagacccctagcttaagcaaaaccatacatccaagaacttagattagtttaactttaggatcttccattcccattctttgtctcctccaccctttgggactcctttccagaggcctgccttggctctaaacttgatcttcaattctcccatctccacaactgacctcccacagaagtacctaaattcaagattattgaccttcaaaaacacttccaattactttcctatgccatcataacatatatgtcctagtactcttaattgcttagctaagttttgtgctgctgcttcaattaccaataataattcctaactggaaaacgtttattccaccaaggatcactaatctagagtgggagaagaaataatgaatttagaactatactgattttagaatagttctgacagagaaatgaaaagctaattatctagtctgatttgtagattctgaacacgtaatacaactttatccaacaaataaagcaagtgtttaaatgtacaccagcttatatcataatcaccttagagaacagaggataatgataggaggaaaggagaggggataatctgcaactgaaccaaaaaagaaggaaagtgcagctgagatgctagagagatcaaggaaaaaagatatctggggttagggagttaggaagcaaggaacgcaagagcttaaagaagaagaaaaatgggagtgggaaaggaagactgagaaaattctgaagtgaaggctgatataatcacactgtggacagcttggcttactgtaggcatcatcataattactaccattttcactgtgctctgaaatgctaaatagctgttaaaccactcacacttcataactcttcaactgctttttaaaattaagacacctgttgcagtcctaccagaagacaattgattctccggagcaagttcagtgactagattagagtgatgaaatcagttcaagtaccaaacaatgtccctggatcctccaaaacaatagatttatgttttaacagccacttcaattccttacccctaaaggagaagctaatctcagttgctgtcacagataatggagcactattttggtgtaggtgggattttggggtttttttctccttggaagaaggaggaaacaaagggggctgcttttagtatttctcaaattggactataagtagttagatattttgcttatacatagagtcaaccttaccaatcaggtcttcaaaaaggccttgtatttcaaatgccacactctccctgtgcacaaaagaagaattcctcttggtctctgcatcagtattcttgccctgttaagactcacatctgatcacactcagtcaacagaacaatcttcaaacaggaaggacaaatgtatttaaggaaaccttagtaagatcatggcagaaatgttgcaggaaatcgtctccctcctgttggatgagggaaagggtcaactgtgacttcagaagatgaacgtagaggagaacaaattgagaagcaagaagcaaaaccattattcctcagaattcagactcaatcaagcaaaagatgcattaatatgctatctcacaagggtcagaaaccatttgtaacacaaacactaccaaaacctactgttactgagagagttactttcaaaacctgagctttttagcgactctgaaccatacccctccccttttgtcctcactctgttggactgaggttcctgggaccaatttattatcagatcacttggcagacatgaaactcagcagctgaggtgtgggagttctgtgcactcccacagctgaattcagattctctcttaggagagaatggtgggttgcactaagaattaatgaaacctgcctccagaactaaaagtgctatgaagtgctaggagacttcctgcacacctaagatcaagaatcatagactagccatttacattcggtgaaaacatggggcactcagattttctcaaaaggtttccagggagagcattgttgtcaggagaagattgagggaggctttagggggttgatcactgtcccaaacctactgccatatactcaacctcctcaatgctgagggttcacaaattcattcaaatgggcaagattccccaagttctctgacagccattgttattgtaaccatatgtcacctgcacaggatggttgtgagagggcatacactctctgcttctctttgccagatgaggaaggagcaatcttggcccctaccctcagagggcttacagtcttggtacaaggtagatgatgactgaaaagaatctgcattcatttatgtatattgctctgctcagagaaaatacttttaaaagcccaaaaggaagactttccctttgccccttcacttggacttgctcttcctaatacaatcgggggtgggggagttgactaaatttttcttcgtgcccaaaagctgtgagcctttgcaattgaggagtcataccgggaccctgaaagcatatagctgctgagaacctcagaatgaccactttcttgccagcctttccaccttctgagcaggaggtatttgcttatttgttgattcacaatgccctagctataaacatgtaaaagaacctacaatgacaacctaagaaaaatcctctccccatgtcagcagctttggaaaacttaccccaggagtggtttcactgagcttcaatcctatagcaaaatggttgatttacaattttcctaataaatattcattaagcctgaacaagtcaattaaagctctggtggcagctcacacgaggcttgaatataagcagacagaaggaaacaacttctataaatattcccaaataacattacagtcttcccccatgagagtgcaagagtttatctgaaagattgaaaaccctctctgaacccagtgaaggcctctaaggtccacatttcctcccatttactgtacagcttcagaaaagcttgttgcatcctcagtctccacttcctcaattattgcaatatggtttctaccaccaccactgtacaggaacttctcttgacaaggtcatcaataaactgcaatccatactttatagcaagggttggcaaactttggcacacaggctaaatccagcccaccactggtttttgttaataaagttttactggaacacagccacagccattcacttatgtattttccgtggcttcattcactctgcagtggcagagttgactagttgcaacagtattgcccaaagtctaaaatatttactaacttgctctttacagaaagtttcccgatcactactttaccctacttgatagccattattttattttatctctttccagaatttgatgccattaacctcctccagtttggaaatctctattatttttacttccatgacagcactctttactgggtttcctcttaccctgctactgataatttttcttctgcttcctggtctcctcttctatctcttaatgtcaatgttctcccaagttctaccacatttccccctttctttacactccatattctcttcttgtgtgctatcccatggtttccatctccacttacattatgatgtgtttcaagtttttatttctatctcaaaactctctcgtgagctccgaacaagtataattaaatgtctataggagcccccctcacttggattatgctataagcatgtcaaacttgacatctccaacacagaaactattgtgtgttctcttgccctcgccccactgctaaaccagagctccctataagaatccctctcttgatttaaaacaccattgatggggagtcaaattaaatataaaaataaaactaatggactttaaaattggtggatatgacaatctgaaaaaaacagacttgcactcaaaagcagaagccacagtacaatgacaatggaaaagcagatgggttagtttaacaccaacttgtatagctataagatgtagtgaaaagtaagcatatggttctttgtatattttggatcgccaaatcataatatgatttgcactcttgcggaggaaaaccatctagggttatcaccaaggaaggaatgtgcaagccctgagcatgctagccaagggtcccaaatcactccccagaacaaagcaatacaaggaggtggttatggtcactctgagggagatattagatgaaacctgggtggaatcaaaaaaggaacaggtggggagtttgcatgttcagtttatatatacccaagcatatgtatttctgtaagtgttcagagaactctaagcaacccatgttttagatttttttttttttttttaccttttgctatggactgaactgtgtctcctccaaaatttgtatgttgtactctaatccccaatatgactggattggagatagggcttttaggaggtaattaaggtaaaatgaggtcttaagggtggggtaccaatctgataggattggtggccttataagaaaaggaagagacagagatctctcagtccacatgcatgcatggaggaaaggctatgtgagcacacagcaagaaagtggccatctacaagtcaggaagagaaccctcaccagaacttgaccagtctcacaccctgatgttgaacttccagcctccagtactgtgagaaaattaatttctgttgtttaagccactcagtctgtggtattttgttatggtggctagagaagactaaaataccctttccactgtcacagagagttgggtcatacaggcacaatggtgggagaggggatcaatcaccactgtaaatccagtcaccaaattcagaagcctggaaatcaactctgcctgctccctccctcattcttatcttgaatcaagttccaatgattcaatctctctgatatctctgaaatccatctacttatatgagtccctaccttagtttgaacttataacagtttctatgtggcctaatataatatcctcttagctgtccctcttgtttccaggtttttgtccctccaattcatgctccacactgcaaccagagtgacttttcctgatctcatcactcctcagcattagtgggtccctattgctctttggcacaagagtaagctcttttttattattatttatgtgtttaattttggttttagagagacagggtttttctctgttgcccagggtggagtgcaaaggcatcatcatagctcactgtagccttgaactcctgggcccaagcgatcctcccacctcagcctcctgagtaacaaggaccatgcctggctaattttttttaacttttttagttaaaaactaagtcatactatattccccaggctggtcttgaactcttagcctcaagcaatcctcctgctttggcctctcaaattgttaggattacaggcatgagccaccagctctttattttaccataaaagttgcttataatctgccacctgccaatttcttcacccttgttgctattcactaagacctagtcatatgcaactttttatttttattttttgtttcaaactcattttaggttcagggagtacatgtgcggtttttctatgtagttaaattgcatgtcatttttaacattaagggtttggtgtacagattcttttgtcacccacataataagcatagtaagtgatagttttttgaccctgatcctcctcccaccctccaccctcaagtaggacccagtgtctattgttcccttctttgtgtctatgtgtactcaatgtttagctcccttcgtaagtgagaacatatggtatttggttttctattcctgcattaatttgtttagtataacggcatccagctccatccatattgctgtaaa

SEQ ID NO: 10554 - DNA, 79377 bp, Homo sapiens
  misc_feature (1)...(79377): n = A,T,C or G, or insertion/deletion polymorphism (see Tables 1-2)
acccgtaattccccagggagatagtactcctaatttcacactgggtttgcatcgtgtgtgtacactctgggacattatgcattatattctggggagatatttctcctaatatcacagtgggtgcgcaccatgtgtggtcacccactgtgacattagcagtaatatctactgtgatattatttgtaatatcctaggaggatgttatttctaatgtcacaggttatgtacccctttttgatactatcagtaacattttagggatatgttactcctaatgtcacagggggtgtacaccctttgatattattcttaatatcccagggggatgttactcctaatgtcacagggtgtgtataccctgttatattatttgtaatattttagggtgatgttactcctaatatcacagggggtgtataccctgtgatattattcataatattgtaggggaattttaatcctaatattacagagggtgtacaccctgtgatattatttgtaatctcctagggtgatgttactcctaatgtcacagggcatgtaaacctgtgatattattcttaatatcttagggggatgttaattcttagggggatgtcacaggggatgtacaccctgtggtattattcctgatattctaaagagatgtgttcctaatgtcacagggggtgtccaccatgtatgtacaccctgtgatattattcgtcttatccttggaagatgttacacctaatgtcacagtgggtgtacaccatgtgtgtacattccctgtgatattattcctaatatcctctggggattttactcctaggatgttactcacaggatgtacactctgtgatattattgatcatattctagagaaatgttacccctaatgtcacagtggttgtacaccatgtgtgtacaccttgtgatattattcatcatgccctagggggatgttacttctaatgtcacagtgggtgtataccacgtgtgtacttcttgtgatagtattcataatatcctagggtaatattacttctcttgtcacagtgggagtacaccatgtgatattattcataatatcttagggggatgttactcctgatttcacaatggatgtacatcctgtgatattattattatttattttttattttgagatggcatctcgctctgttacccaggctggggtgcagtggcacaatctcggctcactgcaagttccacctcccaggttcacaccattctcctgcctcagcctcccgagtagcagggattacaggcacccaccaccatgcctggctaatttttttgtatttttagtagagacggggttttaccgtgttagccaggatggtatcaatctcctgacctcatgatccacccgcttagcctcccaaagtgctgggattacaagcatgagccaccacgcccggcctgtgatatcatttttaatatattaagggggatattactcctaatgtcacagtgggtgtacaccctgtgatatatttcataatatcctatggagatattactcctaatgtcacactgggtatacaccttgtgatattatgcataatattctagaaggatattaatcctaatatcacaggaggtgtacacactgtgatatcacttgtagtattctagggggatattacttctaacttcacaggggatgtatgccctgtgatattattcggaatatcctagggagatattactcttaatgtcacagaaagtgtacaccgtgtgtacaccctgtgatattattcctaatatcctagggagatatcactgctaatgtcacagggggtttacaccatgtgtgtacaccctgtgatattattcctaatatcctagtgagatattactcctaatgtcacaggaggtgtacaccgtgtgtggacactctgtgacattcataatatccaagggagacattacttctaatgtcacagagatgtacatcatatgtggacaccctgtgatattattcataatattctagggagatattactcctaatgtcacagggggtgcgatatggatatttcattaatatcctactgtgttaacactagatattataaatgtcatggatactttcttaatggcatagtgtgttagcaccctgtgataacattagatattatgaatatcatagatatattattagtatcacatgtgttaatactacatagtataaatatcatggatattttattaataccatagtgtgttaacactggatattttattaatatcatagtgtgttaacactagatataaatatcatggaaattttattaatgtcatagtttgttaacactgtgtgtaaacagtagatattataaatgtcagatattttgttaatatcatagcattttaacactagatattatacatatcatagatattttattaatatagtgtgttaacactaaatattacaaatgccatagatattttattaatactatagtgttttaccactagatattataaatgtcttggatagtttattaatttcatagtgtgttacctctagatattataattatcatggctatcttattaatatccatgatattaattcctgaatattatgcatattttattaatatcattgtgtttttacactagatattataaatgtcatggatattttattaatatcatagtgtgttaacatttgatattataaataccatgtatattttattagtatcatactgtgttaacactaaatattataaatgtcatagatattttattaatagcatagtgtgttaaccctgtgtgttaagactatatattataaatatggatattttattaatatcatagtgagttaacagtgtgtattaacactagctactataaatatcatagatattttattaatatcttaatgttttaacactagatattttcaatatcatagatattttttaatattatagtgtgttaacactgtatgttaacactagatattataaatatagatattttattaatcattgtgtgtttacattagttattataaatattatagatattttatgaatattatagcatgttaacacagtgtgctaactttagatattataaatatcatagatattttattaatatcataatgtattaaccctgtgtgttagcactagatattatatttatcatagctattttatgaatatcatagtgtgtttacactgtatgttaacacaagatcgtgtaaatagcatacatattttcttaatatcatagtgtgtcatgactagatatgataaatataaagatattttcttaatatcatagtgtgttaacactgtaaacactagatattataaatatcatagatagtttgttaatagtgtgttaacactagatatcacaaatatagacattttattgatatcatagtgtgttaacactagatattataaatatagagattttattaatatcattgtgtgttaacaccatgtgttagcactagatattataaatatagagattttattaatatcacagtgtgttaacactagaatttgtagctgtgttagtttactaatatcacattgtgttaacactagatattataaatatcatagatatttgttaacatcatagtgtggtaacactgtgtgttaacacttgatattattataaatattttagatattttattaatatcatagtgtgttatatatgacaatatctagatatatgctatatatgtatgaattatctctggaaaaatctgataatattagttatatctgaggaggctacaagaagccaaggatgatgagaaaccctaaatttcactttatacttgttgatgttacacaaaaaaccttttttcccctcgcctccccctacacttcctccaaaataatattttaccataaccatttagtgcttaaaaaaatactcgaaactttttcgtccatttcttggctgccttctgtgtgtagtcccctcctgtatgtgacgtcccatcttagaagatcctgagaggtaagggttgtgaacgtcgggaggaccagggcccacttgcttttctgatcccacgctagaagatgtgggtgtgatgccttccttaaaggttttctgtggaaatgaaataaatgagtctatgtaaagcacaagaacattgaagatgcttactaaatgttatttatcttcatttttgctgccttggtcctctcatacccactcgtgattttaggcgattgggggaaaattgctattgaacatcatactctactaacaaagaccatttgagagttagattcatctctttcccagttcaacagcagaaagaagccccacaaatcaagcactcctcttgttctgtaccttgtcactttgttgctactctcaccagccaaagagggaggaaaatttcttggtgtaattaaaatattgttataggctgggtggtggtggtagggtgggggtggggggctcgtgcctgtaatcccagcactttgggaggccaagacgggacgatcgcttgaggccaggagtttgagaccaggctgggcaacatagtgagacccccatctctacaaaaaaaaaaaaaaattagccaggcatgatgacatccatctgtagtcccagttactcgggaggctgaggcaggaggatcacttgagcccaagggtttaaggctgcagtgagctacgatcatgcaactgcactccagcctgggcaacagagcaagactgtctctctgaaaacaaaaaattgttatagaatgtagagttaataacttttctggaacaagaaagctctcgttttagatacccattcattcactcattcaatagtgtgctggatgccaggaatttaatggtgagcaaaatagacgtggtctctgcctcctgatgctcaagatccctccctctatttttaaaaatcaggtttattgaagtataattgatgtacagtaaattttactctttttagtggaaacttctataggtttccactaaatgtgtaaccaacacaattaagatctagaacatactgtctcgcccctcccgattttcttgtgttcctttggagccaacaactctcccccaacctctagaccctggcaaccactgatctgtcctctgtccgtatggatttgtcttttccagaatgtcatatacatggactaatacacagtgtcatcttttgagcctagctgcttccacatagcttaaaatttgagattcatttgtgctgttttgagtagtattgctgagtggtattccatggtaccaatgaaccttgtttttttattggagacagtcttgctctgccacccaggctggagtgcagtggtgcgatcacagctcactgcagcctccacctcctggactcaagccatcctcctgcctcagcctcctgagtagctgggaccacaggtgccagccactgtgcccagctcgttttaaaattcttttgtagagatggggtctcaataagttgcccaggctagtctcctatactagtaactcctgtacttgagtgatcctctggccacagccttccaaggtgctgaaatgacaggcatgagctaccatgcctcacctcagatggaccattttgatgccatgttggggacaaagaaagaaagaaaacaactcgctttgaccaaattgtccctgagctgatgaattcactgggtaaactacattaattttcctcccgcccagttgtaataggaagataaaatgtcacttcttgcaaccgaatctgtggattatgaaactcacattcactttgctgattattgtttttgtctttttgttttggacaatatggctgcagctggcctgtaagtgagcaaaggccccgctaagagtccctctccccaggctttatgacaccagtgctgagtcatagaggttctgctagtccccaagagaagcactttcacctttcctggtgatgcctttggctccttgagctgagttttgcccgagtggggctcatgagggaggatggagtttcttgggactactcagaccgccagttactgtggtcccaagaaatgctgtggcttgacctcactgccagctrtacaggcgccagtgatccaggaatgctatcagccctactacctgcccgggtaccgctacctcaattcatggaggcctagcctcttctacaagatagccaacgtccagacctgcccggacgagagcaccagtaccctgcggccgcccaccatcctgcccacactgcgctccgcactcttctctcgctatagcccccacgactgggaccagtccaaccagctgcaggtgcgtggggccgaggcctccmggctgtgggccagccggctgacggatgactccatgaggctcttgcaggacaaggaccagctgacgcaccagatgcaggagggcacctgccggaacctgggccagaggctgtcggacattggcttctggaagtcagagctgagctatgagctggacagscttctgactgagaaccagaacttggagacggtcaagaggcggctggagtgcgcggccaatgaggtgaactgcccattgcaggtgagtacaggggtggggacagggctgtggctgtgtcmtggggatactgcacgctcattcygcttcccttgactgaagatgaaggtggcaggcaccttgcaggtcggtttgagctgcatcatcgaatacgatcagtaatacaatcttagtcaattcaggataatcccagtcaaatcagggtttcttggactgartagaatttccttttctccttgaagctacatcaaagttgcaggggtttcatgaaaatattgtgtgcatacttatgcatgcctgagcatgtgtgtgttctggtccttaaagcacatgcttaaaataactgacttatttatttattttttacacasagtctccctctgtcacccaagctggagtgcagtggctcgatcttggctcgctgcgacttccgcctcctgggttcaagcgactctcgtgcctcagcctcctgaggagctgggattacaggtgcccgccaccatggccagctaatttttgtatttttagtgaagacagggttttgctatgttggccaggctggtctcgatctgatcttcccgccttgacctcctagagtgctgggattgcaggcatgggccactgtgcctggcccataactgccttatttttccccgtaatacttaycatttaacatgctctatacttgattgaatattagaatacagtatagtctccatcaaggtagagatttttgcctgctttgtcactgatgtattcaagactgctattcagtgcagggcacctgtatgtctgtgtgggtccgtagtgaccaatgtcggtgctgactggtattgtttacactaatgttttgaatgtattcccagcctaggacagggcgaagcacagagtaggcattcaataaatacatgctgaataaatgagtaaatatctaaatgtgactgggcacagwggcttacacctgtaatcccagcactttgtgaggccagggcaggtggatcacctgaggtcaggagtttgagaccagcctggtcaacatgatgaaaccccatttctactaaaaatacaaaattagctgggtatggtggcacatgtctgtaatcccagctacttgggaggctgaagcataagaatctcttgaacccaggaggcggaggttgcagtgagctgagattgcgccactgcactccagcctgtgccacaaagcaagactccatctcaaaaaacaaaacaaacaaacaaacaacaaacaaaaactaaatgtggacattcctaacacttccttggtctcctagcctccagttgtctccctgctcagttaggatagtttttagccgcatgtaacaaatactccacgatagtggtttagccaaacaggaatttatttttctgtcatgaggaaaattccagagggagacagatcaggcggctccagcctcaacttggtgccagaagggacccaggctcctctctctgttctgccacccacagcatgtggtttgtgttctcctgttcccaaggaggttttgcattttatactgcaagttcctgcatgccaggggcctcttgatattctcattcgaggcaggaaggcaagggtagaacaaagagcagaagcatcaatgggcaccattgctttttatcagggaatgtcttttctagaaggtccgtcgtgtgtctccatgtttagcctattagccagcactctcatggaccctggatgcaaaggggtctggataagtgaatgtttctcaccacgtccaggagaaaatcatggaaggggttgagtggacactgggtaaggaaccagcagcacctatgggaactgactttggccacagaggaagatgatcggctgctccctggagtgtgtggggaactcaggacctcttgcctggaagcctcctgcagctacaggggcttccgtaggagagatcctgcctccggatctccctgggagacatggcataggtttctatcactctaggatgtccaaatccatggaatgcagggagcagattctatacaaccccagattctccctgggaagaatgatgggcagggcagcttttcagagccctacagcagtatcccagacctactgctctccctcccattctcttctcactcccccatcctgtctggaaagtccagctttgcctggtcacatttggctttctctgatcagccatgtggtggcagggggaccatcgacatctcaattctatctcctaggctgcccccacaatccaggcagcctctccctgcgcaatgtaagccacctggtctcccaattcctgctcccttccaatccattgtccttacagcagccactggttcccttgatggcctcccagaaattaacaacctttttttttttttttttgagatggagtctcgctctgttgcccaggctggagtgcagtggtgcgatctcggctcactgcaagctccgcctcccgggtccacgccattctcctgcctcagcatcccgagtagctgggactacaggcgcccgccactatgccccgctaatcttttgtagttttagtagagatagggtttcaccgtgttagccaggatggtcttgatctcttgacctcgtgatccrcccacctcagcctcccaaagtgctgggattacaggcgtgagccaccgtgtctggtcccccagaaattaacatcttaattccggaattcctccacccctccccataacccctgtccccgctattgctstagactcgcttcctctattccagggccaatggcttcctgtctgtttctctgctgacctcagggcctttgcacctgctgttttcccttgtggtgcattcctgcccagctctgcatctctgcttctcatgacacagttcttctcctccttagagaattcctccctgaccactccgctggttactcctcacccactcacctcaccctgaatattttcctcttggcccttcacacagttggaaatgattgagttcctggtttgttgatgttgtttgagacagggtctttgtctgttgctcaggctggagtgcagtggcatgattttggctcattagttgacctcctggagttaagagatcctccgacctcagcctcctgaggagctgggactataggcatgcaccaccatggctggctaattttaaaattttttgtagagatggggtctcactatgctgcccaggctgagcttaagtaatcctcccaccttggcttcccaaagtgttgagattaaaggcatgaaggaggcrctgtgcccagcctgactgagtttcttatgggtgttctctcccctagtagaacacaggctgtgtgagagcagggactctcagcctggttcgttgtgctatccccagcacctcagcagagcatgtctcacagaaggggctccggaaatccttgtggcacgggtcagtgaccccctcccatttctgagttctcacatacatttgcatcctgacatccagaccttgacatcctgcttccttctgctcctgggccctttgtgacatcacgggctggtttgctaatcactgctgtttgtcagcttcccatcatagagcgcccctgaaaagccccttgtcctgtcctctcttctgctctgcccaggtctgcatgagagttgtaaggcccagggctaggtggcagggttgtcctgaccacttccccaaactgtccctccactgggagatctgcaaagaggggttttcatgcatattcacaggtaatatttaggggcagtgttctcagtgatttacacttgtcaagccgacttcacctgcacaatgaacctgtgagataggcaccaatatggcacscatctgcagaggaggaaaccagcagagaggttaagcagtttgcccaaatgcacacaataggaagtggtcaagccccgattgaagtcagaagagaagctacatggaagatggcmgccaacactgtcttatctgaaattattatgaagttttattctatgtattattgtattgtgggaaggcttggggctgctgatgcaattatgggaatcaaaattggttcttgggatgctactttatcctgttttctctacatgggccttgcatctccggatgccttggtcatatgacaacccacagctctcatccggggagaaggggaggcagaagcccatccaatgcccagtagygaggtcacatgaagcacccaggtttccgggagaaaggaacagattgtggcaagggtggatgtgagtcccttctgctcagggtctacatacagctacaggaagaataygttctttctgctgcttcccacaggtggccttggagtgtctgtaccatcgagagaagaggattgggattgatttggtccatgacaacgtggagaaaaaccttatccgggtaaggcatctcctkgttctgcccagccccctgaaggaggcgggaaggccagcaggtcagagaaattactgagctacctgtcaggagcagaagccacacgtgtcactgtgtggaaagtgagggctcaggaagcatrggtggaggyctrgtttgcaatttaggaacagggagtaatggagttatttgaccctcagtcttttcatctccaaaatgggcatgataataatataccaataacaataataaaagctagcgtttattgagcacctactatatgtcataggctgtaccacatcatatgcattatttaatgtaatgataatctataagtgagtgcttggcacatggtaggtgctaaattttcttttattctgggagtctataaaaagaaagtagggcaaaaaaaaaaaaaaaaaaaaaggtggagcctccacaatcaacccttagctgcctggccctggggtcacgtggattgaggcggggccccacgctgacatttcacctcctggggtcgagggtggtcagtgagaggggaggggagagctgagggctctggcctgggagagaagactgtgaggttctaagaggcactgctctttctgacatttttcatttcaggaagtggatttgctaaaatgttgccaagaacagatgagaaaattagctcaaagaattgatatccagatgcggtaagggctttttttttttttaattccctctccttggggtttgttttaggactctcagatttctgggggacaagccagatgggcccacttgtctctgggtggttcttttggtcagtggtatgctggtaaatgttcaacaaccagccttctaggaaaaaaaaaaagagtcctgatcatagtatctgccagtttcgctggtgtaaatgttaccacagtggctgattttaagctgctaatatgatgttactgagatgtgtacaactgactctcacaacccgtgcatcgctggtttctcttgtttacagcgagagccctggccagaggcaactggcctccctgaggcccctcttagcctgtggcttccccatttgagttctgaaccttgggagatgacagagggtgggtggtattaggtagcaaggccaggggctgggcacctccacaagggagctggtggacgcattgagccagaagtcttcaaacaaaatcagctttttgttcttacaagattatgtaaccagtatcccgacaagcctgggggcccctcacataattaaagggagacttaagttttacggggcttggggcccatagtgaagcccttggtaccagctcccccgaaagcagccgcctcacctccacctgcagctggcactcacctttgactctttcagggcacgctgctctgctggtttttccacttcattccctcttgacacagagacacagaaagcacgggacagcctggcaacctggcaatggctgtccctcccgctgcctggtgcacatgggcagttggcgtggatgcagggggggcgggcaccttccaaatcagccctgggagcacatatcttggtttgctgtgccccagaacccacctcctcctctaggagcccttggatcccccgaaggggttagttctgggtgttagggagaaagacatcgcaggcaagctacccatagagcaawgagcttggtcacggacagacacattggagacccctagaaagacatcggggtggaggtgtacagagaagatgcaaatatagcaggagggatgatggctgaaaggacacaaacagagttgaagttcaataatttgtgtgcccctgttctaatttctcacaattccacctatcaccgggactattgttacctatagtttgtctataaattgattcacttaaaaaaaccttaagcacaacagggtgactacagtcaacaataatttattgcacatttaaaaataacttaaagagtataaatgggaatgtttgtaacacaaagaaatgataaatgctggaggggatggataccccagttaccctgatgtgattgttacaaattgcatgcctgtatcaaaatatctcaggtaccccacaaatatatacacctactatgtacccttaaaggcttaaaaaataaaataaaataaataaaaatcaattcagtaaataaaatcccttaaatgttcatatttatttgtttatttatttgtttgagacgaagtctcattctgctgcccagactggagtgcagtggtatgggctcagctcactgcaacctccacctcccagattcatgcgtttctcctgcctcagcctcccsagtagctgggattacaggcccatgccaccacactcagctattttatgtatttttagtagagacagtgttttgccatgttggccaggctggtctsraactcctgacctcaggtgatctgcccacctcaggctcccacagtgctgagtgctgagattataggcatgagtcactgcgcctggcctaaatactcttatttaaacaggcaaattttaacaaagggagaattgggacaggccagtgtctttgttttattgcatttttcttacacttatttttttaattacttattcatttttaattgacaaaagtggtatatgctgtacatataaaacatgatgttctgaaattacgtgtgtatttcaaaacattgaactaattggaactaattaacatatatgttacctcacatacttattttttgtgatgagaacacttaaaagctcagtgattttcaagaacacagtacattgttgttaactatggtcaccatgtctctggaacttattcctcctgacgaactgaaatttgtaccctttgaccaccatctccccaataccccacccccagcctctggtaacaaccattctactctgtgcttttatttgttcgcttgttttagattccacatacatgtgtgatcatgagatatttgtctttctgtgcctgacttattttactttacattatatcctataggcttatccatgttgtcacaaatgacaggattttcttctttttttaaggctgagtagtattctgttgtgtatacatgccaccttttctttatccattcatctgttatgagatacttaggttgatttcgtatcttggctatcgtaaattgtgccgcaataactttgtccattttaaaactgggttgttttcttgctattgagttgtctgagttctttacatattttggatagtaaccccttatcagaggtgtagtttgcaaatatcttctcccatttctgcggttgtctcttcagtctcttgtttgtttcgtttgctgtgcagaagctttttcgtttgatgtaatctcatttgtctatttttgctttgatttcatgtgctattggggtcgttgtccagaccaatgtcatggaacttttcccctatgttttcttctagtagttttacagtttcaggtgttacattttagtctttaatctatttttttttttttttgagatggagtctccctctgtcacccaggctggagtgcagtggtgcaatctcagctcactgcaacctcctcctcctgggttcaagtgattctcctgcttcggcctcctgagtagcaggggttacatgtgcctgccaccatgcccagctaatctttaatctattttgagttgatttttgtctgcagtgtgagatagggctctaacttattcttcggcatgtacctttccacttgtatcaataccatttgttgaagaagctgtcctttatccactgtatgttcttggcatctttgctgaaaatcaattgactgtaaatgcctggatttatttctgggctctctattctgttctttcttccagttatttttgtgatcttctatttatggcaagagagaatggttttccatttgtagctgcgatgggatgtgaaaaaccgtggcgctggtggggacaggagggctgacrtttgggaagtgggatagtttgagccggcagagtgaactaatcccagacttgaagtggggagctggacctcagaggagaaatcctgagactgggatcaggaggccgcttgtgcaaccccagatgatgcaaccagaggtggggggatctgggagaaccaggaagactgagacagatggagacagtcccagagactgagagacacagagagagagatgagcactgacatcaaaagagacagagacatgaagagataaacagagaygggtggggagtagggagacagacggacagagaggcacagagtcagatatgccagaagtatctggcaagagatgagatagagacagagaaaggcaaagagaaggagagagacagatatggagaaagaggaaaagaggctgggcgtggaggctcatgtctgtaatcccagcactttgggaggccgaggtgggtggatcacttgcggtcaggagttcgagaccagtctggccaaaatggtgaaaccccgtctctactaaaaacacaaaattagctgggtggtgacacatgtctctaatcccagctactcagggggctgaggcaggataatcgcttgaacccaagaggcggaggttgtagtgagccaagatcgtgccactgcactccagtccgggccacagagcaagactgtctcaaaaaaagagagagagagagaaagagagagggagatgcttgagcttggatagagaccgagagagatgagagcaactgaggcagacagcaggagagagagaaagcaagcacagagtgagtgaggaagaggatgagagcaggtcagggcagcatttcactttgtggagactggaggccgagccaygccggatggaggctgtttgtcgctgggcagtggctgtgtgtcagatgactcctgccatctcacagcttgtgctgccagagggattggggttatactaattaaccgagagccagccagagcctcattagccaggcagagtctggtgtgtcctcacccccttggggaagctctgccactgacctgctcaggtggccaacaccaggctcttggctcatggttttctgcgaagyctgaggcccgcatctgggcagggtggggtccttgctgcaccaggtgagaaaaggctcttcctgatagagaaggagccacgtttggtcttttcctggtgggctgacagcagggtgagcttggcattggtctggcccttggttgtgggccgagtagggaggacaggactgcctcctctttccctaggcctcatgacaagggccaggcagctggacacgctggactctgaggcccccaggtttccctctaattctctaacatgtttgctttccacatcctggcctcgcttcactttccagctcattaggcaggacagggccccacttctccaggactctgccaatttggaaaccccaagggccccgggactggggttcctcctgctctgacatgacccgagcttcctgataggtgggaaccgccaccactgtgaggatttcacttcctggctcctggcctgctgggaacccctcacccgcaaccaacatccacagcaggaaaaaaaaaaaaaaagatggaggggagggagggagagacccacagagacacacagaggctcagacagagagaaaccaagaaagagacaaaggttagagagacagagacatagacacaagaagggagggagagagaaaggcagagagacagatagagaacagatacactcggtttagctggtgtctgacataccctcacttaatggaagttactcccttctctactctaacaattcttctaaacacttcaaggcaaaagtttcagctgctgcttatgtgtctgtaccatcaactgatctctttttttttcagccaacagggaaacagaaaaaggtccaggcttagaaccttctggaggaaatagattctagctaggatttagcgagtgcctacgtagtattaatatttaggtctgaggtgatcttctattaatggaaagggtgatgggtttttctttaaagacagggatgtaaattttccttttatcatacatttatttacatttttaaagtgattttaggccaggtgcggtggcttacgcctataatcccagcactttgggaagccaaggcaggcggatcgcctgaggtcaggagttcaagaccagcctggctaacatgatgaaaccccatctctactaaaaaaacacaaaaatcagccaggagtggtggcgggtgcctgtaatcccagctactagggagactgaggtaggagaaccccttgaacccaggaggcggaagttgcagtgagctgagatcgtgccactgcactccagcctaagcgacaaaaggaaaactccatctcaaaaaaattaattaattaaataaaagtgattttaaaaaggaaaaataagtaaatagtcgagtttggtatttggcaagaatcgtggaagtgattctcaaatgtctggaatttggcagtaatctttaagtctaagcttcttagccgagataccaaccagccctcctggcttaagccctggccctgatccattgtcctctctttacctcagcccagtctctgatcccacccagccccaaccctacccaattcctgtcttcacctagcccccgaccccgcccagtccctgaacccacccaatccctgtcctcacctagcccctgactccacccagttcctgatcctgaggtccctaaacatctggtgtttctagcttctctgtgttggcacgtgtgatgttgtcggcttggaattctcattcccccataaggtctactcctatttattgtgaaaacccagctcagacacctccttggaaagccttccctgaccaccctctcaccctcagttaatggtttcctctgtgttgtttcatattttcaaacctgcacaatgcccttaccattctgttctgtacatatatacatatattttatatttgttcacacaaatctgtgagcaacctgaagggagtgactgggtcgtcttatttgcgtctcatccctcggtgcccagcatagggtcagacacaatgattgatttacaaagtgatttgacttgcatcaggctttgtccaaagtgtggattgatatcttcaaaattaggtcagcaagctacagctggagggacaaatctggcccgccatctgtttttgtaaataaagttttattgagatgaagccacatggatttttacatatctgcgactgctctcgtgcacagttgagtagttgcaacagagaccatatgacccacaaagcctaaattatttatcatgtaaccctttacrgtaagtgcttacccatccttcttctaaaggacarcaggggccaggtgtggtggcttatgcctgtaatctcaaccctttgggaaactgargcagggggatcacttgagcctaggagttcaagaccagcctgcgcaacacagcaagrccatgtcwacaaaaatatttaaaaagttagtcgggcttggtggcccatgcctgtagccctagctactcaggaggctgaggtgggaagagtgcttgagcctgggaggtcaaggctgcagtgagccatgactgcaccactgcactccaacctgggtgacagagtgagactctgtctggaaacaaaaaaaaaagaataaaggacaaatctgtttggattggggggagcctctgggtatgtggtgggacatggaggtgggaagaggactgagaagctactgggtggctttctgggagtccagggcttgcaacacacacmtgctgtgtggcccaagctgggtactctgtgcaggtgcatagtccaggaatgactcctccctccctgcagggataaccgggatgctcagcacgtgctggagagggacctcgaagacaaaagctcggcccagtgtatcgatgagaagtgctttaacctgagaaatacgtcagactgcatcagcttcttccacggcatggagaaaattsayggcacgtaagtatcagactccccctccccatcmctggcgtgtccaactggagtgagggcttctgctcctgccaacgaatggcgaaggggcatcgtgcaccagttaagtgggaagtggcatggttgaayggggatcctctagcgcaggcggcagaatccaagtcgggttagcttaagacaagatggaatttaccrgaggaggtatgggggagccacgaactcaaggggaaagcgggaaggaaaggttctggcagtaggagctgtgtggtcagagcgccttcatctttccatccttgccccaccattcaagatccaaatttcaggaagagagggcatgccattggcttagtgagggtcgcacagccactgccactcagcagtttcaccaaaaaaaaaaaaaaaattccgaaacaagtgacaacctcggcagggagaccaactggggtcggctggtggcggggtggtttaacagagtgaattcttgcttcgccaggcttgttggcttacccctgtaatcccagccctttgggaggccaaggctggaggattgcctgaggccaggagttccaggagttttccagaccagccagagagagagagagagagagagagagagagagagtggaatctggagccaggctacctggcttcaaatcccagcctctacgctaacactgagcaagtcacttcatttctttgggccatttctgaatctataccactgggagaaaattaagtacccacttcccagggctgctgggagtatgaaaaaggtgggtgtgtgaagttttaagcacagagcctagtatagaataatcacagccaacatttatcaagtgcttactgtgtgacctcattttctcgtcacagcagctatgaggtggtgccttctgtgagcctgtcatgatcgtgggcatatcacagcattgtgaggttttttttttttttttggtatttttcttatttatttatttattattattattatactttaagttttaggatacatgtgcacaatgtgcaggttagttacatatgtatacatgtgccatgctcgtgcgctgcacccactaaatcgtcatctagcattaggtatatctcctaatgctatccctcccccctccccccaccccacaacagtccccagagtgtgatgttccccttcctgtgtccatgtgttctcattgttcagttcccacctrtgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacatttttttaatccagtctatcatcgttggacatttgggttggctccaagtctttgctattgtgagattttatgcagaatgaaaacatgcttcccagttggtagtctgaggtctgagagatgctcgggatgagaaagagggtggagtctatcttagttctgccttcttctgttaaaaaaaaaaaaatccctagcacatagaattgtgcttggcacatgttggtatgcaataaatttttattgaatagaagaatgaatgaaggaggaagggagggaaagaagaaccacaggaagggaggaagggaagcgagaaggaaggtgttccttggcagtctccttggcccaagcctggggtcactttctggatcttacaaatgtcaaagtgctgaggtgaccctttgggacttctggtaatgacaactcctggggactttccttctcttcctgacaaggtgctctcctccatggcactggcaaggtgagcaggactttgggggctgggcccccctcatctgcacagggagtccagagggtctctcttcccaaacagattcctctccagaaacctggcagccccagagcctccaatttccacacccaggagggacctgctacttaaagtcccccatctggagactccatctggagaagagagctgctgtttgtagcaactaattgctccccagatgtgctagcttggggctttgtatttgtggttttcttatttatttatttatttatttatttatctgagaccgagtttcgctcttgttgcccaggctggagggcaatggtgcgatctcggctcaccacagcctccatctcctgggttcaagcgatgctcctgcctcagcctcctgagtagctgggattacaggcatgtgccatcacgcccagctaaattttttgtatttttaatagagatggggtttctgcatgttggtcaggctggtctcaaactcctgaccttaggtgatctgcccgcctcggcctcccaaatttctgggattacaggtgtgagccaccacccctggccttagggttttcttaaagcagggctatgtctgggcggatgaaacaggacgtttggtgactgtcygaattgcagtatctctattcactgcagttctcattaccatggattaacaatgatgataatgatgatggcagtagacaccttttttttttttttttagacagagtctcgctctgtcaccaggccagagcgcagtggcacaatctcggctcactgcaacctctgcctcccaggttcaagtgattctcctgcctcagcctcccgagtagctgggactgcaggcacatgccaccacgcctagctaatttttgtatttttagtagagacagggtttcaccatgttgggcagggagagacaccttttacctggtgtttgctatgtgctagacattgtgctgacagcttcatatgcaacatctcatgaataataaacattttttgggcgcttactctgtccagtgccatgacaaggacttcacatttaaacactcagcaaccctgggggttggtaccattattatctccattttacaatgaggaaactaaggctcggagaggtgaatcgattggctcaagctcacacagcaaatggcagagctgtgattctgaatctacattgaatactgagcctgtgtgttttaccaawggtgccttcctgcctctccagcaaagccagctgtcctctccatctttagagaacaaagactccagaaagcacttccccctactgagacacactgcctgctgaggaggcagactgtctttggcaaattcctccccagggagaatgtgattaagcgggttattttctctggggagctcagctgcctgctgcaggggaggacaagggcttagaggttgctgtttatgacactgacactgtccccccattcagaggcaacagagacactcaaagtaaatctgcatgtttctctctgctgtccttattgtctcctctttcctcagtgtcctgggatgggacgttgttgtgcggccttgaacaagatgcttcactctctgagcctcaggtcttggttggatgaaagctctgaacctgacttagtgccactcctatctccagaagcccgagatgcctgtttattgcttgatttttaactcctgcaaaagccaagcaaaacartcacacamgctatatgatttttaaaactttctatgcaccatgcaacctaagtgtgctttaaaatgtctgaaaagaggccgggtgcggtggctcagacccgtaattccagcactttgggaggctgaggtgggcgaatcacgacgtcaagagatccagaccatcctggccaacatggtgaaaccccgtctctacwaaaaatrcaaaaattagccaagtgtggtggcactcgcctgtagtcccagctacatgggaggctgaggcaggagaattgcttgaacgtgggagacagaggttgcagtgagccgagatcccgccactcaagaccttcagaagttacccaggacctgaagccagctcaaagaaatgcatgcccttcctcaaagccttcccagatgagaaaaccccacrtagtccattggttgcttgttgcagggatttacatgctctgccaggaagaactttactgaggagttcctcatgtgtcascacctctaagaagccttccctrcctgcctttgctaatgtagcctgtgtccatgtccattgatctccccagatccattctccagctaccacgctgtgwgtcctgcacggccgactatcctctgcagacctctcctgggctctctgtcctttggtttccagatggtttcagcctggaggaggggtaccagcagaagacagagtgtgggaggggagaggctgcgatttcttctcctgctacctccctcccagacactctggtcaaccatggttcctccttttctggggcttttataacacctattgcttccttttctcttgccctttacagctgggatagtgacagcttcatgcattttctttttatttttttgttgggggggacagggtcttactctgttgcccaggctggagtgcagtagcgtgatctcggctcgctgcaatctctgactcccagttcaagtgattctcctgcctcagccttccgagtagctgggattacaggcgtgtgccaccacacccggctaatttttatatttttagtagagacgggatttcaccatgttggccaggctggtctcaaattcctggcctcaagtgatccgcccgcctcgggctcccaaagtgctgggattacagccatgagccatcacattcagcacttcatacattttctaatcccagacgatctcaacacccttccgagtattccatctattcccgtttacaaccctgaccaacacataatgacaccactccatttgtctctttcatcctcctgctgctgctgcttcttttgagacagggtcttgttgtgttgcccaggctggagtgcagtggtgcgatcatggctcactgcagtcccggactcctgggctcaagcgatcctcccacctccgcctcccaagtagctgggaccacaggcatgcaccaccacaygtaggtacttttttttttgacattttttatagagatgtgggtttcaccacattgcccagkgtggtcttgaactcctggactcaactgatctgcctgccttggcctcccagtgtgctgggattagaggcatggctggcccagccctccagtttctaaatcccttcccagcacataacacaatgtgtaactatctcctcattcactgtcaatctccctcctctggcacttaaccgccatgaggacacggatgttgccgttcttgttcatggctctctcctaactgcctggaacaatgcttggcatgtcgtagaagttgaagaaatattccatgaatgaatggcagtgaaagtagcgtggccacattcycatcgcagagttagggggttcagggaccccaatgaagaagcaggcccaaagcctgcttcttggcttgtccacgttgtgtttctggtggtggtggtgtgggtgttagggaaaagagctctctgcgggagcccctctctttgacccactcactgagtgcccttctgccaaccagctgctctctttagggttctcttgcttcccctgtaaaatgagggtattggatcaggacagtggttctcaacaaggggcgactgcaccctcccatttggcagggtcatttggcgatgtctggagccattttttggttgtcacaacrgggtggttggggagctactggcatctagtgggtagaggccagggatgctgcttaaacatcccaarcaccctacaatgcacaggacagagaataatcccgacccagaggccaagactgccaaggcggagaaaccrcagattctgaggtctyccaggactgctgcaactcacccttgtgcctttgcaggatctccgtacctgagacctgggccaagttcagtaacgacaacatcaaacactctcagaacatgcgggccaactccatccrgctgcgggaggaggcggagcacctctttgagaccttgtcggatcagatgtggaggcagttcacagacaccaacctggccttcaacgcccgcatctctgaggtgacggatgtgaagaataagctgcagacgcagctggcgaaggtgagcagatcctcccaggacccctgccttctctgccaagccctcacccttctcccgtgaatctgagtgttatctgggccaagctggccctgcccctggtgccaaagcagtaccctctctcccaaggtctgtggtctttttcttcctaaaaggggccaagggctgagcttcctggggggatttaagcatccatagtccatcttgtcttgcttacaagcctggagcttggcctagctgtgcccaagaggctgtgacactcccaggaccccttattttccatctaagacccatgtggccgagcgcgagtgcagagaacggagcccggcacaccatagtctctgccacttctgcacatcttctccgtccacagcagcatctttggaagtgtaatctttgacttccaaaggcctgaacggtaccgtaacagtctaaaggttccctgctgaggggtggggtgctttttggatctgaggagtctgcagcactgcccgattctgtcgtctgcgtgctatgcctacaccagtgtgccctttaggcgttttgcgtcatgctktttcacacctctgggttggctcttggagtcctctttggatggaatttatagtccctgctcaatgcaaatttagattcccactgggtgccagatgctgcgctaggcactaggaataaaatgaggagccgtataaacatgggcgctggcctctggggacttgacattctcctggaggaacagtggtggctgtgaaatttatacacagaaagaacttggatgatagtcaagtcagagggaactagccttgaatttgtgtttgcagaacagtacccctttttaaggccaagcacagtggctcacacctgtaatcccagcactttgggaggctgaggcgggcagatcacttgaggccaggaatttgagaccagcctggccaacatggtgaaaccctggctctactaaaaatasaaaaaattagccaggtgtggtggtgcttgcctgtaatcccagctacttggggaggttgaggtgggagaactcgcttgaacttgggaggcagaggttgcagtgagccaagatcacaccactgcactccaacctgggtgacagcgagaccccgtatcaagaaaaaaaaaaaaaataagaactgtgccctttcttattgtgtctctatctttggggggattagtgggctgcaggcagggtttgatggaaattacagtggtagtttcagcccacctacatctgccacccgttgatctggtactccaaaagagacaataaaataaataaataaagtttatttttcttttcttctctctctgtttttttttttttttttttttttctgagatgatcttgctctgttgcccaggctggagcacagtggcacaatcacggctcactgcagccttgaactcctgggctcaagcgacccaagtagctgagactacgtgtgcgtgccaccacacctggctaggttttttagttttttgtagagacagggtttcgctatgttgcttaggctggtctcaaactcctgggctcaagcagtcctcccacctcagcctcccaaagtgttaggattacaggcgtgagccaccatgactggcctcgaaacaggagtttccatgaaatcattgcaacatttttatagggagggagcaagggtgggtgagccagatattctcatgggacccacactgggtggagcagagaagcaggggacgttgccaccgagaacagatcaacagggagttgagcggccaaaagttggtgggaagaggattccggagagagcagcaagggcaaaggaagcgtccgggatgaagctggaggaaggggcaggtgggtctgggtaggcctggtgaagggtttggattcctacctaagarcaatggggagcctttgaagattttaagcaggacagtgtttggatccaagcttgtccttttgttgatttcttttctgcctgcgtggcagaagggacgcagaggttaagaatggatgcagcggccgggcgtggtggttcacggctgtaatcccagcactktggaaggcagaggcaggaggattacttgaggtcaggagttcgagaccagcctggccaagatagtgaaactccatctctactaaaaatacaaaaaatcagctgggcatagtggcatgcacctgtaattccagctactcgggaggctgaggcgggagaatcatttgaacccaagaggcagaggttgcaatgagccgagatctcaccactgcactccagcgtgggagacagagtgagaatctgtctcaaaaaaaaaaaaaaaaaaaaatagaatgggtgcagtggttaggaggctccagaagaggcccagggagtggggaaggctgcctgtgctgtggtggtgacatcaagtggaagaaggaccagaaaagggtgagatacctggagaaggcaaagttggcatcgagttggcctgtgcaccttccctttatctttcatgaactattttcctactaatcctctaggacagggttggcaaacttttcctgtcaaaggctagatgataactgttttcagctttgcaggcaatacggtttctgcctctatactgcaaaagcagccgtggacaatctgtacaaaaatgagtgtggctgtgttccaataaaacttcacaaaactaggcagtgggctggatttggtccacaggttgtagttttgacaacccctgctctggaacttagctcaaaagtcgcttcctccaggaatccttcctaaactccacggtttatttgcactcaccatctctgggtggccactgcgttctgagactgtgttttcattgctycttccatctcatatcttttggctagaagcactgaccctgagccagactgcatggktatgatgaatcctctataaacttggacaactttcttaacttctctgagcctcagtctccttgtttgtagaatgaggataggaattactgtcacaggaggctgaggcaaggaggatcacttgagcctgggaggtggaggctgcagtgagttgtgattgcaccactgcactccatccaacctggacaacagagcaagatcttgtctcaaaaaaaaaaaacaaaaaaaaacaaaaacaaaaaataactgccgtgaggattgagttaatgcaggtataacacctgaaggagtgcgggcacatagtaggcaccatgtttgtgctagtggctgtgatcttaatgtactagttgatttacttgcctatatgttttcagagcactgctcctgatttaaccttgtccccctactgcttaataacttcctggtactccttacatctttctgcaatgaatggaaggaatctacaatgttgaggtggtttttttgagacagtctcgctctgtaacccagtctggagtgcagtggcgcaatctcggctcactgcaacctctgyctccctggttcaagtgattctcctgcctcagcctcctgagtagctgggattacagacaccccccgccatcacgccccagctaatttttgtattttttgtagagayggcgttttgccatattgcccaggctggtcttgaacttccgggcccaagttccctgggctcaagtgatccacctgcctctgcctcccaaagtgctggaattacatgtgtgagccaccatgcccagcctgcaatgttgagttttgtactgaggtttttttttaaagaatgaagcatgcatgaatgaatgccttaaatgtccctttttctttttttcatgcaaagacccatttttattatggtaaaatacacataacataaaacttagcattttaaccactcttaagtgtacagttctgtggcattaagtacattcatacattgtgcatccatcaccacaatccatctccagaacttttccatcttcccartctgaaactctgcacccattaaacactccctccccttttccatctccccccatatccatggtaatatcatttggctgtgtttccacccagatctcatcttgaattatagctcccataaaccacatgtgtcagtgggagggactcagtgggaggtaattgaaccatgggggcaggtttttcccgtgctkttctcrtgatagtgaataagtctcttgagacctggtggttctataaaagggagttcccctgcacattctcttttgcctgctgccatgttagacgtgcstttgctcctcctctgccttccaccatgattgtaaggccttcctagtcatgtggaactgtgagtccattaaatctctttttctctataaatatcccagtcttgggtatgtctttattagcagcagcattagaacagacaaatacaagtaactaccattctgctttctgtctytgakaatttgactactctatggacttcatataagtggaatcatacagtagttgtcctcctgtgactggttaatttcacttggcataatgtcttcaaggctcatccatgttgtagcatgtgtcagaatttccttctttttcaagtcagagtaatattccattgtctgtctataccacgttttctttatccattcatccatttatggagacttggtggcgtccatcttttggctcttgtgcatcttcttttaatgaggcatctcatacggtggatcaaatgtagttcattgtcatgtttcattgcctgaagtttgtggtctggggatgacttggaaaggctcttttagttggctattggtacctggtttctcacctgtgaaacagggataagaatttctacatggtaacattactgtattaatgaggtaatctctggagctcttaaaacagtgcttgacaaatgataaacactcagtaaaaaggtaactgtaagtattaatataattactgatggagagagaaaggatcttttgaatggaggtggggagagcaaaaccttttcrctttccaaattcctctagtgaggatcccttgagccccggagtttgatgctgcagtgagctatgatcgtggcactgcactccagcctgggtgacagagcaagacattgtctctaaaaaattaaaattaaaataagttkaaataaataaataaatacataaataaataaataaataaaaataaaaattcctccagggaagttttgaattattactaacaacctcatcactacagactggagggtttttgcaacctcatggatttttattaatagtcataatttaatcaccagctgttctgcaaataagttagcacccatckgaaatgcaccaaactccaaccctacgctattgacattttcctgagcaaggatttgtcttctggttggtgaatttcacatggtgttattctaaaataataaaggaatttgatgcaatgaagataaatgtatagcaaccatttcacttttcaacagtttactttggctagaggatttgaaatkctctcttctttttttgaggtggagtctcactctatcgtgcaggctggagtgcagtgacgagatcttggcttactgcaacctctgccttccaggttcaagtgattctcctgcctcagcctcctgagtagctgggcagctgccaccatgctcggctaatttttgtatttttagtagagatgaggtttcaccatgttgaccaggctggtctcaaactcctgatcccaggtgatccacccgccttggcctgccamagtgctgggattacaggcttgagccaccgtgcccggactgaaatgctctctttaaaaatgtaactgttattagttgagcttagcctgatagtccttggcaaaaggcatttctggaaaattccaagtgcccatccttacctatgctgcaaggcagttatttcccaagtggtcacaggaatccaccttgtaagaccaaatctacacggctccacgtgcagacagtggtttggggctgtgcagacagcctcatctgttcactgggatgctagagttctgtcacctcggccacaccccaagcctcatagcttgccccggggcctcatccttgcactttgaggctccaggtatcactgtgtcatactgaccactgctagcaaaggagctggtgacttctctggactaaagaagttggtggccacagagtgggttgctgcctttgagtgctgattcctctgagacccagggccctggaaacttccagaaaaacaacccctcatttacatgcaattacccaagtgaatgtgcatttgagtgggggatctcttaatgtgtagggggaaaagatgcataaatatggtttttgggggtaggatgtgtggggtcagggatacttctatggagaaagtgcttattctgacattgtgggaactagaccctggcaggtgaaatattakatgtgttacatggatatagcattaatatcactgaatcatacaatgagaaggttattccttcttcattgcttctgaccatctcaaaagtgctagaatgccttccttacctcttttaacacctgccaatctcccttttataatttttttttggagacagggtctctctttgttgcccaggctggagtgcagtggcacgatctcggctcactgcaacctccgcctgccaggttcaagcgattctcctgcctcagctttccgagtagctgggattacaggcatgcaccaccttgcccagctattttttttttgtatatttagtagagatagggtttaaccatggtggccaggctggtcttcaggtgatccaccggcctcrgcctcccaaagtgctaggattacaggcgtgagctaccgtacrtggcctcacctgttgataagcatttcggttgtttccagtttggggctgttacaaataaagctgctgtgaacactcatgtacacatatttgtatgcactctcacagagtkcaaaaaatatttggtaaaaaatggkgatttcacataaaaaaatttcagatttccagcgtctcttgaaaaattagtagctctagcaattcagagctcatgtttctacaggggaacagtgggtaagggttgagtggctgctgcctctctttgggtcaggtgctccagttagcctcagaccccaccactccctattacagcacrcttccctcatttgcattatttacttgatcctgtagccctgtatttgtgcactctgctttatatatcagaggaaactcagacaggcagataaacaaaacatccaggcataggaagaggttgaacagaacagagaagggctatgaattttaaccttgawgggctttggtttcattctgaagtttctttggggttttgactcccaagcagccattgttagcatcagcaaaaccaccccttcccaggaaggcctgggcaggaaggcctggcgtctgaggggtgagggcccctgctggtgatctgaggccctgcgtgtctactgccaacccctctgtttgtccaaggaggtctggaacccaytgtgcagtgggaaatgcttttgtgctttgcagccgattccttccagcacyggagcctgcagccaagctactgacggctggtttctraaaccggcccagccctggggaagtggagctggcagcctggccmtgtgctaccctcctcatgagacaccactgcatcccagggagaaagtctctctcttctctgatggtgtcacggaggaagactcatcatgatgccgacctctctttaacacctatccttcctttgcccrtctgcctttctaacaaaggcatcaggcctcaggcttagaagctttggaaagcaatagaacctagatataattattaacttcttttttccagctaggtgtggtggctsacatctgtaatcccagcactttgggaagccaaggcaagcagatcacctgaggtcaagagttccagataagcctggccaacatggtgaaacctccgtttctactaaaaatacaaaaattagctgggcrtggtggygcatgcctgtagttccagctacttgggaggctgaggcaggagaatgacttgaacctgggaggtggaggttgcagtgagccaagatcatgccactgcactccagcctgggcgacagagcgagtctccatctcaaaaaaaaaaaaaattawattatttttcccattttgcctattgttatggtaccctctattggtggaaaacaatagtagttttccacttgtggaaataatttaaagatttcatttcaaatacatatgttaaagcctgaaacaggctgatttgaagaaaaatattaaatgattatgtagatggtatgtggatatgggaaatatgatgacratgctgcccagtacctgaaatttgggaatgttaaaagaaaaacttaaagcagattaaatttaacagaatttaattgagcaaagaatgattcgtgaattgggcagccccctgaaccagaatggattcagagcaaccccaaagctgccacgtggtcggatgatatttacagacagaaaaaggaaagtgaygcacagaagacggaagtcaggtacagaaacagccagattggttactgctcattgtttgtttgccttatttgaacatgatttgaacagttggctgcctgcgattggctaaaattctgtgattggtataggagtcggttccaggctgttcacacatccagttaggttacagttcactgtgtaggggagagatctttaacatacgtaaggaaggaagccaggcgtggtggctcatgcctgtaatcccagcacttttggaggctgaagtgggaggatagcttgagcccaggagtttgagaccagcctgggccacagagtaagatcttgtttctacaaaaaacataaaaattagctgggcatggtggcatgcgcctgtagtcccagctacttgggaggctgaagtgggaggatcacttgagcccaggaggccaaggctttggtgagctgtgattgtgccactgcactccagcctgtgcaacagagtgagaccctgtctcaaaaaaaaaaaaaaaaaaaaaaagtaaggagccagtgttaggctgaatgaagtttagttcatttcatcggamtccctggcagaatagttacccctgcatcagtgtagatagttcatatgggsaactgtgccatgaaagtgactgccatgttttaggaaaacacacccgcatcagtattcaaataaggaaacagccgtatgtcctgatggagggatgaccaggttkcaagggcacttttgacgagacacagttctcacgccttgtattgacttcagaacaacaccccatccctggcttcataaggtgatccacccatgcagacactcagtaatcaatggctgctgttcattcctgtgcaggcgttccctctctctgcagtctgcattttcttagaagttgtggcctgagtaattcttcactgyagtggttgtcagctgaaggcagttgtgtcccccagaggacacttgaaatgttyggaggcatttttggttgctatagtttggtgagggggtgctgctggcatctactgggcagaggccagggatactgctaaacatcccacacggcgcagggcagccccccacagcaaagaatgtttgggcctgaatgtcagtagtgctgaggctgagaaaccttgttttaaaggaattccaggcaccaccgaggaacaggaggggagggtttgaggaggtagaagacctccagaattcttcagatctgcgtgagtcctgaactcatgaactgttgcctgaacaggccaattgccctcttataaactacaagattccagaagataggaagaatctgagtgtataaaacctggactgtgcctactccccgtggcttggtaaacagggtggttcttcagggcatccacacccctatatgggtgcacaccaccatgcccggctaatttttgtatttttagtagagacaaggtgtcaccatgttggccaggctggtctcaaactccgaggtccaccagcctcggcctcccaaagtgctgggattacaggcctgagccaccgcgcccagcccctgttctgttgaagactgcgttcctgtaggtgctgggcttggtgtgaatgtggctttcagaggctctgctatctgtgggtttccagctatctcaggctatagctctcaggaagaggctcagggccatatgcatgcataggtaggtctctacctgatgcccaccttagcaccaggaggaatcaaaagcccttccagtgtcacgtgggctcaggtctcatcatagtacgtgggtggtgtgtgcctggatggactcagcatgaggggtccctgggagttcagacatgggaaattctgagagctgtgccaaaaggtgggctggtcagggtgactgtgtcacagcttatcagttcatgggaacactatgccaaatgggagaggagctgctggaatcaggaaggtggagccaaggtccagagctggggaggtaggcgacagatgcaggaagttggagggaccatgcaggagatggagagaacgaacacgggagagggcagcacaaacgagactgtttctagctcattttgtgaacaccacctatgctcaggaacgctagtacttctttcctcccatggctggcttcaaatggtgacagccaatcatatgctttgcctggaagccctgggcagggcaatcactgggattggttcctggtgagatgagaagaatataaggtgcagcctggccaaggcagagggttgcggtgtcatctcccgggtaatgttatgccccagcattcccctaattttttccaagtgatgactcctccacctttgtgtctttgtctgcttgctagcatgggacctactggctagcctcacctatgctccagctttgacatctgctggcctcctccttggtccagcctccccttccatctccaccttctgtgtcccgacaggtaagacccatagtgtattgcagagtgctgggctcatttctggctccagcacttcctggctgtgtggccaaagtcaggttgccctacctctctgtgcttcagttttttcctctgtcaaatgggagtaatgatgattgacaagcagttgtgagaataacagcagctgtgcccatcccttagtgataatgactattagctataaaaatagtacaaagctatggtctgctttctcatctgctgatgtgggagggatgacaaagtaacggaaagaacctggcacctggtttgaattttggtatgactaaggggtcttgaggaagtaactaacccttctgaatctgtttcctaatctataagaaaggaacaatcctaccagctgtgaggaacaagtgagaaggtgcaggtgagccgctctcagccttagtgccacattggaattgcccagatgcctgggcctcactttagggattctgatttaattggccagggtctggcctgcagcagatctttttaaaactccccaggtgactctaatgcacagcccaggactgaggaccaaaagttaggtcttcagaccagtggttcttaaagtgtggtccttggaccatcagcatcagcattacctgggaatttgttagaaatgcacgttctcaggctccatccaggacccactgaatcagaaagtctgccagtggggtctagcgakctgagttttaacaagccckctaggtatatcttccaggtgtagacatgcaacaattatctgttgttccctccctccctcttccttccctccctgcagcagatatgtacttagcccatcctatgtgctagactgagttaggcgctggggattcaacagtgaacaacagacaagatctctgccctcagggggcttacattctagagggggaaatagagttaaaaaaataagcaaacacacaattaattaaaagtggtaataagtgttaagaaggaggccctcaaaggcctgagatgatgaattatcatgaatttttttaagagcatattggtctctcgggcaagaaagcttctacccgtttctaaccccattcaggactttcaggacctctgacctcagacagcctctcaacagctgatgcatgtactggcctgacatattccgaaagcagctgggctaccacttgagagaaacggctgcgagcaggacctgctcaacatttatctcctggagtagtggttcccaaccagggtgaatttgcaccccactggcatttgccaatrtctggagacatttttggttgttgaaatggctgggggtggagaatgctactaacatctagtgggtagagaccagggatgctgtgctaaacagcccccaatgcacaggacagcccccacagctgagatatatctgggctcaaatgtcaagagtgccaagggttgagagtcccagctctggggcgttcatgctctgaatccctgaccgggtccctccggagcgctcctctcctctttctctctctccttgctcctgaatttggctgaacttgaaaatcttccaccatttgaccagaaaaggatttcaagctgccttccyctttcctgagctggggatctgcactgagccaagcatctccttggaawctccttggcttcatgcaatttggaaaacaataaatttgcaaggttgcacaaaacatccagaagcctaaagctggctggaactactaaatccatttttttccytccacatcaaamataatttcttggccttagaggctttctccactgtcacaagacacaggcagatagttttacatggtgaacaaccctgccaaacatatctctgctttcagagctgttgggtggatttctagtccagccaggaatatcagcacacttttccactgagccgaggttggctttacctgaggcagacctgataattgcctttcacaccccatgcattgccagagaccattcccagtgctgatctcaaccctttccacattctgggtgcagggttgagggtgagtgggtgggtggagtggagatttgcttccggcttctcctctgcagggggtgagagtgggtgatcataattgagttttccatcctgctgcaagccgaaggagaaagaaaataataacttactgtaacaaagacatattagccttactgagagctttacttaggtgagcttatctttccctcccatgaagaaggggttattattagacctgttttacagatgaggaaactgaggactcattacaaaaagtgatttgcctaaagtccccaccactaaccactccagctaggaaatggcagagctgtgttttactccaggtggtcctgtcatgggtgcaactggctggggccagtgctgtggatggtaaaagaatttgccaagatagtcatgggtaaagaaaggcagatgtattggagaaagtacaaggatacgttgcaagaaagcaatgggcagcacagcacagaaggggctgcctgcaaagaggcaggagctggaaggaagttttatagggtggtggtgccggggctacgtgcagaacaaagtatttgggaacagaatgctgtgcaagtgagttgtttgtggttaaccgtctctcagaacaattgttctccccaacctggggccgcctcctcgttgttgctgacttaggactccacaaatcctgctctagattctgagcttcaggttaatagggacacttcccccacctccacccagccttatgacaacagtaataggtcaacatctaaagcagcagttctcaaacaaggtgattttgcccccatttcccccaggggcatttggcaatgtctgaagacatttacttgtcacaaatgggggtgcgtgctaccgatgattagcatccagtgagtagaggccagggatgctgccaaacatcccacagtgcacaggamagtccctaccccccaccatggagaatcacccagcctcaaatgtcaatagtgccaaggctaagaaaccctgatctgctagcattaaggtttaatttaagaagagagaaaggaaaaaagatagtagataggtagatggctaggcagatggtagggtagatagtgtggaggctgagggacccagggctctgaagggcttactgtgtgctggccacagtgctgaacacattacatgggttacctaaatccatcctggaagtcaccttctaggatagatgctattatcatcttctttatacacatggggaaactgaggctcacagaggtttggtgatttgccaaggccacatgcttggcagtggctggtggctccccaacctctcttctagaaggttcctctggattgtagtgaggtgggcacactggaatccgaataccactggcctctcctcactccgcacattccataagttctcaagtccttcctacttcatcttttggatactttggtgacctcgtttctttagcaattgtccacactgcctgggtgtgagtcctcctgtctctcagcttgtccagattgtcccctctgtctatcctccaaatggcagccagagagatctgcatgaaactacaaacataatcatgtctttctcttgctttaaagctttaatatgcatatgaatagcttgggagtttgtaaaaatgtagattctgtgctgagatctggggtggggcctgggtttctaacaagctcttcaagtccaaagatgctggtccagggaccacacttggagtagcgaggcgctgcagaaattgttctctgaacacagaaaccccagaggagcagcagacttacatgagatggacagctttgggggattgtgatttcccctggaatagtttataacaggggttgcaaactcacagccccaagggccaaatccccgcccctccgcctgtttttgtaaatagttttattggagcacagccatgcccaatacattttcatgttgtctgcagctgcttttgtgctacagtggtcaggttgagtagtttcaacagagatcataaagctgtwtattgagacttgcagcaatttaaagaggatggacttgaagaagaaaaaacaaaacacagccgggcgcggtggctcacgtctgtatcccaacactttgggaggccaaggtgggcagatcacttgaggtcaggagttcgagaccagcctggccaacatggcgaaaccacatctcaactaaaaatacaaaaattagccgtgcgtggcggtgtgggcctgtaatcccagctacccaggaggctgaggaaggagaatctcttgaacccaggaggtggaggttatagtgagctgagatcatgccactgcactccagcctgggcaacagagcaagactctgtcttcaaataaataaataacacacacacacacacacacacacacacacacacacacacagccttgcactcctgctggtaacattctcagactggcttttgaaggaagtggcggctccgggcmtgtgtgggagtttgaaggtggaattcatagagaacattacctggccagtctctgtytcccggatgaggagatagcggctcagagcagtcaggggttctgagtgggggtctgggccccacagttggtttgtgttagggctgagatgggaacctgggcctcctgactgaccttttacctccaggacaccctgcacagaattctgccagcaggtgggggtggggtggggggagttacttaayatgaaaccctttggtcagccaaaggtgggggcatgtggcccaaagagccacctgccacctgccttgggcaggctctttttctgagccacattccaaagactgaggagagcccttttctattacacaggcaacccccgtcttgaccccttacactggaataagtgggttgagggaggctgggctagggtgggggatgttaaattggatcccatactggagatctggggatctgcctctctccagctgtgacctcatcacgttgcctaatgtctcagaatgttgcctgtgatatccagggaattggattaaatgcttctgaaggtggattccttttaaattaaaatagtaatacgtattgagagtggtggagacaaaaatgagttttttcctttattaaggtgaaattcgcataacataaaattaactactttaaagtgaacaattcactgccatttaatattgataatattgtacaaccaccacctctacccagttccatttccgtcaccccaaaacaaaaccctgtgcccactgaaatctatcctccccaaactttccccattcacctttcacctttaagctatcgtaacactaataatgagcgtacaggcctttcatggttttcttattttgaatgtgaatacattgatttgttttctctgcggttgccttattaaaactttttttaaagtgaggtattgccaggtgtggtggctcacgcctgtaatcccagcactttgggaggttgaggcgggcagatcacgaggtcaggctaacatggtgaaaccccatctctactaaaaatacaaaaaattagccaagtgtggtggtgggcacctgtagtcccagctactcgggaggctgaggcaggagaatggtgtgaactcgggaggcagagcttgcagtgagccgagattgcaccactgcactccagcctgtgtgacaaagcgaggctccatctcaaaataagtaaataaataaataaataaggtataacacagcaaagaacacaactgtattaatcttcaaattttaaaaaatggttagtcattatggagacataatagttgtacatattcgtcaggtacatgtgatatttgactgcattaatctgggtacagtttgaatttgatttttacgtgtgtgcgcacatgtgtgaccagtacctagttcagtggctctcagtcatggggtgattatcccctcaggggatatttcgcaatgtggttgtcacagcttgcggggtggatgctactggcatttagtgggtagagaccagggatgctactaaacatccttcaatgcacaggacagataccacacacagaatgatctggtcccagactgggcaccgtggctcacatctgtaatcctagcactttgggagactgaagtgggtggatcacttgaggccaggagttcgagaccagcctgaccaacatggtgaaaccccatctctactaaaaatacaaaaattaaccgggtgtggtggcgcatgcctgtaatcccaggtactcaggggactgaggtacgagaattgcttgaacccaggaggcagaggttgcagtgagctgagatggcaccactgcactccagcctgggtgacagagtgagactctgtctcaaaaaaaaaaagaaaaagaaatatctagtcctaaatgtcactgaatgtcaataggtgatgaggttgggaaaccctgttccagatcaaaggctaggacatttctagttccaggagcccccctcataccacctctcagtctacaccccctccccaaaggaactatcattcttacttctatcaccagccgttagatttgcctggtcttgaaattcatattgatagaatcatgcagtatgttcttttcttgtgcttggctgcttctactcaatatagtattggtgaggttcatccattgtattggtrtgtgtgtgttagaagttgttttttaccgctggatagtggtctattgtggggctattccacaattgatccatcctcctgttgatagatgtttaagttgttatgaacattcttgaacattcttgcacaaatcttttggtggacatatggactctttctcatgggcgttcccaggaacggaatccctggctcatagagtgggtgtatcttcagcttcagtaggttctgtcaaacggcttttcagaggttgacaaatattgacttccaccagccgcatataagtggtccagtttctctgcatcctagtcaacacttagaattgtcatctctttcatttagattacaagtcaataatcacattcaaagacaggggatacaaagtttcttttgtgggtgagtaatgaaagtgttctaaattagattatagtgatggctggacaactgtaactatactgaaaaccacagtacattttaagtgggtgaactttgtggtaaattgtatctcaataaagatgttggaaaaaattgaaaggggaggccgggcgcagtggttcacgcctgtaatcccggcactttgggaggccgagccgggcggatcacgaggtcaggagatcgagaacatcctggctaacacggtaaaaccctgtctctactaaagatacaaaaaaaaaaaaaaaaattagcttggcgtagtggtgggcgcctgtagtcccagctactcaggaggctgaggcaggagaatggcatgaacccgggaggtggagcttgcagtgagccgagattgcgccactgcactccagcctgggtgactgagcgagactccatctcagggaaaaaaaaaaaaattgaaaggggaatgacttttctacaacgtgacttaatgttatcatttaccacttaaaatcactttggaagtcattggttatagcactggattcactcctatttctctactgtcttatcctcttgattcctatcctaaatacagttgtttaaaagcagctctaggccgggcatggtggctcatgcctgtaatcctagcactttggaaggccaaggcgggtgcatcacctgaggtcgggagttcgagaccagcctggccaacatggtgaaaccctgtttctactaaatacacaaaaaaattagctgggcatggtggtgcatgcctgtaatcccagctactcagaaggctgaggcaggagaatcgcttgaacctggcaaacggaggttgcagtgaaccaagatcacaccattgcactccagcctgggcaacaagagtgaaactctgtctcaaaaaaaagaaaaaaaaaaaaaaggcagacctaatttttggctttatatacaactaattgtccatcaatctgagtctaggcttgaatttcaagtcaaaaatataggctgggtgcaatgcctcatacctgtaatcccagcactttgagaggctgtggtgggaggatcacttgagcccaggagttcaagaccagcttgggcaatctagcagaccccatctctrcacaaaataataaattagccaggcatggyggtgtgcatctgtagtcccagctactcaggaggtggaggtgggagggtcacytgagcccaggagatcaaagctgtggtgaggagtgattgcaccattgccctccagcctgggcaacaaagcaagaccctgtttcaaaaacaaaacaaaaagtagtttgcatgtacccagttgaatacctttctagagagatcagtataaccyaaatgtttgtgtctttggttatcttttcctcttgacatcagtttattatatctcaggtgtttgtattcatttctaggggttcacttctataggccttacctctttggcttccaaatttctcaataaataaatcaagatggctgggygtggtggctcacacctgtcatctcagcactttgggaggccaaggcgggtggatcgcttgagmccaggagtttgaggccagcctgggtaacatggtgagaccctgtctctaagaaaaataaaaataattagctgggtgtggtggcacacgcctgtagtcccaggtactcaggaggctgaggtgggagaatcgcttgagcccaggaggcatagattgcagggagctgacatcacgccrctgcattccagcctaggtgatgagcaagactctcaaaaaaataaaaataaaaataaataaatcaagagcagtggttctcaacctggggcaattttttcctctagggggtagttggcaaygtctggagataattttggttgtcacactggaagtgggtgctactggcatctagtgggtagagaccagggaggctgctaactaaacatccttcaatgcacaggacggtctcctccacaaattttatcaaagagtctatcaaaatgtcagtagtgctgaggtcaagataccctcatcacrgatgatttgctatgaactctttggtcatatatgacaactcatttgggattaggttcagccacatgtaatagaagaccccaaataacaccagtttaagtaagttagaagtctactttcctctcacataaaataaatcttgggttgcaagatggcttcatggtatcatcagatgcccaggctgctatttttctgcttcaccatccaagcatttatttttcacacttagacctcatggtccaaggaggctgctggagctccaccatcacatcttaagtttgagctagcaggaagatacctgagaaagagaagggtacaaccacccccttttaaaagagacttcccaagagtcccaaacaacattttgattcctttccactggctagaattagtcacatggcctggagctacaagggagyctggaaaatgtagtcttttatagtgttccacaggttaagaggaagtgggtattaatattgccctttctatgtgtcarctagccacaatgccacaaacatataaacatacataatcttacataaccctcacaataatcctatatggcaggccttaaaaatattatttcataattttaaaaaaatactgaggtttagacagatcaggtaatttttacaaggttgaatagggggtaagtagtggaactgggattggaaccaggagttccggtgggttctgaagtcctacttttcctaatggactacactccctccgtttagactgggagcgataagaacgtgtaaatatggttggaggctgtttgtaaaggcaacattgtttatgtaattgggcttttgagttacccgttcagcatgtgtgtgtatgtaaaagagacaacagttcttgaaggataaatgtagtcctcaattgtttttttaggaaaggcagttttttctccagcaataagtctctcttcctgccttacagaatttaagttgcctgcaaagacaaattctttcaagcaaatctgaatttcctattgtcttacattaaaaaacaaaaaaaacaatgatcccaagtgaaaaatctcgtcacagactggggggggggcgtgggtgaggggaggggggggagacaggacagtccatggcatggtggcagacactggaataagcaatttacacactgttttaagggtctccagagaaacagaagcaataggatatatagaaatgtatctgagaggagatttgttgtaggaattggcttgtgaggttatggaggctgagaagtcccacaacctgtggtctgcatgctggagacccaggaaacctggtggtgtaattgagttccagtcctaaggtctaagagtcaggggctgaggctgtaagcttccgtctgagtctgaaccagcaacwctgatgtccaagggtaggagaagatggatgtcccagctaaagcagagagagcgaattcacccttcctctgcctttttgttctgttcggaccctcagtgggttgggtgatgcctgcctacgttggacatgaccgcwgagttcatcaattcaaacgttagtttcttccagaaacaccttcacagacacacctcaaaataatggtttaccagctatctggctgtccctttaarttaacatatacaattaacccagtcaagccagtcaaattgacatataaaattaaccactggctgggtgcagtggctcacatctgtaatcccagcactttgggaggctgaggtggatggattgcttgagcccaggagtttgagatcagcctggccaacgcgggaaaacctcatctctgtgaaaaacacaaaaattagctggatgtggtagcatgtgcctgtagttccagcaactcgggagtctgaagtgggaggatcccttgagcctgggatgttgaggctgcagtgagccataatagtgccgctgcagttcatcctggacaacagtgtgagaacctctctcaaaaaaatgatagaacagccaccacacacacacatgtgcacacacacacacatgcacacacacacacacgttcacacacacacaattttacttagttcccccagtaaccttgtgggcaagtgtttttcttttgtttttgtttttgtttttgttttgagacagagtttcactcttattgcccaggctggagtgcaatggctcggtctcggctcactgcaaattttgcctcccaggttcaagtgactctcctgcctcagcctcccaaatagctgagattacaggctcctgccaccatacctggctaatttttgtgtttttagtagagacggggtttcaccatgttggccaggctggtctcgaactcctaacctcaggtgatctccccaccttggcctcccaaagtgtttggattacaagcgtaggccaccacacctggccgggcaagttattattaagcctgtttttacagacaaaagaacaagtgtcctacacagtgtctggcagctagaaagggctcaatcgatgttgaatgcatattgcatgaggcacagagaggttgtgatccatgcaaggtcacacagcaggaagtggaattgaacctacatctgtgcaactgtagagaggctcaggaaggtgaagtaacctgtccccaggtgtacagcacatgggaggcttaggactcctgctcccyagtcttgcctcatctccactggcaggcagcctactgtatgcaaagcacagagtttgggcgggaaagggagtgaggtgagccgtctacgccaccaccctcttcccaccagagttccagctcccaggcagggctgggcggggaaggcagggctggctgccagacccaggatgccaggactcctcccatggggtgaccccctgagccaatccccagcagccttgcccagccactaggatatgccaggctgtgccccagaagcctcttttccccagattcctccaacttcatgggaacaggaaggttaacatccctggggaggggacctgcagtggggactctggggaagcccctcagagcttgggggatgggcagagagatgccagctctgtgcatgtgtgcgtctctgcctgtgtatataagagattgttctacctgacctggagagggagggtgtgtgtgtgtgtctctgcctgtgtatataagggatcgctctacctgacctggagggtgtgtgtgtgtgtgtgtgtgtgtgtgtgtgtgtctgcctgtgtatataagggatcgttctacctggcctggagggtgtgtgtgtgtgtgtgtgtgtgtgtgtgtttgcctgtgtatataagggatcactctacctggcctggagggtgtgtgtgtgtgtgtgtgtgtgtgtgtgtgtgtgtgtgtgtctgcctgtgtatataagggatcgctctacttggcctggagggtgtgtgtgtgtgtgtgtgtgtgtgtgtgtgtgtgtgtctgcctgtgtatataagggatcattctacctggcctggagggggtgtgtgtgtgtgtgtgtgtatgtctgcctgtgtatataagggatcgctctacctggcctggagggtgtgtgtgtgtgtgtgtgtgtgtgtgtgtgtgtgtgtgtgtgtttgcctgtgtatataagggattgctgtacctggcctggagggtgtgtgtgtgtgtttttgcctgagtatataagggatagttctacctggcctggagagagtgggagggcaggactttcctttggcatttttcagagtgtgtgggagaaaagcatgaactgtgggaagagctgggcatgccacctttgctctgtgaccagaagggtgtctgcgtctgccagctctgtgtgccgaggcagtgaaggggttccatacttgctaaggttttcgagagttctgtctcccagaccctgtgctaatcgcattgctggattgtctcactaaacctcacctccagcccatggactaggaatgattatgatccctgctgtagtggaacggctcagagaggataggacattggcccaaggcccccctgctcgagctgggatttagatagtctggtgccaatgcttatcctcttgtcttttttatttttttgagatggagtcttgctctgttgcccaggctggagtgcagtagtgccatcttggctcactgcaacctctgcctcccgggttcaagtgattcttctgcctcagcctctcaagtagcttggattacaggcacctgccaccacacctggctaatttttttgtatttttagtagagacggggtttcgccatgtttgtcaggctggtctygaacccctgatctcaggtgatcctcccacctcggcctcccaaagtgctgggattacaggtgagagccaccacacccggctgtgtacycttgtctttaacgcacactccatggtgtatatttatccatccagggagccagtgtttgctgagcacccactaattgactaatatatgcaaagcccttggaaaagtgcctggcacacaatagcagtatgctaagtgttacatattattattatcatcatcattattatttactatgctccagacattgatcctgtgtaggcactgggaattcagaagggagcaaaacagaccaaaacccctcccaaaggaaaagcttgcttttgagttaggggaattaacaacaaaattaatgagtaaaacatacagtatgccagggataagggctagagagaaaatgaagcagagaagcaggcgattgggggtgctggctggttagggctgcagtttaaactgggatggtcagggaaggccttcttggctttttagccctagcctgaaggaggtgagagaatgaggcatgtggatacctggggaggtgcatcccaggtgaatcggcagctccccgatttgatcttgttgcattggrttgccctgcagaaagaccgtgtcactaaactgtccctcctgctcaggatgacggtcccctgggcttcctcctcagcatgaagcttcaggctgctctgtctccagcccctgcccctggccagcccatgcagccgtctgcctctctggcattgggagtcccattcctcaaacttctggaagctgtcatggtgccccagtgtttctagtgcacaagcaggggctgccccccagatacagtgggtgtggctttttttttttttttagatggagtcttactctgtcacccaggctgaaatgcaatgccacaatctctgctcactgtaacctccgcctcccaggttcaagtgattcttgtgcctcagcctcctgagtagctgggattacaggcacacaccaccacgcctggctgattttttgtatttttagtagagacggggtgtcaccatgttggctaggctggtctcgaactcctgacctcagatgatccgcctgccttggcatcccaaagtgctgggattacaggcgtgagccacccacctggccagatgtggcttttttcctcccttctaatgaagatgaccctggccttgagtgacagagtctggacaagatgttaaggggcgtgttttttggcagagtgcacacccacatgggcagatttgccttgggtgtgagtcatcgataggttctagggaagccaattctggaaaagctgcagacaggccccgtaaagatatgggagggggaccgggcacagtggctcacccctgtaatcccagcactttgggaggccgaggtgggcagatcacctgaggtcaggagttcgagacctgcttggccaacatggtgaaaccctgtctccactaaaaatacaaaaatcagccgggccttgtcgcacacacctgtaatcccagctactgtaatcccagctacttgtcgcacacacctgtaatcccagaggcaggagaattgcttgaacccaggaagcggaggttscagtgagccgagattgcgccactgcactccagcgtgggcaatagagcaagacttcgtctcaaaaaaaataataataaaaagaaaaataaaaaaagaaatggcagggggagtgggaggagaccagggggaggaagaaagtggaacggggttgggggtggtggagaaacaggcagctgtcagttccrgtctccaacctgggaaggatatggggtaggaacaggctccgtaggagcagggtccctgcccctcartgtcctcctcctagctctgcttcaattctctctcacctgcattatctacgtaccaagcgcaggaatgccrtgttctcaattttaccatattcgtgtgccacctggaccattactgattttgtatttctatttaaaytgagtcacctaaaaatttcaaaaaataggccgagtgcagtggctcatacttgtaatcccggcactttaggaggccagtgtgggaggatcacttgaggcccagagttcaagactagcctgggcaacttggggagacccagtctctacaaaaaaatacaaaaactagccaagcatggtggtgtacgtctgtagtcctagctactcaggaggctgaggtgggaggatcacttgaggcctggaaggtcgaggctgcagtgaggagaaattgagccactgcactccagcctgggtgacagagaacctgtgttaaaaagaaaaagaaaattaaaaaaataataatttaaaagagacacagcrgagtgcattggttcatgcctataatcccagaactttgggaggctgaggcaggaggatggcttgaggctaggagttcaagaccagcctgggcaacatagcaagaccccatctctacaaaaaattagccaggcatggtggcacacacttgtaatgccagctacataggagactgggttgggaacatcacctgagcccaggagttctaggctgcagtgagatatgatagtgccactgcactccagcctaggcaacatagtgagatccaatttctacaaacaaaataaaaataaatagccaggtatggtggcatgcacctgtagtaccagttactcaggtggctgaggcagaaggatcacttgagcccgggagtttaaggttgcagtgagccatgatcatgccattgcactccagcctgggcaacagagagagaacttgtctctaaaaataaaattaaaaatgaaaataaaagagaaacttcaggtctcttcaataaatgcaaaaccatcagcacttgctgtaagcagagggtagctagaaaataaatataagggaagcagagccaaccattcaaatgcagtctgagcctgtggcctgcagaaactgctcaatgctgaagctgctctttgtgaaccatgcaagatggccaagggctagagagacaaagataggctggcaccacgtggggcctcatgcctggaaatggtcagcaggtttgaaagagaattgacaaggaggtaactgtctcatttctcttatctaaaaaccaggggatgcaggcagggcgtggtggctcatgcctgtaatcccagcactttgggaggccgagataggcggatcactcgaggccgggagttcgagaccagcctggccaacatggcaaaaccctgtctctactaacaaaaataaataaataaatacaaaaatcagccagatgtggtagcacatgcctgtgtcccagctactcaggaggctgaggcaggagaatcacttgaccctgggaggcggaggttgcagtgagccgagatcactccactgcattccagcctgggtaacacagcaagactctgtctcaaaaaaaaaaatgataaataaaaataaaagccagggaatgttgctagaaccttctgcataggattggtttggttctataatgagatgattcatgtaagagtcttggcgcaggacctggcctggagtaaactcttgataaatggttgtgtgtgcctgtgcccttgttcctctgcttacacaggaattccaggagaactgacatggtgcctttttttgtggccctgtcccccacccatgtgctgtacatcaaaggcatttaataaatatttttaacaggaggtgggagggacttgagttctgtgatgctgacagtgaccatttgtctcacttgtagccagtactcgtatgtgctcaacaagtgattgttgtgtaaaaaagcaaacaacagagtgtaaagtccagcagaatgtccactccacaaggacagggttttccagctgttgtggttactcggatccaccgcctagaacagtgcttggcactaagtaggtgctcaacgaacatttgttgcactgacatatgaatcaatgactctgtggatgaatgaatgaatgaagaaaagattgagcttatgaatgagtattagctcttcctttcccagacccaggagacaggccttttgtaaagtttcaggtccccatcacaggctgactgagccctaagcatggtgaccaggaaatggagaaagtgaacaaagaaagagacaaggtgggctcaggtctctggcctgaggcatctctagatttccctagcaacagcacctactggtggaggggagcatcctgggagctgccctggatgggctcagggtggggccaggaaggcgcgtaccacaggtggctgctgctttttttttttttttttgagacagggtcccactctgtcacccaggctggggtgcagtggcgtcatcacagctcactgcagcctcgacatcccaggcttaagcgatcctcctgcctcagcctcctgagtagctgggaccgccggtgtgcaccaccacgcccggcttatttttttttaaattttttgtagagacagggtctcaccatgctacccaagctggtcgaattcctggactcaagcaatctgcctgcctcagcctcccaaagtgctgggaccacagttgtcagccaccgcgcccagcccactggcagcttcttatcacccgctgaaccctcagtaatgtcccgtccaccccagcaataggctcttcaagtagggacgcctagatggtaggggctgttttccatgacagggcaaacactgggcaaagtggcaccaaggagcatttttcatctatataaggctttattttcttctgcgctgggctgaagtggtgcattctaagggttgtacatcccacccactgcccccacaaaggggaggtttctgaagaaaatccccagggcttccaagagaggtgttgccacattgagtgtttatatgccactcacattctgggcacagaacattcttatgggataatgtttaaccagcgtgtgggctgagttgctgtggctcacagaggaccaggtgaagggctggcctccttcctaggtgggctctggaggaggctgggcctccttgccctcccataacccagcttctcgtcttgactccaccagtaggaaacaggcatccttttgtcctctttagggagcaaactgctatctatttttcctggattttttcttaagctaatacagaagccaggactttgattctttgaaaaaaaaaattctgttttaagcaatttcttggtgcccataggttatgggcccaacctcattcagtcattccttgcatattaagatgtgtgaatgttttacagcttatgagaaaggaaaaaaagcaaagtgactgtaaaatccttgaaggcagggactgggtgttatacttgcaatcccacctcattcaggagcaatttactgtgtaatcagttttcccctatcttaaaatccgagatgggcaggattctataatttgtagggcaggttgttcccaaatttgagtgtgcacaagagtcactggggggaagctggttaaaaatctagatttccagatcccactgtgattcattcattcaattgatgtttattgagctactaccataagtagggtttccagatttagcaaagacaaatacaggatgtccatttaaacttgaatgtcagatcaacaaatttttttttttttttgagacagagtcttactctgttggccaggctagaatgcagtacagtgttgtgatcatagctgagtgcgacctcgaccttctgggctcaagcaatccttcctcagcctcccaagtagctgggattacagatgtgcactatatgcctggccagtttttcttttttttctgtagagatggggtctcactatattgcccaggctggtctcaaactcctgggctcaagcgatcctcccacctcagtgccccgcaaagtgctggaattacaggcactaagacactatggccagccaacaaattattatattttttaaattttatttagtttttgagacagagtttcactcttgttgcccagtcttgcagtccagtgcaatggtgtgatcttggctccctgcaacctccgcctcccaggttcaagcgattttcctgtctcagcctcccagtagctggaattacaggtgcttgccaccatgtctggccaatttttgtatttttagcagagatgggattttaccatgttggccaggctggttttgaactcctctcctcaggtgatctgcctgctttggcctcccaaagtgctgggattacaggcgtgagccactgtgcctggccaaattattattatataggatcttgctctgctgcccaggctggagtgcagtggtgcatcacggctcactgcagccttcacctcctggggtcaggcagtcctcccacctcagcctcctgagtagctgggaccacaggtgcaaaccaccacacctgactaatttttttgtattttttgtagagatgggttttcactatgttgcccaggctggtctcgaactcctgggctcaagcaatcctcccacctcagcctctcaaagtgtttaggattataggtgtgagccattgtgcctgacctacaaatcatgttttaacatcagtatgtctcatgcaataactgggggggcttgcctccttgcattcatgctactataaccaagtaccaccataggctaggtggtttgtaaacatcaaaatttatttctcacagttctggaggctaaaagtccaaggtcagggtgccagcatgatcgggttctggtgagggccctcttccgggttgtagacagcctttgtatttcttcacctggcagaaagagagtaaagtagcctcttcttataaaggcactaatcccattcatgagagctccacctcatcacctaatcgcctctcagaggccccacctccagcacactgggacagattaagctttcaatataggaattttgggggaacacagacattcaggcagtccattacagaacatacacgagaaagtgctttgttgtttatatgaaattcaaatttaactgggagtcctatagtttaactggtaaccctaatgctgcaccaaacactgttctaggcgataggagaacagtgtgaacaaaacacagcccctgatttctgatagcttatgttatagtcaggaagccatttcctggtgcccccrtagggtctggagacaaactgattcatgcagacaaatagatccaggaagaaagggggaagccaggtgaggggtgcagtgatggaggtggctgtccrttttgaatagagtagacagggaagctctttctttggaggtgacatttaagcaaggacctggagaggtgagatttggatgcagtaagtgtgtagggctcaaggatctgcatagataataagccattctggaagaatccgatgtggggatctgcgaacgccactttgagaaaaatgactttagggtttcaagcctcatgtccayctctgatgatgcacttagctgtttacagctcctctctgggcctcagttgacttcatatgtgcaatgggaatagtagtcactgactcactttctcacagggcagttgtgggtatcaaatgacgtaaaagatgggaaaggactttgtaaactgaaaaacgctcagcagggtctcgactagtgccatccattagaaatacagtgcaagccccttgtgtaactttaaagtgtctagtagctgcttgaaaaagcgaaaaatgtgaaattgattttatgttattttatttattttttgaggcagagttttgctcttgttgcccagtctggagtgcgatggtgcgacctcggttcactgcaacctcctcctcccgggttcaagcaattctcctgcctcagcctcccgcgtagttgggattacaggcgcctgccaccacatctggctaattttttttctatttttagtagagacgggggtctcactaygtggcccaggctggtctggaacttctgacctcaggtgatccacctgtcttggcctcccaaagtgctggtaaaacaggcgtgagccaccccgcccggcgtgaaattgattttaataatatgttttatgtaatgcataatactttgataataatataccaaagtgttatttttacatgttgtcaatataaaaattattgcagagatattttataacatttttcttgtgctaagtcttcaaaatctggtgcatgttacgtgcttacttacggctcatctcaatttgcactagccacattcaagggcttaacagccatatgtggccctcggcctcatgttggacagcacaggctatagcatgaataktatgtgaagagctggcctcattgttttaaaacacagtgtattagtggaaattttgaggtataatcatacagtaaatttttttatatttatattttactttttttttttttaagagayggagtctcgctctgtcgcccagcctgcagtgcaatggtgccatcacagctcactagagcctcaaactcataggctcaagccatcctctcacctcagccttctgactagctaggactatagacatcagctaccaggcccagaaaattttttttttttttagagatggggtctcactgtgttgcccaggctggtctcaaactcctggcgtcaagtgattctcctgcctcggcatcccaaagtgctgggattacaggcatgagccaccatgcccagcctttgttttattttttaaattgacacagtaattgtgcgtatgttttgacgcacaccatgtgtagtgatcagggtaacttgcatttccgtcatctcaaacatcatttctttgtgttgggaacatccactatccgccttctagctatttggaacttatgtttcagtcatcctacagtggcataaaacactggaacttattcctcccacctcgctgtaactttgtatcctttaagaactcactctctatcccccaccctttcccttccccttcccagcctgtagtatcctctgttctactgtttacttctatgagatcaacactttagcttctgcatatgagtgagagcatgtggtgtttaactttctgcccctggtttacttctaaggtggaatattgaacagtaaagtgaaacagaccagtgacacaacaatgtgaatgattcttacaataggctaagtaaaagaagccagactaagggcaacagatcaacagatgatcaccatcagaaagatagttcccaagaagagggggcattccacaccacaggggtccacagggggagcactggggtggctcaggaaggagggagggagggggagaaacgtgggcaggagcctttgttatggtttccatgggaaggacagggtggggcagggtaagaggcttaggaatggctaatgaggatcatttcagtgggctctgggggagagggactgtccctagttgaatagtacctggcctggggtgattagagcaggtgtaytgtggcctggtggacagtgaatgcccagtaaaggaggtggttggactatgggctctaggttggttgctttgcatttgaagagtgtgctccagggtgacttgtctgcttatcgctaggttatcactggctaaccctgggagggctagtgcctctagggtcagcaaggcctcagatatcaaagctctagaacacaaaagataagacatgtgtcatgtactcatactgcaagagatttggccaggggcacggcacagcgatccagattggtttgggtgaatatcagtagctctgtcatgtctcagccctgccagcctgcggccagccccttagcttttaacaggaagagagatttcaaggaattgcctgaactgagcttcttcagagcttgtcgctctctgcgactgttctttggagctagtctcgtgctagaagttgtgaaggctttgcctaattccagttgagatgttcaagggacaggatccctttctcctcctttcatgtgattatttatttattagacagtgtctcactctgtcacccaggctggggtgcagtggcgtgatctcagttcactgcagcctcaacctctcatgctcaggtgatgctcctgcctcagcctcccttgtagctgggactacaggcgcgcatcaccatgcctggctaattttgtctatttttcgtggagacaaggtctcactatgttgccccagtctggtctcaaactcctggactcaagtgatcctcccacctcatcctcccaaagtgctgcaattataggcatgagctaccacgccaggcctctatgtgatattactgcccaactccaaacatggtagggtctggggaatttaggggtttctagtgcctgcttataatcacctaagtgtattgggagatgaggagtggtattttcctctcccttggaaataccaggcccctcttggctgtaacgtctcagtggctggtgcttggggaccatgggaggagagtgtggggataggagcctctttcggttaatatcatctctgatgctcacccctcaggccccaccacaacctgcctgtccacctgtaccacctgggctaatccacatgcttctctgaagacttgctcttcaaagagacaagcacaatgcaaattaaaaccataatataccactacatgttcaygagaatggctgaaattaaaaagactgaccacactaagtgttgacgaaggtggggagcaactggcagtcgtgaatactgctggtgggaatgaaaacwagaaacctgggggaaaactttgacagtttctaaaaaagtgaaacattgacctattctatgatccagctrttccactcctaggcatttacccaaaagaaataaagtatacatctccccaaagactcagatacaaatattcatagcagctcttatttgtaatagccccaaagtggaaacaacccacatgtccatgaacaggtggctagatgaaaattgtggtctagctatatggtggaatattgtgcaatgaaatgaaacagatcattgatacacacaacaacatgaataattctcaaaataattatgctgagtgaagaagccagaaccccctccctccaaaaacaaatatatatatactgtcagattctgatgctagaaaggcaaactaatgcaccgtgacagaagtgtttatctatgatcagtggttgcctagggtaggcggaggcaggagagayggattgtaaagcggtatacagaaacctttgggagtgatggattcattcactatcttgattatggtgatgatttcatgggtatatacataagtcaaacctcagctaattgtaaacattaaacgtgtaatttattgtatatcaactatgcctcaacaaagcygtaaagcttaaaaaaatctattttttaaaaagtcacgtacaraccagtcatggcggctcacatgcctgtattctcagtgcttcaagaggttgaggyggcaggatcactttaggtcaggagtttgagaccagcctgggcaacagaaagttagctgagtgtggtggcaggcacctgtagtcccagctactgaggaagctgaggtgagaggatcactggagcccgggaggcagaggttgcagtgagccatgatcctgccactgctcttcaatctgagcaacagagaccctgtcacacggaggaggaggaggggaagaaagggggaggaggaaggggggaggaggaagatgggaggaggggagagggaaggaaggaaggagaagaaaggaaggaaggagaagaaggagaaagaaaaaggaggaggaggaggaagagaaagaaggagaaggggaagagaaagactgaggaggaggaagaggaggaagaaaaagaagaaagaagaagcatgcataagctttaggggtgggctggtgggagatcagactgtgaggcagtgccagcctccagtcccaaggcagatctgggagcaggcactaggatgcagatgcagaggggacacagaaggggacaggtgggcctggaccctccccaggagtggctcacactctgattgggggacccaacctaccctgctgtgaaccagtctgtctgaggtgtgttagtggagacacaaacctttgcttatgccagagatgtgatttgtttcaattgggaggatgggatgaggcttcttggaaacaatggtatttcaatgtattggtgtcttatttgaaaaatagactgtgagcactggaatagctgacctctgatgagcacttagtatgtgctagggactcttggaaagctgcacatgcagtattccatttttttcttgtcacacacttgatgggagggcacttttatcacctccatttaaggacatggatgcccaaggtcttataggtataggtcttttaggtatagtggtgataccaagatttggcccctggtggtctaatttccaattcagcactcctattattcccaatctgtctctggtgtgtgagtgtgtggatggagaatatattggaatgtacaactgtttgggttttttgttttttgttttttggagatagggtttttgttttttggactccaggctggagtgcagtggtgcgatcatagctcactgcaacctkgaactcctgggctcaaacagttctccatcctcagcctcccaagtagctgggactacaaacgtgcaccaccatgcctggctaacttttaaaattattttgtagagataaggtcttgctctgttggccaggctggtctcaaactcctgggctcaagtgattccaccactttggcctcccaaaatgttgggattacaggtgtgagccactgcacccaaacttgagtatgatttgaaggtgcctttgggacccttatgttgtaaatcattgtcacttatcactagtctaaaatggaaaaggtagacggtattgaacaaatgttgaattaattacccccatcacttgcagatagtactttttgttttacatcatagtcttgtctgtctctttccccagacttccatggttttgatgatgaayctttcaagtaaggcttcactggttgtttctttgaattatcctcttcattaattatggtgaacagggtagaaatggtcaaagatgttgactcactgtggtcttgtataaggtagcagtcacattcacaaagcagatgcccttgtatggaacagcaggtgcatctctagcaggtgaccccatgaagatgttcctggtggagctgatgaatagcttctttaggtggtatggagtgtctgggcaaatgaaatcgaactcttcatgatcatgagttgcactggcacatccttctgatcattgaaggccatcatggcaggacatcactgcmtcatttctaggcttctcagggactgagcacatgcarcctcaccattgtgtcctgctgagtctgggaaggggtgtcaagacagcctgtcctcaaagggccttgtcrcagaagagggacaccgtgaccagcagaactgctcacaggtcaagggccactgggtgacaatagggtagagagtggatgtttcagtcacggtcaggtgacatcgtttagtgccagtgtctcagttccgggtgtttgtggttggccaagtgcaaggacagcttccttctggaataaatgcataggcttttgagcccattctttgttcattctctcgttcttttattttttgttgtggaaagtttcaaacacacagaagtagagagaatcatataaaagactcccaccaggtgctgtgggtcacacctgtaatcccagcactttgggaggttgaggcatgatggttgcttgagcccaggagtttgagaccagtctgagcaacatagcaagccccaatctcttgaaaaaaattaaacaattagccaggtgtggtggtgtgtgactgtaatccctgttacttgccaggctgaggcgggaagatcatttgagccctggaggtcgaggctgtggtaagctgcgattgcgcaactgcactccagcctgagtgtcagagcaagaccctgtctcaaaaaaatgaaataaatgaaagactttcatgtacccaacacaaatgttgacatttcaccactcgcgtcttgtatttgactttttctgattttcattgtattttctgttgaggcatcacagtcagtaaagcttacagcttgatggattttgaagatgaattttcatctatgtttatatctgtgaaaccttcagatcaagatgtagaacattctcagaccttagcaggctcttgcctgcccctccctgagatctgcactttcataaattgtagggtacaatggtgacatcatattgggaaaaatatcttgacagataaaaagttttgtcttccttcttgccttcctttctccctcccttcctctcccctctcccctcctccttcctcctcccctccctcccttcttgcattcttatatccttcccttcttccttctttattcactgatctagttattaagagggtaaactctggatttttttttttttttaaagcgggctgggtgtggtggctcatgcgtgtaatcccagcactttgggaggccgaggcaggtggatcccttgaggtcaggagtttgagacaagcctggccaacatggcgaaaccccatctgtactaaaaatacaaaaatcaatcctgggtaacacggtgaaaccccgtctctactaaaaatataaaaaaaaattagccaggcatggtggcaggcacctgtaatcccagctactctggaggctgaggcaggagaatggcgtgaaccccggaggcggagtttgcagtgagccgaaatcgcaccactgcacgccagccctggtgacagagcgagactccgtcaaaaaaaaaaaaaaaaaatcagccaggtgaggcagcaggtgcctgtaatcccagctacttgggagactgaggcaggagaatcacttgaacttggggggcggagtttgcagtgagcccagatcacagcactgcactccagcctgggcgacagagcgagactccctgtcaaaataataataataataataatggaaaatacatacagatccagagtttactttcttagtaattaagaaggtaattactaagaaggtaaactctgagtctgtttgaatacacacacacacacacacacacacacacacacacacacgtatgtatgtatatatgaaaaaacccagatgaagtgaaactggcttagagattggcttagagattatttcagattaacagtctctgtcaatctgaaaggcctgccttcctccttcccttcctctccctcttcttctccctcactcccttactttgctttcttcctgctgagcactgattggcaactctaatggctattggaggttcagaacaaaaccaaccatgatactggcccgtcttccatgtccacagtgccccggtgacaagaggatacctgaagcggcttctcagggtttctaaccctttttttttttttgagacaaagtctcgctcttgtcccccaggctggagtgcggtggcacaatctcagctcactgcaacctccgcctcccgggttcaagcgattctcctgcctcggtcccccgagtagctgggattacaggcgcctgccaccacgcccggctaatttttgtttttttagtagagacggggtttcaccacgttggccaggctgatctagaacccctgacctcaggtgatccacccatctcggcctcccaaagtgctgggattacaggcatgagccaccgcgcccagcctcaaggtttcttaggaagggtgagcttcctgccctaaaggtgctcaaggccggggaaggagtatcttaagtgcctggctggaggctgacctagctgacttgctccccccaggcccccagtcagaggaggtcagaagggcctggtgggtggtgacacctgtgtgttccctcgcagacgctgcaggagatcttccaggccgagaacaccatcatgctgctggaaaggtccatcatggccaaggagggcccgctgaaggtggcccagacaaggctggagtgccggacccggcgccccaacatggagctgtgcagggacatcccgcagttgaagtaagtgagggaggccagaggaggcaggagaacccctgggaatccaggaacsggaaggggtgagtctcaggagcttctaggtgcactgggtctgaaaaatggaccctccttcaatcaggacatccagtcccacaactcagtagagtgcagggtgtgggtggagttctgagatgcagctcgggctgtaccactgcgtggcttcctcatcactgggagccccaccctgtgcactgtggtcttctcacttgcctaaactaggggtggttttgtaactctgttgtgctctagaaaccctcttgtttcacttgaaagccaaggcaatgaatggtcgcctcccaggtggtggctttaccttctctctccaggcttccatgaaagaggcacccattcctcactcatttcccacctccctttttgtaaagttcttaccatgaagccctggaagagcctcatgagctcctggctggtggatcccacccatcctgctgtgctaaagaggctggtgtctgttgacgaagggctttctcacaggacaggggtcaaaagctcatgccagcccagaaaggaggtttgtggggggyggggggtggggattgtaataggatgatggccaggccaagaaggaacaggtcatcagatatggggattatttcccatgaacgtgctgtatgacttggggcaaaccacttggccactctgttctccccatgctaggggcattatcttagttgtctattgctgtgtaataaagtaccccaaaaggtagtgacttgaaagaaccacatttgttatctcagtttccgtgggttaggaattgggctaggttccttgctatgttgtacatgtcagggtcttccgcaggttgcaatcaagctgtcagctggggctgtggtcttatctcaaggctggactggggaaggttccacatccaagctcactcccatgcttgttggtagaactcagttctttgctggctgttggctggcagccaccctcattyacccatgggtctctccagcatggtggcttgcttcaacaaagcatgcaaaccagaaggacaatgacagtaccagccacaaggatgtcacagtcttttgtaacctaaccatggaagtgacagtccatcactctttctgcatgctcttctttagaagcatctctaggtccacactcaaggatgtgatgccaggaggaccccacatcattgagggtcatccttggagcatcctcctatgggcactaacagggtttccggtggagggggaagagactgagtctggccccatttcagctgctcatttgctccataaaccttattctgcattcactgtgcccagggctgtgctcaccgggtttcatagcagtacttcttttgacaagatactgagttgatatcccccaagagaaaaagattgaaaggaccatcctcaggcttccttgggcatattatttcagccctagcctacagcaagggaagttcaccctgatggctaactgcaatcccttgaacttcttttgagttctttgccctttagtctcactcctaggggagttgggaagtcagttactcctactgttgtcaaatgggaagataaattgaggtccagagaggttgaaaaagctgtcccagtcacacagcactaagccagggcttcactgggcagggagcacaggtcttggtccagcgatggaccctgctccctccatcctggtgtggagaccccactgctagatgtgaaaagatgtcaagaagagagctatcagttaggagaaggaggatagataatcaagaaaaagtgttgggtggtgcccaagcgatgatttttgcacagcctcagttaccgcctgagtaaccatttaggaaatggaaaaagcaggttatgtgttggggtggggtggaggggcaggcaaattgatccaaggctttgaacttgagggtctggggtccctcccactttggaaggccgaggcaggaggatcacttgaggccaggagtttgagaccagcctggacaacacagcaagacactatctctaaaaaataaaatacaaaacttagccaggcatcgtgacatgtacctgtagtcccagctactcaggaggctgaggcagaaggattgcttaagcccaggagttggaggctgcagtgagctatgattgcgccattgcactccatcctgggcaacagagcaacacccagcagacctgctgctggcttgctaggtcttcagycctggaagtgagatggatagggtctaggtcctgggtgcaggagagtgggggctgggctctgctgacctctcttccctctgcccctgcttcttcgatgctcaggctgaaccccagtacctcctgaagtggagggctcaggtgatccctttgcctccccaacgagagtttttttttaattgagtcttgctctgttgcccaggctggagtgcagtggcacgatcttggctcactgcaacctccacctcccgggttcaagagattctcctgcctcagcctcccgagtagctgggattacactcgcctgccaccatgctcggctaatttttgtattgttagtagagtcagggtttcaccatgttggtcaggctggtctcaaactcctaacctcaagtgatccagccaccttggcctcccaaagtgctgggattacaggcatgagccacagtggcggccccgccaggggacttctacagaacagggcttctgggggasttgcctggaggacctactgctttggggcaagctctctgccttcccgtttcccgttcaacagtcataccactgaggaggacagacagaaagcaaggaggtggagcatgtttggttcaggagccgggccktgtgtgtgtgtgtgtgtgtgtgtgtgtgtgtgtgtgtgtgtgtctgcatctgtgtatgttgtgttttggtttgtatgcatggctgtcttcggaattgagcagatgataggattcaggctgtctcccttctccagtggctaaattgtcccatctgtgcatgatcttccttgtccccgtcctctccattcctgcctttgggccatctttttccttttcctcctataagtggtctctcttctcctgacctactccaatcactagggtcccatccatgcctatcccccagaaagaaagtccatttaaaattgaactttaaaggctaggtgtggtggttcagacctgtaaccccagcactttgggaggctgaggtgggaggatcacatgaggccaggagttcgagatgagcctggacaacatagcaagaccccatctctacaaaaaatacaaaaattagccaggcatggtggcatgcctatagtccaagctacttaggaggctaaagcaggargattgcttaagcacagaagttggaggctgcagtgagctataatcgtgccactgtactccatcctggggaacaatgcaacaccctgtcaaaaaaaaaaycawaaactgaattttaatgaaaattaaataaagttaaaaattcaattccttattcacaataaccacatttcaagggctcagtatccacatgtggctagggttcaccatatcagacaacatagcacagaatatctcccttgctctagaaagttctattggacagagctggtggaagtttccaggctgcttctgtcacttctctttgcttctctctagcccaggcttcccatggggaagttcacccagcttcatgtcctctggtcctgagcacagtttcactgtctcttctccccagaggtgggacccgcagcacagtcccacaaccaagccaccatcacagctcaccttgccgcattcatttcccagggctgctatcacaaattactacaaactgggtggctacagacaacagaagtttattccctcacagctttgggggccagaagtcccaaatcaaggttgctgttcctggaggctctgagagaggctctgttcccttccactctcccagctccggagggctgtcagcaatccttggcgtccctcagcttgtagccgcatcgctcccatctctgccttcgtctccacatggccttctctcctgcatgtctccatgtctcaaacctccctctcctttctcttatcaggagatcagtcattggatttaggtgtcaccctaaatccaggatgatctcatcttaagatcctaaacttcattacagctgcaaagaccctatttcctaataacattacacgcaccagggcttaggacttgaacatatctttctgaggaacaccacccratccgctccatgtggattcacaataacctcctaacctttctcctgcctctactcttgcccccttccaatctcatcttacacagcagcctggaggttatcccgaaactcgagtcagcatgccattcccctgtttcaaccctcccccgcccccaccccatggcttcccacagcactgagaacaaacccaagccctttaattttgcatgtgcttttctctctctctctctctcttttttttttttttttttgagatggagtcttgctctgttgtccaggctggagtgtaatggtatgatctcatcacactgcgacctctgcctcccgggttcaagcaattctcctgcctcagcctcccgagtatctgggattacaggcacctgccaccacacttcgctaatttttgtgtgtgtgtgtgtgtgtatatatatatatatatggacatagatatagatatatttttagtagggactgcgtttcaccatgttggccaggctggtctcaaactctctacctcaagtgatctgccacttcagcctcccaaagtgctgggatgacaggctgcaacctctgcctcctgggtcagcctcccaaatagctgtgattacaggtgtgcaccatgacacctggctaatttttttctatttttagtggagacggcattttgccaccatgttgaccaggctggtctcgaacccctgacctcaagtgatctgcccgcctcagcctcccaaagtgctgggattacaagcgtgagtcaccacgcctagccaaaatttaggttttaaattaatacagctaaaattcaggttctcaattgcatggccacattcaagtgttcattagccccatggggctggtgggtaccatatttgatggtgcagatatagatctttccatttttgcagaaagttctactccacggcactgctgcaacatactttccctcttggccttcaacatgtccagctaagtcttatctttcttctctgctcaaagtcctctcctgggaggcggagggaggaggatcacttaagcccaggagtttgagaccaacctggaggcaaaaaaataaaccccatctctataaaaacttttttttttaattagccaggtgtggtggtgcctgcctgtagcctcagctatttgggaggctgagacaggaggatstcttgaacccagaggtttgaggctgcagtaagctatggtggcaycactacactccagcctaggtgacagagggagatctggtctaaaaaaaaaaaaattaaaatcagctgggtgcggtggctcatgcctgtaatctcagcattttgggaggctgagttgtgcagattgcttgagcccgggagtttgagaccagcctgggcaacatggtgaaaccctgtctctacaaaacattaaaattagcctagtgcagttttgcacgcctgtagacccaggtacttgggaggctgaggctggaggaacgcttaagccaaggaagttgaggctgcagtgagctttgactgcaccactgcactctggcctagacagagtgagactctgtctcaaaaagaaaaaagaaaaaaagtcctcccctcggaaagttctagataagcaaagcctcagaaggagaggggtgaggaagtagtacggggcagcccagtcccagctgatcctgcaaggggcgccagaccttgaagtgcatcacagagatgtctgcaccagaggccctttgtacctgagtcagccagccattgtctgtggccgctggcagggactatcctcccaggtgagatagctcagattggctgagcaacttaattgcctggagaactgcggacctgtgagccattagcagccaacactcactcgtagcagctggggatggtgccctggccagtaaggaagacctgagtgaggctcttatctagacaaggctggccctgttatcctgtttattaaaaaattatagggccaggcgtggtggctcatgcctgtaatcccagcactttgggaggctgagactggcggattgcctgagcttaggagttcgagaccagcctgagcaacatggtgaaacactgtctctactaaaacatgaaaaattagctgggtgtggcggcacgtgcctgtaatcccagctacttgggacgctgaggcaagagaattgcttgaacccgggaggcagaggttgccgtgagccgagattgcaccactgcactccagcctggatgacagggcgagactccatctcaaaaaaaaaaaaaaattgtgataaaatacatgtaacacaaaatttaccatcagtgacatctggtacattcacgatgttgtgcaaccctcaccactctctagttctgtgatgttttcatcaacccaaaaggaaaccccgtacccattaagcaatcttctacattctccccaccgcctgacctctggaagccaccagttaactttctgtccgtatggctttgcctcttctggacatttcctgtgcatgcagtcacgcaatatttgtccttttgtgtctggcttcctttatttagcatcatgtttttcaaggttcattcatgttgttgcaggtattagtatttcattcctttttttttttttttttgagacagagtttcgctcaggctcccaggctggagtgcaatgatgtgatctcagctcactgcaacctctgactcccgggttcaagagcttctcccacctcagcctctcgagtagctgggattacaggcacccaccatcatgcctggctaactttttgtattttcagtagagatggggtttcaccatgttggccaggctggtcctgaactcctgacctcaggtgatccacctgtctcagcctcccaaagtgctgggatttcaggcgtgagccaccatacccagctgtatttcattcctttttattatagctgaataatctcccattctgtggctcgattacattgtgcttatccactcatccatccatccacagacatttgagctgcttccaccttttggttatcgtgaatagggctgcygtgaacattcatgtacatattttggtttgaacgcctgttttctgttcttttgggtatatacccgggagcrgaactgctggactgtgtggtaagtctatgtctaacttatcgaggaatctccagattggtctcctatcctgttttaccatcctgtcttatttcttcctttgtgtacattacccttgacagttctcttgtgtatttacttgtctacctgttctgcctctgccttcccctggagggccgagccttgcctgtcttgcttgctgctgtctctcagtgccaggcacagttcccagtgcacagtgagtgcatctaccttgaaccgaataacctgtgctaggtcgggcaccatagctcatgcttgtaatcccggcactttgggaggccaaggcaagtggatcaactgaggtcaggagttcttgaccagcttgaccagcatggtgaaaccctgcctctaataaaaaaaaaaatacaaaaattagctgggtgttgtggtgcatgcccgtaatcccagctactcgggaggctgaggcagaattacttgaacccgggaggcagaggttgcagtgagccgagattgtgccactgcactccagcctgggtgacagagtgagactctgtctcaaaaaataaacaaataaaaataaatgaataacctgtgccttctcctctgccctcaccccaggctggtgaacgaggtgttcaccatcgacgacaccctgcagaccctcaagctgcggctgcgggagacacaggacacgctgcagctgctggtcatgaccaagtgcyggctggagcacgagctcgccatcaaggccaacaccctctgcatcgacaaggagaagtgcatgggcatgcgtaagaccttcccctgcaccccgcgcctggtgggccacacctgagcaccgccctggcgcctcattccgcgctggcgtaaaattggaaaaggctgagaaacaaagtaaaacagtattttgtttgaaagggccgactttctttttttcttatctgtttcttctctgcctgcctttctttctttctttctttttctttcttttcttgctttctttttctttctttctctttctttctttcctttcttttctctctctctctctatcacctgcttgtcaccttaggggcacagtgtaaaccatggtgttttaagattagacttggcagctcaaagtctagagcccagctctgtcacttaggagctgtgtggcctcgaacaagcttctaacctgtggtcctcatctatggaatgagggtagtccgaggtgcaggggactgtcagcagtgtggggcagagaaaaaaacaaaaacaaaaataaccaggatttgcaatcagaagttctagatttgaatgccagccttggtagatggagtatttatttatttatttgagatggagttttgctctgtcacccaggctggagtgcaatggtgcaatcttggctcactgcaacctccacctccggggttcaagcagtttccctgcctcactagctgggatgacatgcacctgccaccacgcctggctaatttttgtatttttagtagagagataggttttcaccatgttgaccaggctgatctcaaactcctgacctcaggcgatccacccatctctgcctcccaaagtgctgggactacaggcatgagccactgtgtctggctgttggagtgttttagaaatacctatgggaggccaggtgtggtggctcacgcctgtaatcccagcagtttgggaggccgaggtgggcggatcacgaggtcaggagatcgagaccatcctggctaacacggtgaaaccccatctgtactaaaaatacaaaatattagccgggtgtggtggcaggtgtctgtagtcccagttacttgggaggctgaggcaggagaatggagtgaacctgggaggcaaagcttgcagtgagccgagattgtgccattgcactccagcctgggcaacagagcgaaactccgtcttaaaaaaaaaaaaaaaaaaaagaagagaaatagctatgggaggccaggtgcggtggctcatgcctgtaatcccagcactttgggaggccgaggtgggtggatcacttgaggccaggagttctagaccaccctggccaaggtggggaaaccacatctctactaaaaatccaaaaatttgccaggtgtgttggtgcaaacctgtaatcccagctactggggaggctaaggtgggagaattgcttgaacctgggagacggaggtttcagtgaggcaagattatgccactgcactcctcaaaaagtagttacacataaaactgccctatgactcagcaatttcactcctagatgtttacccaagagaagtgaaaacgatcctcaaatactcatacacgaatgttcagagcagcactgatcacattagtcaaagggtggaatgacccaaatgtctatccgtggatggatgggaaaacgaaatgtgctgaatccgtacaacggagtctgattcagccataaaacggaatgaagcactgatccatggtacaacgtggatgaaccttgaaaacaggatgctaagtgaaaaaagccagacacaaatcccacatagtgtatgattccatttatatgaaatgtccagaataggcaaatccaaagaaatagatgtgattgctgggagaaggtaatgggcgtgactgcttagtgtgtgcagggttttcctttggagtgatgaagatgttttggaactagagagagttggttgcacaacattgtgagtccactaaatgacatagaattgttgcactccagccaggctgcagtgcaatggtgcgatcttggctcactgcaacctccgcctcctaggttcaagcatttctcctgcctcagcctcccaagtagctgggactacaggtgcccgccaccacgcctgactaactttttgtatttttagtagagacagggtttcactgtgttagccaggatggtctcgatctcttgacctcaagatccgcttgcctcggcctcccaaaatgctagattacagccatgagccactgcacccagccaggcctctgtttcttaatatacctcttctgtaggggatttcactccttcccctcttttttttttttttttcttcttttttgagatggagtttcattcttgtcacccaggctggagtgcaatggcataatctcggctcactgcaacctttgcctccctgggttcaagcgattctcctgcctcagcctcccgagtagctggaactgcaggcgcacaccactgtgccaagctaattttttgtatttttagcagagacagggtttcaccatgttggccaggctggtctcgaactcctgatctcaggcgatctgcccaccccggcctcctaaagtgctgggattacaggcatgagcccagcgtgccttcccctccttttaatcccattcatccccccactgactcccaaacttctggcttctaaatccaggctcctgaactcagctcctgacgacatttctagctttactcgcccagctccaggccacgctctgttcctccctcagtaaatgccccaccagccgatcctcaaccttgaactcatccttgattcctctctttctcccacaccccacatttaattcatcagcaagtcaggtgcatactaccttcctaatctttcctgaaattggccactgctcgccttctcttctgttaccatctgaggtaagcacctattatgtctcctgggcaacgtgggcaacaggtacagtggggaatgcagatgagtcaacttggactgtgacccccccaggcgcttacaggtgctacgaggagtcacagggcctatacaccaccagatgcagctacatttgggcagacgggggccagtgatctttcaggaaaaatcaagtttgaagtcaggcacttgagttgggaaggtccctgcacttcagtgagcctcagtcaccttgtctgtatataatggttcccccaccgtgaggatgtctaggaaaacctcagcattattgggacagaatgcttgagcccatctgagcaccaaaatatgggtagaaaaaaataatagatctccaacacgttttaagctattattgaaatgttcgtggatgccattgggttcaaccaatacattattgaattgatactggccttctgttgttatagattttctttgacaaatcctgaaaattaaagaaaaggagggcccctctcctccccgctcgcgacccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcagaacttaacaactagatctaatttgactccactcctcactagctgtgttgccctgggaaagtcactgagtcactgaactcagtttccctatctgtcagagggggccaatattcatttctcccrttcatgggtgactgtgaggactaagtttggatgataggactaatacctcccatatctaaggggtattcagtaatatattaagaataacagctcatatttattgaggatttgctctgtgccaggcaattttaaaagtaccatctcattttaattatcactgagccctgaaacatggaaatggaaattaaggcacagagaggttaagaaacttacccatagccacacagtctccttatctatataatggtccccctaagtgaggatttgcaaataataaatgactgatacaggatttaagtccacttatgagaatccagggtctgaactactactgaccacagcttcccaaataaagaaaaaactattgtttagggtggacccacagaccaaaaagggtcaggcaaaggccaagccccacaggggcatctaaaagagcagaggaccccacagtcttgctctcagaggggctgatttgattaaacgtgtctccattctctggagaagagagtaatgataacaataacaattgtaggccaaggtgggaggattgcttgaggccaggacttcgagaccagcctggacaacatagcaagaccccatctctacaaaaaaaattcactgggcacggtggtgtgcacctgtggtcccagttagttgggaggctgaggcaggagaatcacttgagtccaggagttcaaggctgcaatgagccaggttggtgccactgcactccagcctggaagactgagcaagaccctatttctaaaacaacaacaaacaaaacaacaacaacaactggtgctaacagcttgaatgcttgggagatagacgccaagtgctctatctaatccccgtgctcaaccccgctttacagataaggaaactgaggcacagcgagtctaggtcccttgcccacagttacacagctaggatgggttggccctggccttcagcgcttatgcacccaccacccaggtggccccccactggtgcttctgcccccgcttctctactcccagccagtgtcagtgacaaggcactgcctgggagggaggcggctgcattttttgcctggtccagaaatgtcagtgcgtcactgtcacacaaagtcctggctgttggctcctgtgattcccaaggcactctaaacaagtgtccctgctcccagggtgaggggtggggggcggagcaggaatgggagacaggtttaaagcacacaattaaaattcctaaggggcgatatggagtcttattccacatgcagaacattcttggtctccatatggcacagggggctgggctataagcctcttgccgcaccttctcccatcccatgtgaccccagactagctccccggtggaattctctgtgtctccgagacagctggcccctccctccccacccccacccagcaaggctgcttgggattcctggcgctcctccgggggcaggcacgggtgtgggcacccatgggccgcagaaccctggacagcctgagttggggatatccgaggggctgctggcccaggccccatgcctggtaggtcagcacctggcagtgtgtgtgtgtgtgtgctgggagtgggtgtctgcagccgcccctgctgggccctgggttgttggtggtctcggaagataagggagacccatcagctgagggtgtgaatgagagagacctgccttccccaggggtgtgggcctcctctcctgataaggggctgcctttaggagctgagagcagataagaggctgtccttatccacgaactgaacggcagatcagggaggaccagggcgaggcaaggcaggcaggacactgggagtgcaaaatctaagaagtcttcactttgggtcacttcaagttttttttttttttcttttcttactttatttttattttttgagacagggttttactgtgtcccccaggctggagtgtagtggcgtgatctcagctcactgcaacctctgcctcccaggttcaagccattctcatgcctcagcctcccaagtatctgggactacaggcccatgctaccacacccggctaatttttgtattctttgtagagacagggtttcaccatgttgcctaggctggtctttgaactcctgagatcaagtgatccacctgcctcggactcccaaagtgctgggattacaggtgtgagccactgagcctggcctttttttttttttttttttttttcccagacagggtctcactgtgtcacccaggctagagtgcagtggtgtgatcatggctcactgcagcctcc

SEQ ID NO: 10555 - DNA, 34304 bp, Homo sapiens
  misc_feature (1)...(34304): n = A,T,C or G, or insertion/deletion polymorphism (see Tables 1-2)
aagcataacaagagtcaccaggaagtttctcatctgcatctgagaccatctccatctagacttcattttccatgtcactatcagcattttggtgaaagccattcaacaagtctcaatgaagttccaaactttcccacatttcctgtcttcttctgagcccttcaaactgttctaacgctacctgttacgcagttccaaagtcacttccatatttttgggtatctttatagcagcacccctctctctgcagtatcaatttactgtattagtccattctcacactgctatgaagaaatacctgagactgggtaaataaaggaaggaggttaaattgactcacggttccacatggctggggaggaatcttacaatcatggtggaaggcaaaggagtagtaggtaccttcttcacagggcagcaggacagagtgagtgcaagcaggggaaatgctagatgtttataaaaccatcggatgtcgtgagacactcactcattatcatgcgaacagcatgcggaaatcacgcccatgatccaattacctccacctggtaccctacacttcaccctgttgacatgtgaggattatggggattacaattctaggtaaggtttgggtggggacacagaaccaaaccatatcaagtgatcaaatggtgtcagccaaagcattctgtagtgtagtggtatcaggatctgtcttaattcacatgtgccagtagcacaaagcattttgtagtgtggtggcatcaggatgtctttttttttttttttttttttttttgagacagagtctcactcttgcccaggctggagtgcaatggaatgatcttggatcactgcaacctccatcccccaggttcaagcgattctcctgcccttccaagtagctgtgattacaggcacagaccaccacatctgtctatttttgcatttttagtagagatggggttttgccatgttggtcaggctggtcttgaactcctgacttaaggtgatctgcccacctcggcctcccaaagtgctgggattacaggcatgagccactgtgcctggcctaggatctgtcttaatttacatgtgtcagcagcagtggcagcgtcagcaagccagcacggtggggtgcacacttgttggctgtgtagcagggtgtgggcattcaccacagtgacagaggcagcatggcttggggagggtgaaggacccctgatgcttactgtgtgcatggtcccactggtggtcgtgttggtaggagggcagggcactggtatgtgcaggtctgtttggctctctatgagccacaggcaggggtggttgctcagcataggggagggtctgctgttctccgtgcctagtttcactcctgtggctgtgttggtgcaagggaagggtactggagggtgcagtgttgtctggctctgtgcccaccaaggttccaactgcaaggcccgtctggtgggaggagggggtacaaaatgcacttccccactgaagcagtggcaaggcaggactcatgcacaggcacacttgtggggctaggaagacaaaacctacgtgtgcacacatgtgcctgcaatgtgatgcaggtggggggtggagggttgctgtgtgtctgagagatgctgcagtgtggagagggagcaggtgggccggtgcatggycatggcggctgcctcgctggggctttctgccggttaggcacagtttgccagtgcaggagctgtgatgcgggccccacggcacccgaggttgcccagcagaccaaggagtgctcaggtcagaccagccctgtctggtgggcgagaccaccctctatagtttaggtcctgcagttctcctagggctaaagtctcctgtaggagcaagtcgagcctagggggatgggtgtctttggctgtgttctgttacagatacttctgtaccaatccctttggcctacacatcagctgttgtgctggcccctatcacttctctaagcagctctttctgccaacttgagtgtccatggtggttgaggggtctcctatgtcaggattcctgaggcccgtggtgaaagcgagttgctccttgccagttcaactcacccattcccccagagttgttggggtctgggagtgagtcccagtgcatagtaaccccatgcagggttctcggcttcctcccacttcagcccagcttctgtgtctttcctctgtccactctcagtgccttccccctgaagatctgttaggagtgtgccagtcatctcagtccctcagggaaggctgttccacctggctgtgtctagtaggaagtcttgcccagccaaatcttcatgcaaagtctttaaaaatttgtttatgtagttgaatttattttgcattataattaggacagtttttccctcatcacttatctttcttctggtacttctataatttctctttttttaatttctacatttggatctctgatctttttagaagtatattactgtacagataggctaaaatttggatcaaatgttagactttcattttgttgtatctgcatattgcccatatcatcacactgttttaactattatgatgtttttagaatgtgtgcctcaatagctttcttttttcctgaattatgaataattatgaattattgtttttgttgctcaggtatatctgattagtcttgattgttattcttgctcatgtagtctttagttaatggaataatggcccagcctctcagtcctctgtcaggatgattctagggcatcttccacttcccagacagttctgaacaagcttacatcccagttgcctacactattattgttctcattaacacctgaattattggctgcttttctccctttttggtcctacttcctcactgtgcctcctccagttgccttccatataaagtacaagtctttccctagaggtctgcttttgggaaatccaaactaagaaagagtcatttttggattttgacctagatgtaaaagatatcaaacattgttacccaagtatgttatatatttgtgtgtggtggtagagaaagagaggaggaagtaatgtgctgtcctaatttagctgttcagaatataaggttttagcttcttctcctgattatttccccatggcccatatcggttctttatgttctttagacttgaaacagttctggaatgctcttgggaagaatgaatgtcatctcccaagatttgggttgaagcttgctcttatctattttctccattaacttgattccatctgttttatagtttccaggattttctcaagcttttcatatactgctggcttcttctctttctttcttcagtgtatggatgtatatgtatgtatgtatgtatgtatactgttgaagcaaaatttgacgtatttactgaagaaaatttaaaaatactttactcattaatgaaggggtcagtaattagatcatttgaggcaaatacacaaaataaccaggaagaaaattagcttaaatacattaagtttctaagtaggcacatactgctatttcacttcatatggccataaaaatatcccatgcttattaatggtagggaggactaaatttgtggaatagatgaattagagctattttctacttgccagatgtcaaccagtaattggaaataagaagtaccatatctgagaagaaaataaaaagtgaatggatctctgactaccaattgaatatacttagcaacagttttggtctttttaatcatctgacaaaaggcaattagaacagaggcaacaatgagaggtcagcacaattaggacatttcactaactgcaagcaaagatgctgaccatactgttacataattctgtttggagacaaaatcgatctctcagtctccctgtctgtctctcttttatctctctcattccctttctttggtttagtgagtctgtccaccctgccattttctacacatcacatataaaattttgtattctactgttttaccaaaagtcatttagtaaatatttcctctgatatgacatatttttaatattcattagatttaaagacaaataagaatccatagagtgactatatcattgtttatgtattcacctgcaaagatgtcttttgcacttttaaattaatgagtgacttgtgaagtgatattttgaaagtataaatatgctattcctcaataattattcacctatgactttatcattctttcatgaaactggcctaaatcagctattactatggtggttacaaatgtttatgctttgtttctaactacaattattagttggcattcttctgtagagaagaactttcctttcccaatttttaattttgtattggtataggttcatgaatttaaaaaaattactgtgttataatatattccagtaattatttattttaattatcaagttctcatcggcttccattgcatttaaaaaactctttttactttaaaggcctggtgtggtggctcatgcctgtaatcccagcactttgggaggccgaggtggacggatcacagggtctggagatcaagaccatcctgactaacacagtaaaaccccatctcaactaaaaatacaaaaaatatcctggcatggtggggtgcacctgtaatcccagctactcaggaagctgtagtaggagaatcgcttggacccgggaggcagaggttgcagtgagacacgatcacgccactgcactccagcctgggtgacagagtgagactgtctcaaaaaaaaaggtaataaaaaatatatatatttaaggcgtgcaagatgatgttttgaatacatatacatagtgacttgagtactacagccaagctaatcaacgcatccatctcttgacgtattttatttatttatttatttttgagacagagtcttgctctgtcccccaagctggagtgcagtgcgcgatctcggctcactgcaacctctgcctcccaggtttaagtgattctcatgcctcagtcacctgagtagctgggattacaggcgcatgccaccactcccagctaatttttgtagagacagggttttgccatgttggcgcaggttggtcttgacctcctggcctcaagagatccacctgcctcggcttcccaaagtgctggcattacaggtgtgagccaccacgcccagccagttatctatttttttttcttttaagacagtgtgaattcttaagacctagtctcttagcatattctaagcatacaatacagtattattagctgtagtccatgtgatgcatttgaacttactcattctacgtaactgaaactttgcaccctttgacaagcatctccccatttcctctacctcctgcccttgataaccaccattttatgctctgtttctagtttgattttttagattccacatataagtaggattatgcagtgcttttctttctgtgtctgatttatttcacttaacatgatgttctccaggttcatccacatattctcatatggcagaatttccttctttttaaagattaaatagtattccattgtgtgtgtgtgtgtgtgtgtgcgtgtgagatttatttatttatttagttttttatatgttgactgacaggttgttttcatattttggctattgtgaataatgaggtaataaacaccgaagtgcaggtatatcttcttaattttttatttttaatttttgtgagtacatagtaggcgtacatatttatatatctttgagatactgatttcacttcctttggatatatatgcataagagagattgcttgattatatctgttctggccctttgttcctttaacatttgcagtattttaagtttttttttggttgtctatttgattaagtattgtgcatacttagcctgtggacttttgttccaactcagtagattttttccagtgaaacacaaaggtaatttttttttctggttaatatttagcaagaattctgcagagtgatcaaaaaaatcaaatactcagtatttcagaaatagattaaataggttacttttttactgataatgtgaaagaatgatataaaaacttgattttcctcaacaacattactttcttttgtaaatrtggtttctacaaagatgaaactactaaaacttacaggttttatttttttcttgttttttttgactgaatccctaaccctgcccacacaacctcgggatataggtaagaaatttacttgtatatcagctaaagcatgaccagttaggataatttctatttttaaaattttgttttctttcaagttaattctttacttgcttttttcaccctctcactaatttacataggctaaccagttatccaaaactaaccttttcagaatttttattttgatggtaatttttatattaccragtctatatgaagaaagagttgtcacatctgaagaataatcagcagtctatgacaggacagaaagtgttgctgggagatacatttggattttaatgttggtatttcttgcatatatgtatagtttatggtaacagtggaacaatagatgttaactgggatttttctggaacctttggttgtccaacatatttcccaactatatctttatggaatgcagaacctagttcctccttcaactgtacagtttgaacatccctcctgagcctggccaaggccatctcagtctgtaggaagggatgactttttttatttcttccatccaaaggggaaatattttgaacctcatatgtctagaggaggtgtctttttctaatcctttttggcctagaaggagctcctttctttgacttgaacaaatgtgccctaagcatggcagtggccctgaaggcatggatcgtgtcttacgtgtcttactcaatttgacatgcccctacaataccagctagtgaagactggtcatttctgagttttcctgctccttttccctcgtaacaacctgtttcaaaatcttgattttttgcctctttaatatcttttgtatctatattttccttttcatttccattactcctaccaaaatttagatcttgctgatttctcagtgtgacagttgcaaagtctcctatggccttcttactttgtcccatccacccttcttttgcccatttatttgacaatagttctttctacctttttctatttgtcwggcactgtggaaagtcccatgacattacatataccactacctgactcgtatttcttagtgtatagaaatgatcagattactatcctatataaacattttccagggctctccatgtcttccaaatgaagcccatactccttagctttatatacaagactcctataatctgggcccaggttctttctatcctaggtaccattattcctctttgtgacccactttctcatcaaaatagattgactttccctaaatacttctcaagatttcttaatgcatttattcacatcattctctctccacacagacagacagggtttttcatttttccgtcagctgaatctcttacatttactcatgctcaactcatatctcactcctcctataatccttttttttctttctttctcacccaggattcataaagcattcccaacttaatcccattctaaattagattattgtcacatgcacgagtaacttccattagagagcagcttaggaacctgatgtcaaggggagatattttagtcattgttgattgcttcacagggtccagcacaacactttgcaaaaaataaatgtagcttatgtgaacaaacataaatatgctccaattagtrtatgctcattgggagggaatccatgattttaggtggatctggagatgacctaaatagctgtgactgagtagcgctaaaaactatgctgaccaccagcatgctacagcatctctcatcaggctctgttatggcattgaatcagccattagttaatcttcatatcacttctctagtcataaatgatagacatttagcatggtaatgtatttgacatttctatctggggagccatcaatggcaaatttaaagtctagtcagattaagatttatttaggtcaattcaatttggtaaatatttcttgaacacataatcaacaatgactaagatttcctattttgttcacatgacttatttgtttcttgttaaatatgcaaaattatctcctgtcatcagtggtctattttgtattttatacacttaaatgccatgtatagttatttatttgaaaaatgttagaaaaccatgctatgtaataacctaaatattcttgcttttcagagaacttcaatagtactcaaaaatttatagaagataatattgaatacatgtgagttgtgctaaatactttttgatgatgatttttaaaatgatatattctagaaatgttaatgcttctcaaaagtaatttaactaaatagaagccatatccaagaagacaactttaattataaaattcaggcaaagaagttgtaaaatttatagccattrcaatagataatttcctgaggctagtcaggatgttcctgtgactttttcttgaccataaatggaaactctgcaactgatctttgtataccccatgtgaactgttgcagcaccatcattgcatttgctcagtatgttcaggaagcaacctttgaagaaatggaaaagctggtgaaagacatggtagaatacaaagacagatgtatggctgacaagacgctcccagagtgttcaaaattacctgtaagtaaattgcttgtgtttcttttccttttatcttatgtctttctttytttctttctttctttctttctttctttctttctttctttctttctttctttctttctttcattctttctttcttctttctttctttctttccttcttttttttttcttgaaacagagtctcgctctgtcacccaggctggagtgcagtggcaatcttggctcactgcaacctccacttcctgggttcaggcaattctcatgcctcagtctccctagtagctgggatcacaggcatgcaccaccatgcccagctaatttttttgtatttttagtagagatgaggttttgccatgttgaccagcctggtctcaaactcctgaccccaagtgatcctcccaacttggcctcccaaagtgttgggattgcaggcgtgagccactgtgccctgccaattgcttgtgtttcttaaacacacaagattttttgcccaacactgagaaaatttctggcttgaaaatatgaaatgaaagatgttctgtgcgcagcattttcattttgcttaattttggtatttagaacaaggtactttccttggaaaagatactaattctgtattttgatgcacagaaggagattgctgtgtatttgcagtatgtatacagtatgccctatatgttcaggcagaagaggaagccatagcttgaaactgcacrtgaaattacagaggtacctccttagctgcctctctcaatatgtattctattgttacatcccttttctgggcctcctccaagtagaatcactatctgcatctccaaaaaactactactaaacactacttctaaacactctaccaatacattaacataccagcatgtcatcaccttgggaggtgagtagaaaagcctggtggaagggaaatgtaggcagcaagggaagagtaagaggtggaagtgtcttgtgacaagacagaggaacaaagattctgaaagtgcaggatgattgtcaagggtttgggtaaaaatgctttgatttggcacacctgttctcccagctatttaggacactttggctggaggatcacttgagcccaggagttcgaatctagcctgcacaacatatcaagatcccattccaaagaagaagcagaaaacaaggagaaggagaaggaggagaaggagaaggagaaagagaaggagaaggagaagaggaagaggaagaggaagaggaagaagaagaagaaaaagaagaggaagaagaagaagaaggggaggaggaggaggaggaggaggtggaagagaaggagggggggaagggaaggagaaggggaaggggaaggggaaggagaggagtaggagaaagagaaggagctctgttggtaatggtgggaaaattagtcattgtgttttctcagtgagtacagaagctttactttaccatgactaaaaattgtccttttcttctctgttgtatagaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcagtaagtttaatcttagtaaaaaatgatccagttgaagaattagtcttaggctgaatctaatatctatctcaaataaatatggctgggttcattaatttattgattaattgtttcattcattcaaaacatactgtgtgtcagatactgtgctcagtgttcaggatataactatgatcaagatatggaccctgcttacaagaccattatattaacgaattttatcttctaattngtaagtcctagagcagaggtgtgtacatggtgttaaattggtaggatgcacagtagaggaaataatatactcttcccaaggggaagttgctgttttcacctcaggcagacattcaattacaggatgtttagcaaaacatctgtttttaatatagtgctgtcattgcagaaacagactttttctggaaggttggtatgctccttgaaatctaaatctaaatcacaaatttatctgaaaaaaagtaaacaggacccctgaatctcagatagagtgtgtatagatagctgttctttgaacatggaagagagaactgctgaccagctggtagcatgtggatggaaggacaatagccacagttcagtgtttgggattagaattgcaatcattattcctactttggagttagcaacttcaatgataaggacttcaaaggactcttatcgggaactggttaatgctgccttatattgaagttttctataactggaaacctttcttccttttaccttgttttacaacttgctcttcttgtctctttctattttttcttttccttcccatcttaccctcccytcccttcccttcccttcccttgtctacattcattgcttcctgtttcttccctcacccgtcttctctctttcatttttattttttatagctttttatatgaagttgccagaaggaacccatttgtcttcgcccctacacttctaactgttgctgttcattttgaggaggtggccaaatcatgttgtgaagaacaaaacaaagtcwwctgccttcaaacaagggtgggtatagcatttgttccatgaagaggataagaaatcactcaataccacagatccagaccctgacttatattatagcaaaaggcttgcttaccatatrtgatgttctcttgtcacattcagtgattttcaaaccattggtcaccaggtgctgatctaaatattctctttacttgagactcttgaatgacagccagtcattttcagggtctctcttccagctttgttttctttgtaaattggaaggaagccctggtgagtgaatgcccagggtgaatgatgacattttatcttttatctttgacaatttgtagtcttttgactacaaacaacatggtataatctcagtagggatggccaagctcacagcatgctgccccaccaagggagcacttatgcacctttttaccaagtgcaattcaatcatcagcaagactggtcctacctttgtgatgtgccgtaagtgcatatttcttttaatatgtgtgtttactgaaataaaaatcctgtagattttctgtctctgaacaaattttgtaatagtttgaatgaaatatgactaaaaaataagagaatagtgagattttgctattgtttcaaaagaattttctctttcttcttcaggcaatacctgtcacacaatatttaaaagcattttcttcttatcaaaaacatgtctgtggggcacttttgaaatttggaaccaaagttgtacactttatgtgagttttatactatatgtcttgtctctgcttgcatttccttgtctgtgtcccatttttgttaaatggttgataactttttatttatattcttcctagtacctaggggctttggggtgagtctgagcctacttagacagctcaggaccaggacattaggttgagatgagagaagttttgggaggtgaggagacccaaaagagaatggtggctgggtctgagacatatttaggttaattgagaatctgaactgctctggatgtttcaaaccagggttataaaacccacaagtgctttagaaataattcatccattggtctttgactttaacaatgaggagataaattttatctctagtgcttgcaaagataaattttatctctagtgctcaccctaatcaattagtaatgggtgctaaggcaatgtcttgagaaaaattttgagatttcaggtagatcagcaggaaagagttctatcatgaattatctatgcctgccatgagcttacagtaggaagtggtggccttacacagcatgtcttactataataattatggaagaaagcacacctctcagttttgttttttttcacatccaggactttggggctcttaaaatatcaccctaagattttcaaagtgatcatgtaggctgtgcaccaactatttgataaagacttctataaaaacaacaacaacagcaatggtggcaatactttttgtagctattcatatcatattagcaaattactcccacttgttctacttgctgttcaaattatttttgtggtttatcaattctctttccagatatattgcgatactcagtcaaaaattccccaagattgaatttaaggagcttatttctcttgtagaagatgtttcttccaactatgatggatgctgtgaaggggatgttgtgcagtgcatccgtgacacggtgaatattctctaaaaccaagttaaaatagtgatttttggcaattatcatttttttattctcaagttgccctgatatgtggttactttgccacaatgaaatcagaatgtgatttaacttttgaatgaaagcataaaatgaaatataaacattttyataaataaaccttgggattttttatacttggaatttttaaagattactgaatagattgtatattatatggctaaatgtcttgatgtaaaacttcagaaatttcaaatttttcatagttcatttagtacagattgaagttttctcttacattataaatcctcttttagagaggttggaaacaaatagtaaatttcaaggaatgacttgttaacattatgtttttaagagctgatttccctgagcttccttacgctattcaggtatagtccttccaaataagtggatacattaatttaacttttcttttccctttctcttttggttcctttttccttaccttctcccttcccttttcctgttccctcccttttccctttcatttctttccacgttccctttcctttctggcctttaactgacaattaaaaattgtatattctcatggtatacaacatgatatatatgtatgtgtatatataacatgttatatatgcatatatattaatgtatacatgcacacacattgtggaatgtctaaatcaaactatttaagatatgcattacctcacatacttatttttttgtggtgagaatactccaaatcttagcaattttaaagtactcaatatagtggtatgaattcatcattgaatcactatgatgtacaagagatgtcttgaatgtattccttctgtcctaatgaaattttgtgtcctttaaccaacatctccccaattcccagcctctagaaatctttaaagtgattttccaaggaaaagtattggtacgaatattgttggcatagtttgaattgttcatgcattctgttctcactcataagtgggagttgaacaatgagaacacatggacacagggaggggaacaacacaggccagggcctgttgggttgagattgggtgctgaaaggagagcatcaaagtagctcatgcatgcggggcttaaaacctaggtgataagttgacaggtgcagcaaatctccatggcacacgtatacctatgtaacaagcctgtacattctgcacatctgcccatgtatcccggaacttaaagtgaaaaaaaattgctcatgcattcaaaggtaatataattttattaaaaaaataactgagtatgataggttgcacctgtaattgcagctactcaggactcaggaagctaaggagggaggcttgcttgagtccaggagttcgaggatacagtacagtgagctahcaacaccctcagcaacagaatgaaaccttatttcaaaaaaaaaaaaaaaagaaagaaagaaagattcaacttttaggcttacagtgaagatagcatgtcaattaaataacttgaattttagggtattgagaaatgtttatttcaaacaatggacaacagatgttcccaataattatttttgctcctaactgtacccaagttaaatcaatctcctttgcgatttatttttgtattgcttgattgttcttggtgatgtaggattttgtttgtttgtttgttttttgagacggagtctggctctgtcrcccaggctggagtgcagtgacaatgatctcggctcactgcaagctccgcctcctgggttcacgccattctcctgcctcagcctcctgagtagctgggactacaggtgtctgccaccacaccccgctaatgttttttgtatttttagtagagacggggtttcactgtattagccaggatgtatgttttataatgtgaaatctaaggtactgaattaggatataattatagattttctgtgaaatttgaggcttaggttaagggattatgtctcaaatttccttctttttaatgtctttttggagaaataagaggaattgaattacagttaactgaaaatagaagtaacttcccagaggataagagatgctctgcctagaacaatgctggcattacatgagatgtaaatgtctttttgaagattggcttcctggttctatgtggtttgttggaaacatggtgccgatccccattttattttttacctcagtcctgagcttcatcttattccttatcctccatgttcaccagaagattcgtcagtggaaatagcttgagtaaagtcataaaggcttgaaatagtctagtgtgttgctgtaactcaacataattcaagtgaggctgaaacggagaggggaaataatgtgcagtctcattctagagtctggaagggcccagaacagtttttaaaaattattcaactaatgtgtaaataagataaccccaccctctctctaattcccaactcttatgtagaggttagaactggggcaattggtagggatggggacagaataaagttgtccatttgagcagtatttgctaacctgaacagcttcaaatgaatgatatccattagaaaatgatatccattagaaaatgataccatgagtggaatagcttcttatatttgatgaatcgtcatctggtagttgctgtagttcactcacttgtcattctttcattcatttatcaaatatttattttgattttgccatgtgctcagccacaagagaagaccaggattatagatattatagtaacatgtctttggtggcctccactgaaaacacaagtggactcttatggaaaagaaacaacatttagaatataagatgtaaatatatcantgtaggagggttatttaaaagactaatgcttaataatggatgtgaatctatagtacagcctattttttcataattatatcatcttaaatcctgagaagttttaatgtaaaacttcatgtgcattaagtaaatccaaaatttaattcaaacaaatattatctagcaaattaattgatgaagtgattccagatgctgcgatcatgactggttttgcatgccatcattccataatggaagaaaacccagcctgaaagtaaaataatctctcattcttatttggtacagagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtgaaaatgtgtgtcaagaacgagatgctgacccagacaccttctttgcgaagtaatataactctttattgaatttataagggaaacagaaagaaacttrtaagatttgacttttgttgctaatttaggtggaaggacatggtaccgtttatttcactaggtatcatataatttttttttaaatcatggctatagagtgtagttttcacacaattttaagaaaaaatcaactgtattattaaaataatcgctagcatttattgagcacttaatatatgccagtcatgggactatatactttatacagataaactattttaattcttacagcaatcatacaaaataagtacaatttctcccagtttttcagatgagcaagctgagatacaatgaagtgaattgttcagattcacagctaaaaagtgacagagtaagaatttgactccaggaagcctggcctagcaagttgcaggcttaactgctatgctatgccatctacaactgttaaggggaagactagtgaacytggagccacagggactatatttgagttctggttgagttgctgggacaagttaacctttctgtgctttttttttttgtcatatataaaattcatataagaatactcattcatctataatcccagctaatcaggaggctgaggcagagaattgcttgaacctgggaggcagaggttgccgtgagccgagatcacgcactgcactccagcctgggcgacagagtgagactgtctcaaaaaaaaaaaaaaaaaagaatatttattaatttaaagtttattagtaatgtaatataatccagggactttactgtttttttttttgttgttgtttgttttttttatctcctggaagccttcatctatagagagtataaagtgagaagagacaaacataaataaataagtgcaaaaaatgttcttttatttctaatagcatcctgttctaggtaatgcaggggaacagaagaagaaatggtcagttgtatatagggaccctggaaaggcttaatagggaagtggtacttgaagaaattttggtaatctagataggtagagcatgaattgaagtttataatggtttgttgtgtatgtggctgtgagtagggcatctgcagcgagagaccagcatggtgagaggtaggtggggccagatcatgcaggcatgctaagtaatgggatgccactgaatggttttaatggaagaatgaggaaggacaaattcactttcagtttttagaaacctcatctgaagaaaatcccagtttggggcttggataactgggtgggtagttttcccattcaatgtgaaaaagtagcaggttttgtgagaaagataatatgtttaagtatgagcacattgactttgaggtaccagtagaataactaattggaactatcagaagagaattttatatgtgaacctgtagctctggaagggaatctggcttgaaatctaggacataacaacaactaatgtttactgaatacttactaaattttaagtgcctctcatctactaaccaaccaaattttaaaaacaaccctctgaagttagtatacttttataatctttatttttcagataataaaacaggcacagagaggttaagtaatttacccgaagtcacacatgtggtgtggccaggattcaaatgcaagcagtgtggctccaaactcctagtcttataactactgtcctctacggcttctcatggttgtggatattaaatcaagttcaattaaacaaaatgatagattgtacctgacatatgtgtttgatagataaaagccatttttataatcgtcactattacaacataaaaagtgtttgaaacatggggagaaatgatagagtaacagtgagcacaccaagtcagagtgctcagtgttttaaggtagagtctttctggatgtgaacattttaggcaagtcctcagtggcttctccagcctagagtaagcttccagggatttttcttcacagtattttgagacatgtttttaggtgtgtgtgtgtgtgtgtgtgtgttactcccccactcccagagaagaagtccatggcttacatcagatattaagaggagccctgattctctgaacgttaagcactactgccatgggatatgggaatatatctcacaaatggaattgaaaaagcaaatgggaagctggagagatggtttcagaaaaaccaagattaatcaagaaggtcaaatcctgaaaaaataggggtggggaggggatgaaaagagttacctggtcatgaaaaacttgtgaggtattgcgctcacaaaacgtggaagatctgaacttattgtgaatgaatagatgagttttcttttttttatgaagactgtaaatagcccagctgaggtacttcaagatgacatctctgtcttgagaaaagagttcgcttggtaaagaatggagtaaacatcccaggggacttagggtcaaattttatatcttccattgataggaaggtgcttaaccagtctgtgatttagtttcctcagttgtaaaacagtacatattttggggactaagtgaagtgaaatgagaaagtgtttataaagtccaggaagcacatctatatctgttatgcccaaagtttgatccagtgcctagcacctactaagggcttaataactgttagccttcttcctctctctttctttccaaatcacacccacctatgctcttgaagtccttgacagaggatttggaagccactgccagtgatttggagctgaaggcgtaaacactcccatagttggcaagtgacaggatgtagtaatgggcaaagcttgctccctatctctcacgaagaccacattgtgggcgggaaggaagccatattcccagmatgtcaagttggaaatctgaatgcatcttcaaacataattataagcaatatgtattttttaaagtatattcacaatttattatttccaatgttttatagattaaatcattccaataattagttccaaataattctactaattctctcttctcaaataaaaaatattgttaatctaaaacgtaccatggaagagaacttttgtaaaatgatctatagccaaaatgtcctcttaaattactctgtgaccaagacagaggagaaaattagcttttgaaagcagagtcagtattagatctgactggattacaaaatagtggaattgggttttttgctctttctctaatttctmatatacaaaattttacacattgcaggtttacttttgaatactcaaggagacatccagacctgtctataccagagcttttaagaattgttcaaatatacaaagatctcctgagaaattgctgcaacacagaaaaccctccaggttgttaccrttacgcggtaggttccattgytgtaggttcagaaaatcaaaaaagaacaactagaaaacacttaaaaattgatatcagagttttgctgcagtctgggggtagaaaatgtgaytggctaatctgagtcyactgtagattcagcctaagaagattattgggaaggccaatgtcatcagtttggctgatgcataatgttttggactactaatccaatgtgttaattcaaaaaagtcttcccattaaacattttaaatttacatttttctttatgtattctgtattttattaagccgtattggatattacatgatttcaaaagcaatgattgctgtagatgactaggaaaatattctgtattttattaagccatattggattctttatggtttcaaaagtaatgattgattgttgttgattattaggaaagcaacaaaggttacaaagaacccttttctgattctcccactgggaaatagctataattaacatttgtgttcaactcttcagtacatatacgtatatatacgtgtattttaaaaataagattggcataattcctagaaaatgtttggacctgtttttttatttggtatcatagaaaacttttttgttgttgttgttataaattgtgcttccttggtttcctgctgttgccacaaagggagcggcttaaaccaacaaaaatttattctctcacaagaggccagaagcctgaaatgagtctcatggggctaacatcaggtgtcagaagggctgtgttccctctagggaagctagtccttgactcttcttgtgtctagtatagaaaactttttacgtcattaaacagacttgaaaataaacttctttttaaatgatggtatcccatcataattatttaatttatttaactgatttcctactgtgtgtttgacattttggatgtttgcttagggtgtttttcactttktaagtgaccctgagatgaacgtctccttccatttatctttattaatatttatggcttttttcttaggatggattatcagaaggaaaattattggatcaaaatatatgaactttaaaaaacatttaacacaaattgttgaattactgtcaagaaagttgtttctggtgtctggccccacaacagtgcttggaaatgctcatttcaatgtcacttttaccaacattgcacatggaaattaactttgctagatttatatgtaaataacagtgtttgtgtttttaaaacacctttatttratttttaaattgttaaattttttccatatgattttagctatttacacattttctgtgaaaaatctgttcatgtgtactacccattttcctgttgaaattagtgtttttcatataaawtcatatgtatttctgaatacatattagagaaattaataatttgacattttttgatttatttctccttcctttgatatgtgctacttttgctttagcaaaacattttttttcacttgccacaaacaccagtttatacccactcaaatttgagcaatggaataagacttggatccctgctctgtaactgtccctaatgaggtagtctgtttctgatccttaaattaatcatagcgctagaaaattctctcttttcatggagatacaatttgctccacaatagctatccactggtgtttagttctctgtctggtggccactcagaagatgtccaattttatgccacatgagagatagtccatcaaatatttgaagaaaactgttggaggttttaagttccaaatctaaacaatgaaaaaatcaaaaagagcaacatgatttaaaatgttctgtaacaacacttactagctggggtattctgggtaagtcacttaatttcacaaggccagttgcctttacttaaaaatggagataacaactgctcttgccacttcaaagtgacaactgaatgttattattttcaacatacaatttaaattctrttttgtaatttggaaggctctgaaatatgtacaaggtgataataaaaaaatttggacttttaaatttagcaagaaatatatttttatatacataattaaaaaattaagttcttgcaygtgcttgtaaaaagtgccctgaatttagtgtaataatgagaatttgaaaataccatagaaayaagaaatgctattctacacattgatgtaaagcttatggttaaattttagataaaatgtttgtaaccatgattattcttattttcaggaagacaaattcaatgagwcaactgagaaaagcctcaagatggtacaacaagaatgtaaacatttccagaatttggggaaggatggtttgaaataccagtatgttgtttgcacaagtgggctaacacttgccactagaattgaatacataatccctcgaagcgtaaaaaagttagctgtcaagtttttcagttatggccgattcataaactcttggaagaatttttttttaaagtcaagaatgcctattgaactgtcacattaatcttttatcagaaatgaagctaaaaataaaagaaatacaggattctggagacattgattctctaatgctttggtttctgtttgacattggctttctcactgccaatctagaatccctgcatcctcacccatttcaaagtgggacactgcatatttcaggtcattacagtttctttggggaagagatagtttgccttgccttgccttacggctatcttacctgagtttatagaaataactcaggatgtgtttaacactttaatatttagctttttagtgctcttgtgagcatttgtgaataatatgcagtttgggtttttttcaattattatgtcaatgtattttattatcattattattattgttattattatcattactacatatttttgagacagggtctctctgtcacccaggctggagtgcagtggtgtgatctcagctcactgcaatctctgcctcacaggctccagtgatcctcccacgtcagcctctcaagtagctagggctacagacgtgagccaccatccctggctgatgtttgtattttttggtagagatggcgttttgccatgttgcacaggctggtcttgaacttctgagctcaagcaatccaacccttcggactttgctgggattacaggtgtgagccactgcacctggcctcatgctaatgtattatttattgaaactaaacatctttaaatcaaaataaaacacagtttaaaaatatctgactttcctatttctgcaatttggctgttagctgacaattcaaacttagttcattaaaaatcttagttttcttcatctcagattatccttttacaacatatattgattaaattctttctttaaaatattttctaatgatgtaaattattttaagcaagattttagatactagccaatgtatttgctgtcaaggagctcctatacttaaagataacacggggaggcaaatctaagagcttctgagacaaccgtgaaattagaaaggaagctaaaatagatataggaagcagggtgcaggaaaacaggaagtaaagacatatttctctactttatgagagagctaaggttcatgttgcacctatattggttgtcgctagccttgaagggtctgggcttcagcagtaattcaagggaaaatgggtatctgctttcattcagaaccaaacagacaaatgttctttcagttacctcatcaggctcacgaagatagctccccaactctccactgaagaactggtgtctcttggcgagaaaatggtgacagctttcactacttgctgtacgctaagtgaagagtttgcctgtgttgataatttggtgagcatggcctgtgtaccagactactcttttttttttttttwaaaaaaaagaatatttgcactcattgatttaccgtgattatccatattcctttcttcactgktttaatattgttaagcaaaaattgtcaagttttccttttggctcactttgtgaaaaccctaagaagtaaaacagaatgtcttcaatatttttggagagtacttcaaattatctttcttatttcttcattgtattagaagggatttgttaggacaaatgatttaggaatcataatattgtttcaaaatgatacaggaaactttataattttaagtaaggttacagattcttcctcttggccccattgcttcatccagcaatcaggcattgaatacatctctttagggctggggtggagagtaccttgaggcagatgccaggaggggaagaaacccctgtaccacagtgtttgatcgcccctttcagttggctttttgcagctgtctgtttgcaattgaaagtttgtttatatgccaccaagaaattaatttgtaggcatctaaattcttatggcttggattttggtcataatgccatttaggaccccagcttctagttttacttgtatatagggatatgtcatgagtgcatgtgttttatgagtgaggttaacagtgatcttagaaagatctaagtattcatctaaccatatttttagaaattccattcaagttttaagatcgtatctcagttgcaactcttgttggtacaggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtacaaataatctcttccattcttctttttctttggtttgaagacacaccatgtattagtgagaaggtttatctagtggatatgtctttttgatatcacaatcctgttccttccaccaaattgtccagtctcttctatatggaaaaatacaagtgcatatttttttttttgccattgtttatatctagcttgtcttttcatttgaaagagacttggaatgtccaagtctaacattacctttagaaagtttacagcagccagcaaaaaggctcataggcaggctgataatgaatttcatttccttgagggaatgcccggagaatatcatttagtgtttacaaaggagaggcctaaagggccaggaagtttactttcattttctcaataaatgctttaaaatgccaggaaattagacctagttttttggatttagacagagtctgcctaatgtgtagtggagacaacattcagytaccaaatatgaggaaatggaggttgttttggacatgaattttctggaaagatcagacgtagtcatgtataccataatacttggcataataaaggcctaatatatgttttcatttttaaatagaataatactcttattatgtgcaatattcatagattcacagtgcaatacactcttgtattttccagtccatcctattctagtctggtctattttattctttttaactatcctgttttcattttaaaaatgaaagcgagaaaatgcaaatttttgttaattcttagatcgaaggatgggcatacgggacttattacattttcctctttggtgcattaaaattttattacttaaaataattactctaaaaatgtactctaaaatgtacttttaagacatcaatgggttgccccctgaagtttggaattctataagttactagaatactggaattctagaatttactagaaaataaggaaatcattattgtctatggctgttgtcacacttaattgtgatagcttatttttttaattgctcctttgacatcatttttaattgacatataatagttgtacatattttgggggtacatgtgatattttgataactgcataaatgtgtaatgatcaagtcagggtaattggaatgtccatcatctaaaacatttatcttttctttgtaytgggaacattacaattctcctcttctagctattttgaaatatacaataaattactgttaactttaattttcctactatactactgaatactagaacttattactgctatctaattgtatttttgtactccttggccaacttctcgtcatccctctcttcctccttgttaatactttttgtataattttgtgtgtgacaaaacccttcaaagaatgttactgtggaaaccattctctaaatttaataggaaagtttcagaagacccattcaaagtggtatatttcaactctttacccacacccaagctgagactcaagacgtgattctgtaacaagcattttggagtagagacgcttcagaaagaaagcgttaattaatkttatttgacatcttttggccacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagaggtagttttatttcttttctactgaaattcaactggttttcctggtcaaataaaataaaacagaaccctgnaggacactgcttcctctctgcagtgtctaccaggactacatttgagagcacaattgctacacaactaatatgtagacatctctgaaatacactttgagcagtgtctccttagtacagaaaaagctgtcggaagacctgggttgtaaccccagcagtcttgtaagtcatgcaacttaaactgaatggcaattaactatctttaaatgaggatggtaataattatccctgaattacacctttggttcttattttttggttttgaaccactcattatcttaataagacagagtcaaagcgacttgcaaaggaaatcataaacagctccaaatggagcagagcaggaagggtattagaaagtgaagtctttcaggagtggctgtctcactttcccaggccttgtgctaacatcctgcagttgagaataatgagggagtggagggtaagggtagtcagggagaaaagggagaaatgtcccttgcttgccctcgctccagtgaaggtagtctgtagccatttgctctggtttgaacctcagcaacctgtgaatgttagccccaatggatggctccatggaaatgcctgttcactgttttccaactttatttctcactgtttcttttctaggaacactcactccactccaaactcacaattcatgtaaactcacaggcagacaaactcacacacgtgattcattctggttgtgagccatctacttttctgagtgacacttagtttgtggaaatttttctggggtacatattactagtttttaaaaaatatacctaattttaagtaaaggatattaatcaatatctagcatttatctgagtgagtgtgtacattagggccatgtgaaggaaaggatgaatttttggcagttgtaaagagcctttcggtgtctattttttcactagaagaaagaatgtttactgtttccctgtacaacgtgggaatgatttaattttcttcaaaattcaggaaaacatgcttatctaaatttaaactagtgtcttaaatttttcttcctatgtgtttttatttccatccctcacctcagagtccaaaaattggcaactgaagccagctgctggagatatgtaaagaaaaaagcaccaaaggtaataccctctgcctcattcaaatgtcaaatgtatttgtggcttatctgatctccttgccttttctccctcatgcttctttgtctatttctggttcatcctacatgaacaagaaatgcacatgtagctaacagaccccgatattgttcctgtgtttttctgggtatcagccactccttatggggtggcaatgctgcatttgtgcttgcccttctcttgctgttcaatcagttttctagataaccaagaggcgcttaagtcctctgccttcctactcatgtattcagctgtctggaccacaaaggagggatgatggaacctctgaatgttgacagaaagaagaggggtaactccctggggactgaggtgggcagacagacctcagtgaccctttccaataatcttttaagaatattgctttactgagatatgattcacatacaaaccaagggtattgctacagcatttacrtgaacaaaaagcgatatgtttgtgatttcaaaaagatatataaagatgccctcccctttgtggcttatgtaagacctgaaacacaaactttagcaacaaaatgttgcrtagatataggagttatatacagtgtcagtgaagagagacctggacctcaacagaaggtaggttgggatttacaagggacaaaacacggttaccactaatagttttttcaaatactcgactttctatcacccaastttcaacatttcatgtttttttgatgcatgaaatactatcttctctttccagggaaggcttcctatctgtgtggtgatgaatcgcatttcctgagaacaaaataaaaggatttttctgtaactgtcacctgaaataatacattgcagcaagcaataaacacaacattttgtaaagttatttttcagaccgatgtcataaatcaacctaatcacaaaatcaagcaatcatgattcattcattccatcagcatcttttgctcacatggctgcaccattccctatccatgaaagatggaagtctgaatagcagctgggtaggcacagtgctctaagatgtccttgaaactaccagaaagaaaactgagaattttgggcatgaaactttactgctacaactactgctactactagtagatgacattgaatgttttcaatgtaccaaacattgttctagctagttttcatgcattatttcatttaatctaataactctatgggtaggtattattttcatttacattttacaaacaggaaatctaaggcttggggagataaactaatgtgttcagtgtgatatcactagtaattggcagaaccagggtttgaatttaggttctctaattctggaactatatataaatgtatataacatatatattatatattatgtaataataatgttatatattatatataatactgtataatatattacattactgtaacatattataaaatatataatatataatataatatatacttccagaattttatatatattatatattttataatttcaacttttattttagatatagggggttcatgtacaggtttgttacatgtgtatattgcatggtgctgtggtttggtgtatggatctcatcacccaagtagcgagcatagtacccagtagttagtttttcaacccacacccctctccctcccacccctctgtagtagtccccagtatctatcgttcctgtctttatgtccatgtactcaatgtttagctcccacggtatttggtttgaagtttgaagttgggtaatgtgatgcctccagctttgtggaacaatattgttaaccattgcatacactacctcttaggtatggccatgttgcatgccttacaaaatctgttattcagagaggtggaatgattgtacaaggcaacaatgacagtggtggttctcgccctccattccaagccagaattgctgttgtgttagtgatataaatgcttgatattgatatcaaaggagaagtaactcaggaaatgaagactggttatggactcatggcctggctttcctggtggttctctaaactttgaagatttttgtatgccaatgtttacatttgaagatgttggccatttaatagataatacatgaggctattcatagagttattttggtagagtgtttagagcatagtctttgggattctcattgatttattcaacaagtatttattagaattctattgtgtgtcagacattgtggatacaaatatgagacagaattggttcctgtttcttgctaagcaggggagagggacagtaaacatgcaatcacgtttcaatgtcatacgtgcagggtccaggcactcactctaagctgaaggtgcagagtgagaaagggatggcagcgggtgctttatatccctactgccattaatttactgtacagccccagataagttccttatactctatgacatcaatttctttgtgtaggatgggctaatatcaagtcacaaaggctttagagaaaagaattaaattactatataaagtacttaatacattggccagcagataacaggtgtgtaagtcataaagttattttgtcctctaaccactttctccaagcactctcatttaccaatgaggataagaaggaagtattgctttacttaaacaatagatagtagatttagaaaacggaagtgaaacaaagcataattagtgaacttaattttatactggattctgctatgtattcaatactgtgctaagagaagcagatacaaaatcagggacccaggcacttgccgccatcataaagtttctatcatggcaatggaaactgccatacaactctttctctactgccatgccagaacacacattgatcaaagcaggaaaggagggagaagaatggcttctgcaaaagacacagttgcctgaaaaggaggagatttggagtgggcacgaattagtcttactctgtattacttggacagaactcataccaatgaatagaacatatctggtttgatgcagaaaaaaattttctaacactagagatgcttatacatgtgataagcctcctgctgcaatactcaatgccaagactgcatgtgtgtgagcagctaccacctgggtttttggtggcatccagtcatggtctttctaaggcctctttgaactctatttctatgacctgggcaagaattaagttttctatgaaaatagtatttattaaacatcatcactgcatcttgtacttgcataccttccatattttatcttaaaggctagcctgaagagcttattttcttctagagccaattctgtgctggtgtctattgattgatatcacaaaacctatctcattgcctttacttaaataatccttgctacttttctttcctgtggtctggaattctaccactagttactgataaggatttaacattttaaatgttgtcaagaatctcttattaattgcaaatgtctctgaagaagggttcccaaggaatgttaattttggtcagttacttttttaaggaggaattagcttagcacacataacagttgttaaaaaatttttagtgttaactccaatcaactgatagtggctgtcctgcagctttgtgctgtgagtgtttctaagactgagcataagctcagagagaaagagtgcagtgatcagatagcagtgtctgcggtgggtaacagtcttggagcattcttccaaaggatttgacaaaagattggacttagtttaataggtacatttttgatagttctaagaagtttagagtaagatttcaagggaacagcactaaggatacatgacaaaagagacaatgaatgttaagactgtttagaggacctcaaaatggatgatggagacctgccaaagatagtcttccccttgctgaccttggtgggctctctagcatccttcatattctttacgacaagcctatgtgtcccaaaactaaataatgacagatgttttgggsttgtttttcaggcaaatatgtctctctcacttgtgatatatttttgcttagaaaaatggtattgagaatatgtgagtagcagaattaagtaagatactgtcagccttagagcttatttgatccaaaccttccatttaaaaatgaggaaattgagaagagaataaagtaataacccatgatctcccattttcaaaattttagactttacatgtatagacatcttacaattgttatttagtaactaattacctgtttgctgccttagacccaagaattggttgataggcaaagcagacaatagctgagggatattggtgtctcagccttaacactagctcttggatgtgtgggctgtaaagtcagacagacatgaatttttacctgtgagtctatgaacaaattacttgactctgagtcttaatttctcattcaagacatactaatattgctaactatctgagagtcatataaagtgaccatagtaagtgtttgataaattaggtcccattcttttaggttcactcccaatgcttgtacagctcctaactccccttctccccagggacttgaaaatgtacccagcattagaacctgagccctgaccatttagtcaatctgtggtagtatatgtttatcttcttcccttccactttagaactttggacatgtcaacaatcatttctaagaaatgaggtattgcagaccaacatttgccaagagtgtttatggattacttaattataaagtttgcatgttgaaatcttaaagaaacaagcagattgacatgacttgtttaaaaatgcagtattcattaatgaattcaatccatcagcaatatttcttcattgtcatagatttcctcagttttatcagggccatagttgcttggaaaaaatattcaccagaaaaaggtttctttttaatagtaattacttggaaagaatataaagttcttcatttctctcaaatgatagaacactttccataaaggttctcacgaagtaatgaagactgctaaacccacatcttttcttgttttcttcagctncattaaatgtcaatctcgttagagaagtttactagatgcgggtggaaaatcctatttacaatttacatattccaggtataaggataagataagtaagccacaatgactactacagtgtacatgagaaggcttatctttttcagaggtcattactgtaaatagaatcattgaaaattgcaagacattaatttgtggaatgaatatacagagagagctgatatattgaagcaacacacacaggaatattccactttagcctcacttccactctaggtaagagaatgttctattttaaacttacgtttagaattggataagcagttttagacaaagcaatactttgaataatagcagaaataatattatgagctaaattattcagtacctgttatgtgccaggccctgtgctcagtacttcacacatatgctttcttattttgttttcttatttttaaattttatttttagaaacagggtcttgctctgttatccaggctagaatgcagtggtatgatcattcataccaccttgacgtcctgggctcaagtgatcctcctgccttaacctcctgagtaggtaggactacagcggcctaaccctgtacctgagtagtttttcatttttttgtagagatgaggtctaactatattgcccaggctggtctgaaactcctggcctcaagtcttggcatcctggcctcctgcattggcaccctaaagtgccgggattacaggcatgagtcatcatgcccagcccatatatgctttcatgtaatcttaactaccacccaatatagtagaacttatttaaattttattgccagagaaacagaaactcagagaacttaagttattttcccaagaccatagtaagtaccagagctagaagttgaactcagaatagctgtttctgaaaccttttcttattttaatatagtaaatgataatggtttgtttatttaacaactgctaagctctttgggagctattattataggaaaaatgacactgttatcaatagagaacatatgcatgtgattttggtgagtggagatgatgaagaagatggaggtgatccaagatgtgtgaaacaccgactttgccgaattaagcctggcaaggtattaatgtttatacttttatatccaatgctaaaccttaattttcggtgtgctagtaacttctaatataaagagttaaataactgaaatattaagtttaattcagaagtgttaacagaagtacatgcagcttatttgtagaacaatgatagatttcacctacacaacatatttgaatataagtcattcacagaatacagtttaaatacaagtgaagacatattccgagaatttgcttaacttacagtaaataaaaatacatctagaaatttatgagagaacaaatataggttgtagaattgtaaagagggatttcaatttggaaaattttcttttatgcaaatatctcactccatctgaattctataacaaaataccataaactggatagcttttaaacaacaaaaatttatttttcacagctctggaggctgggacctccaagatcaaggcactggcagatttggtatctggtaagcatccttatattcggaatctgggatggctctacattctggtccatagaaggtgcctactgaggtgtcttaacatggtgaaaaaagtaaaccagctcccttgggcttcttttataagggcaatagttgcagtcatgaagactccaacctcatcacctaatcacctccccaaaggcaccacctactaacactatcaccttggggttagattttcaatgtatgaattttaggggacacaagcattcaggcagcacagcagcaaataaaatctca

SEQ ID NO: 10556 - DNA, 34016 bp, Homo sapiens
  misc_feature (1)...(34016): n = A,T,C or G, or insertion/deletion polymorphism (see Tables 1-2)
gccagaaaatgggagaccccagctccaaactgcaagcgttgagccaaaggcaagtctggagcaccagcctgaccatggccctcgggccagacccacggtctagctgtgcccagtaggggaccctgcaatctgaccactcccccagcaggcctggagggtgggcaccacgtgcgatgaggattcttcccattcttgggccaggaggcctagacgtgtggcttcaggacctagcacccaccctccccagcacccccctccccaggatccccctccccagctgacccaggctgtattttcctcaccatcaccttctaaagagcttcattcaagggctgagttgaggctgcttctgattaaaaccaaaggtgattctaaaacacaacgaagtccttgtactgactggatttagagtcgtggtagaaatccatctccctgtgccaacagaacggacctagaaacagggaggccccaggtcagaccagcatgctctgagtgccaagagaaaggcagctggaggggaaagccttttgaagagctgtgtggcctctctgagcctgtgtcctgatctgtgagatgggactgatgaggctcatggagatgattagcaagacggcagccaacatccttaggctggtgcttgtcatcagtttggctaatatggaccccgtctgactggtcttttaccatctccctgttcttctgtttttctccctaaaaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgyaggagacccccaagccaaagcaggcggagacacacacctcggaanagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattagaggctctcagatctgcccttgcttgcctcatacctctgtgctccacactgcggccaggccagctgagtccctccatccgtggatgctttcctgcagctatgtggtatgggggtcattcctgcctcttggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagamccccagtggatgtctaaaaccacagataataacaaaccttatacatactgttttttcctatgcatacatacctgtgattaagtttatgaattaggcaccttaagagattgacaacaataactaataataaaatgtaacggttatactgtaatgaaagttgtaaatgtggtctgtctcacaatatcttcttgtactgtactcatctcttttccaggtggctgttgactctgggtaactaaagctgcagaaggtgaaactcaggtactattgtatatctctgtggctgctgtttttgttttaattaagtagctttgtttttttgtttttttgttttttttgagaccaagtcttgctctgttgcccagcatggagtgcagtggcgtgatctcagctcactgcaacctctgcctcctgggttcaagcaattcttctgcctcagcctcccaagcagctgggactacaggcgtgcaccaccacgcccagctaatttttmtatttttactagagatggggtttcaccatattggccaggctggtctcaaactcctgacctcgtgatccacccgcctcggcctcccaacatgctgggattacaggcgtgagccaccatgcccggtctgcttgtttgtttgttttagagacagactggagtgctgtggcatgaccatagctcatggcagcctcaaactcttggcctgaagtaatcctcctgccccagcctccctagtagctgggactacaggcatgaaccagcatgcctggcttcaatttcctttctagtatttacacaaagtaccataaaataatttcaaatgatttataccaaaaagaccattgttggccttaatataattaagatataataaccccacatatttggcaattttaagtcttacactgattatattcaattagatttgaataacttggaatttggataaatggctttttatttcccattttttgtctttacagaggtaagataaatgtttttaatatatggaagtataagcttgtgaatacaccaaagaaattaaccaaagaataggaaagaggaatctggcctattcacgtgatacaatgtacgaaaatgtacaatagtactttaatccataaatcattcaacctgggaagataactcaaaatgtttaacaaccagaacagtaacattaaataatatatagataatacaaataaaaaatttaaattttataagtaaacatgaatattttaaaactgcttaccaagtaatataagttgcatcaaaccactcatcaaatcattcttataatttccaagaaaaaaaactatatacatgaatttttaaaggattaccggttcattgccaaaaggagaaaaatatacagaaaagtagaacaatttttcctagtgctacagattactcagtattttggtgtttattctgtattttttttcagagtttaactgatgtcatatatgaaatttttattctactcctttcattaagcataaaacattttttgcagatgctttctgttctcagccacagtagctcaaacgtagaaatgaaggaaaaccacccaaatgagaaacagtattcagagcttgctacagcaagggagtcagcaacatccccsgtgtgggtaggcgcaaggacgcagggggtggaaaacggggaaggctccaggtggttctgaccgcaggctgttggaaactggaggtgagctaacaagaagcaggatgttttctgtgactggtttggggagcgctttcttgggttggttctgacatggggagggtggtacaaaaaatagaggagcaagcagtcctgaccacgtccttcccaagcagccgactgcccggttactgcagaggctgcagtcagtttattgtcattcgttatctgaccattgtctattggcatattgtctctcaatttttttttctaactacttactgtacaaaagttggaaaaatttaaaaattagcattacctacgaccttagccacacacacacacacacacgccagaaaataatgccggtgtcacagaagtcaaacgatgtactgtaattctgtaaccttgcctctccacagcacgttgtcacttcaaactcaggttcttgctgatggaactgcctaagagtccgtgccgttcttcagaacactgatttccatttcttcctagtattcttcagggaacactagggaatgaataataaatcacctaggtgaagggattcctttcttggggtagcagtattgccaggttgctttccacggttttgcacttgaccgttctcccagcaccctgtcagaggggtagccctccctgcacccttgtcaggattgggtgttttcttcaacgggatggtttctgctgttaaaagcgagtgtcggccgggtgcagtggctcacgtctgtaatcccagtactttgggaagccgaggcgggtggatcacctgaggtcaggagttcgagaccagcctggccaacatggagaaacaccgtctctactaaaaatacaaaaattagctgggcgtggtggcgggcatccgtaatcccagctactggagaggctgaggcaggagaatcacgccactgcactccagcctgggcgactgagcgagactgtctccaaaaacaaaaaacaaaaaaaaaacacctcgcttttttggtgatagtcactgtgtaaaagttggaaaaaaaattaaaattacaaccctagacaccgagggttgtacggtgggaggtaattttaatattttttgtattttattttccaacgaggttacaaccctaagccacacagggttgcggcgtgagcgtcgggctgcgggggcgcctccaccctccgtagggtgggcctgggacgctcccggggctgcagggggaccggcttcgcgctcggcggccgcgcgcctccgccgccctctccgggaagcgtgggtgtggtgagcccctccgtctccccgtattccaccccgggctccggttcaaaggctaactgttcgctgctacctaaaagcacggcagcgcaggcctggcagggcggcccctcagccccgctccgcgttgtgtccaaggactggtcagcggaggccctgtcgtctcaattccagtctccccagggccggaaccagtgccttaggaagatgcgggcacggccctggtcagacgacgagtcggctaccaggaatcccgcacccaggactctttccgaggtcggaggggcgcagatgaccagcgagaggcgcggcaggctagagggatcccagtgcgcaggggcggggccgcggcggccggagcgaagagtataagcgcatgcgagacggcgtaggggactagagggttcggagcgcgtgcgtggggcggggccgcggcgggacaaatgcagagcgcacgcgcttggctgcctggcgactgcacaagcagggatggcgtcgcttcagcgttctcgggtgctacgctgctgcagctgycgcctcttccaggcgcaccaggtctggcgggtgccagcyccctcctcctcctccggcgyggggacagcggacggggagtggcggggctgtkggtgttgtctcgaatggctccgggatgcaccgggcccgaaggagtgcagggaccgctgagggcgggtctcattggggtcgcccccgcataacgttctgagctttttgtttggttcttgtacaaaccagaggtaatggttctgcggaggtggcctcttgtgaattgtagcaggtagtgggagaatccggttgagtatagcatcctttacgsagagcctaccccacgaagtagcsctgtcgcagtttcagtgagagggggaggacggttcttagagaccgagcgcgccgcggcggcgtccctgctccacacctgggcgccctctccgtcgccccgcgcctctgccgccgtccgtttccgcggggccagagacttgatatggctgttcgccgacgcataaaccacgggccccggagtcttaaagacagataatctgtgtttctaggacatatttgcctccctaactttcagcgtgccagatagagaatgccacttaaccttttccggatcgcacctgtctccctgcttgatatcacttaacactgcagtcaccgtatctgcttctgatagtccctccctcctaattattggtaatctgctatgccctgagaaagaatagcatcagacttcttcttcttttttttttttttttgagacggagtttcgctcttgttgcccaggctggagtgcaatggcgcgatctcggctcaccgcaacctccgcctcccaggttcaagcaattctcctgcctcagcctcccgagtagctggattacaggcatgcgccaccatgcccagctaattttgtgtttttaatagagacagggtttctccatgttggtcaggccggtctcgaactcctgacctcaggtgacccgcctgcctcggcctcccaaagtgctgggattacaggcgagagccattgtgcccggcgtggatcagacttgtttaagaggtatgttaaaaagtcagcaagatgctgagtatgtgtctgtaagcttgcatttaatgctaagcgtttgtaagggccattttaagggctcagaaactttttacttattttctttcgggagctgggtcctaagagttgcaaataaagggagatcatttgcatttttaaattattccacgtctaatgtttcatgctgttttttaaaaacaaattttccgtttatttttatttcctttttttgtttttgagacagagtctcacgtctcactctgtcgccaggctggagtgcagtagcgtgatctcggctcactgcaacctccgcctcctgggttcaagcgattctcctgcttcagcctcccgaatagcttggattacaggcgcgcgccaccaagcccagttaatttttgtatttttagtagagacggggtttcaccatgttgaccaggaaggtctccatctcttgacctcgtgatctgcccgcctcggcctccgaaagtgctgggattayagtgctggtgttacgggtgtgagccactgcgcccggcctctatttccttgtttgttttcctgtttcactcttccatgttcaccagtgttatttatttatttatttacttatttattttgagacaaggtctcgctttgtcgcccagattggagtgcagtggtaacaatcacagctcgctgcaacctgcatctcccgggctcagctgatccacctcagcctcccacgtagctggtactacaggtgtgggccaccatccccagctaatttttatattttttgtaggaatgaggtttcggccgtgttgcccaggctggtctggaactcctgggctcaagtgttcttcccgccttagctcccaaagtgccgggactacgggtgtgagccagcgcccctgaccctcgtggtcattttcaaccttatgaaatgtgagttgcttggccccggtggctcacgcccataatctcagcactttgggaagcccactagggcagatcacttgagctcagaagttccagagcagcctgggcaacgtagcgagaccttgtctctactaaaattcaaaataaaatagctagatgtagtggcgcgcatctgtagtcctagctactcagggtcgctgaggcaggagaatcgcttcagtccaggaggtagaggttgcagtgagccgtgttcacaccactgcactccagcctgggcgacagccagaccctgtctcaaaaacaaagaaaaattacttgaaaccaaagaggacggcaagtcggctatgtactactttaattttaattgcaagtcggctgtgtactactttaacacgtttaacttcaacaacctttgacttaggcatcattcccatcttagagacatgagaattccgaaatacacgggaatcaagtggtttctccatctagggagtggcagaaccatactatctcagcagttcccacaattaattcctttaccaggttctgtgagtcctaaacttttaaaaaggcttttcttggccgggtgcggtggctcacacctgtaatcccagcrctttgggaggccgaggggggcagatcatgaggtcaggagttcgagaccagcctgggcaatgttgtgaaaccccgtctctactaaaaatacaaaaaatacaggtcgtggtggcgggcacctgtaatcgcagctacttgggaggctgaggcaggagaatcacttgaatccaggaggcagaggttgcagtgagccgagatcacaccacagtgctccagcctgggcaacagagccagactctgtctcaaaaaaaaaaaaaaaaaaacaacttttcttacttgtttatatactcatagaaaatccacagttttattggtgttttaaggtagaagctgagaagtaaaattgctaagtcattacccagttcaatttttggtaggtgctcattgtcctccttagaatccttttggatacttcccccgaaaacctcatgattttgtattaggatcatattaatcgtattaatgttaatggatcaacctagacatctttgtggtgttaaacatgatccattacgtttcttcaagtaaccttggtatcccttggtaacattttatttgttgctgttataaatggactctttatcaattatgtgttctaattagatgtctgctcatataaaagctatattaatttttgaaggtatcttaattttgtacctaaccactgtattagactatctggttttagtggcttctcatttcattatgttggttttcggataaaaaattatgtcaggtagcagccgggctggtggttcatgcctttaatcccagcactttgggtgggtcacttgaggtcaggagttcgagaccagcctgaccaacatgatgaaaccctgtctctgctaaaaccacaaagttagccgggcgtggtggcacgtgcctgtaatcccagctacttgggagactgaggcaggagaatctcttgaacctgggaggtggaggttgcactaagccgagatctcaccattgcactccagcctgggcaataagagcgaaactccgtctcaaaaaaattaaaattaaaattaaaattaaaaaattggcttttctttgggaggccgaggtctgcagatcatttgaggtcaggagttatttcaggtattataattatgtctataaataatgatagggttttccgctcctttataatttttatacatcttacaactttcttctaattccattggctagtacatccagaaaaaaatggtaaataatagcgggcaaccctggcttgttcttgacttccatgtggaatgctggtaaagattctccagcattagagtgggttttaggcattttatatgttaagagagaacacatctagtcaggtttaacaagaattgaaaataaatgttacggaattttttttagacccaagtttaacaagaatttaaatattatggaattttttttacagcttcaatttgagtcttacggagtgtttttgttttgtttggatttggttttgcgagacaggaatattatggaatttttttttacagcttcaatttgggtctttcagagtggttttgttttgtttggatttggttttgtgagacagcctcttgccatgctacccgggctggcctcaaactcctgggctcgagtagtcttggcctccctcgtcgctgagactacaggctcaagccactgtgcccagcccaatttgattgtgtttcatacagatagccagttttcccagcaccaacccggacttgttaaatagtctgttcttttctcacttttaaagtaccacctttatgattatgatacgctaaatgtttacacatgctttggtttgtttctggactccttccatcagtttttaaaattatttcaggccagatccagccctggtggctcacgcctgtaatcccagcactttgggaggccgaggcgggtggatcaccaggtcaggagatcgagaccatcctggccaacacggtgaaaccccgtctctactaaaaatacaaaaaattagccaggcgtggtggcgggcacctgtagtcccagctactcgggaggctgacacaggagaatggcgtgaacccgggagggggagcttgcagtgagccgagattgcgccgctgcactccagcctgggcagcagagccagactctgtctcaaaaaaaaaaaaaaaaaaattatttcaggccaggcatggtggctcacacctgtaatcccagcactgtgggaggccaaggcaggtggatcacttgaggtcaggagtttgagaacagcctggtcaacatggtgaaaccccatctctactaaaatacaaaaattagctgggcgtggtggtacacacctgtaatcccagctacttgggatttaaaaaaaaaaaatttcagatccaattccatttgttttttgtttgtttgtttgtttttttgagatggagtctcaccctgtcgtgtaggctggagtgcagtggtgcaatcttggctcactgcaacctccacctcccaggtttaagcgattctcctgtctcagcctcctgagtagctgggattacaggtgcccgccaccatgcctggctaatttttgtatttttagtagagactgggtttcaccatattggtcaggctggtctcgaactcctgaccttgtgatctgcccgcctcggcctcccaaagggggattacaggcatgagccaccgagtccagcccaattccattttgttttaaataattatctgagttgtatttctgaaatttcattgcaggtaaaaaagagtgtcaagtggacatgcaaagcttgtggagagaagcagtcctttttgcgggtgagtcctacaaaacagaaagcaagtggggcgcaggcctgcagcgagcccttccagggagtcccagcatgccacagctgggatcatcctctctcaaacagagttccccagacacggagctcctgcttccgagcttcctgttccttcaggaagtgaaatggatggagcagaatctggaaaggtactgccatttgattcttcattcagcaagtatttcttgagtactttctgtgtgccaagcacaaggggaacagtggaaagtaagcccattgtcattcttgccctcacagatgcacttgtgtggaaggggaagagaaactaatgcacacatgcatctgcataatttaaaactcggctgagcacaaggaaaggaaagcactggggactgtgagaagatgacagaggaatcagggcagccggggaagggcngaggccgttggtggaggtggaggtgtgggatagtgggctcaggaagtggaggcaggcaggggcaggctgtaaatgctctcatccagctgtttgcagctggcattcagtacgtcttttcagtccatccgtattgcccctcctgaactctaggaccccaaactgtcctgcatcctttgccttactgaacttgctcttttcctgctycagcsccagtgccacctctcccttcacctctcatctttcctctccttctacagccatgtgctttctttctgaccttaaacccaaatttgctccctcttcaggcctttgtgctcactgtggagttcccctccctcttctcagtatcctatggaagttacatagtcatgtgtttatgcacggattgtccatctaaggctgtaagttccgtgagaacagaggctttttatttgctggtgtatccgcagcacctagcacagtgctcggtgtttgtggagtgagtaaggaactggcccaaccttgttgggcatttaggttgatttcccttttgactgttatgcacaactctaccgtgaagcttttcacaaaaacctctttatccacgtgaccagctgtttactgtttacttaggacaaagtcctaaaagttaaattgctgttttttggggttttttttttttttgacatggagtctctctctgtcatgcaggctggagtgcagtggcgcaatctcggctcactgcaaccttcgcctcccgggtttaagcagttttcctgcctcagcctcctgagtatctgggactacagatgcatgccaccacacccagctaatttgttttttgtatgtttaatagagacggggtttcaccatgttggccaggctggtcttgaactcctgacstcaaatgatccacctgcctccgtagacaaaaacatttcataatgttggtgagtgccttcacctgatattttttatttttttatttttttttagacggagtctcgctctgtcactcaggctggagtgcagtggtgcgatctcgctcactgcaagctccgccccctgggtttacgccattctcctgcctcagcctcctgagtagctgggaccacaggctcccaccaccacgcccggctaatattttgtatttttagtagagatggggtttcaccatgttagccaggatggtgtcaatctcctgacctcgtgatctgcccaccttggcctcccaaagtgctggggttacaggcgtgagccaccgtgcctggctgatattttttttaaaaaagggaaaaaaaacacttcagaatgggttcagcaaagttaaaaaataaataaataaataaataaagtgctggcaaggtaatgagatctcttagggaatccaagggcagaacttcatccccggtcccttgaaaaactagccccaagaactgaaaagctgccaacaagccagacatcagcttttcctgcccatcacccagcttctccctatatctttactctattttctcctctccttccctttctgtttctccccagactgttcagtcagatnctctgctccaagtccatagaatctcattccaagccaactggaagagctgagtctcaattataaattcctaggagaagcaacctggttggcccaggctgactcggatgcccacctctggtccagtcaactgggattgggtctcagaagagaggggctggcttaccaggtaggcagacaccccacatggtgagcatggcttgtttgagrtgtatatatttctacattctccttgaggaagccttcttactcccctcaatgcctctgtgctgtgtgtggtatgtggtgtatggctgactaggccacagtaacaaacacaccaaaattgtggtggcttaatacaatagacgtttctcttgctctcataacagtcctgggaagatgataaggtcagcagggcgctgcccttgatgtggttgctcagggatccaagctcctgccatcttgagctgcttctattccctgaggctcatctgtagctgcttctagccactgtgcttctagccactgagaagggcaggtgcttggaggagctacygagaggctttgagggccaggctgggaagcaagtgacagtgccatggaaagaggctggtttcgtggccacccctgaccacacgcacactggaaaatgacatctagttttcgggaagaatgcgcttcagtatccatccagcagtccctgccctatggaagagcacaccgctactggttatgccagcctggtctttgccatttccccctccagctactcttctccgttctcaggcgaatgtgctccaaacaggactgcactccctacgtgtccattacaattgcttctgtcagcgtcagcagtggtctctgtgttgctaaaaacaacggttggttctcagttctcacttgacttactagctgccaggcactgggagtccaccagaattctgtgctcacgggacatcaagaatgctcctgccagtggggtgttgaggaacactggacacgtatagtgtgtgtgtctgatcacagatgtgctccattgtcccagcacacttcacttaaaaaacacaggttcaaagsccagantgttaagaatttcaagatggcgacagcagagcggctgtcacaccctgaagctgattctgcctgtgccatagcaggacgcatgctctcaaattccatctcgtaccatctgcctgtgccatagcaggacgcatcctctcaaattccgtcttgtaccatctgcctgtgccatagcaggacccaggatctcaaattcaggctcttaacatctgcctgtgccatagcaggactcatgctctcaaattccatctcgtaccatctgcctgtgccatagcaggacccgtggtctcaaatcccgtctcgtaccatctgcctgtgcgatagcgggacctgagccctcaaattccgtctcgtaccatctacctgtgccatagcgggacccgtactctcaaattccatcccgtaccatctgcctgtgcgatagcgggacccgagccctcaaattccgtctcgtaccatctgcctgtgccatagcgggacccgtactctcaaattccgtctcgtaccatctgcctgtgccatagcacgacccatggtctcaaattccatctcttaccatctgcctgtgtcattgcaggatccatgctctcaaattccgtctcgtagcatctgcctgtgccatagcaggacccatggtctcaaattctgtttcttaccatctgcctgtgccatagcaggacccatggtcacaaattccatctcttaccatctgcctgtgtcattgcaggatccatgctctcaaattccrtctcgtagcatctgcctgtgccatagcaggacccatggtcacaaattccatctcttaccatctgcctgtgccatagcaggacccatggtcacaaattccatctcttaccatctgcctgtgtcattgcaggatccatgctctcaaattccgtctcgtaccatctgcctgtgccatagcaggacccatggtcwcaaattccatctcttaccatctgcctgtgtcattgcaggatccatggtcacaaattccatctcttaccatctgcctgtgccatagcaggacccatggtctcaaattccatctcgtaccatctgcctgtgccatagcaggacccgtactctcaaattccatcttgtaccatctgcctgtgccatagcaggacccatggtctcaaattccgtctcgtaccatctgcctgtgccatagcaggacccgtactctcaaattccgtcttgtaccatctgcctgtgccatagcaggacccatggtctcaaattccgtctcgtaccatctgcctgtgccatagcaggacccgtactctcaaattccatcttgtaccatctgcctgtgccatagcaggacccatggtctcaaattccgtcttgtaccatctgcctgtgccatagcaggacccatgctctcaaattccgtctcgtaccgtcttccccttagacccctcagctccagcgatgctggcctctttgctgttcctccaaaatttcaggctcagggtcttcacactcattctcatgtattgcttctgctggaatgttcttcccctagacagccatgtgggttgcttcttcatatcttcctgtttgtgctcaaacgttaccttcttagagatgcatttcttgaccattttgaacaccttatgtaaaacggtatgctcttatgtacgacctctttcctggccttgtctttctcaggagcacttactagcatctgataggttatatggctcacttgtttctttcctgtctcttctcacttgaatgtgagttccatgatgacagggagtcttgtccattcctgtattgtctaccccaagatgaggcctggcacacagttggtattcaataaatatttgttggatgaatttgtgactggtaagtgggaaaaaatgtattttattttgtattcctttgattatcagtgaaggtaagtatcatttcatatattttttggcagtatgttatacaatatggcaatatgtgttacttctcttgtgacctttttactcatgtgcactaaccattttgtgtagggctttgggttgagtttggcttcagtaggtagagttcagggtgattgtgggacagccacatagatgtaaactattagttccggagactgttggtttgtaaatcattctagagacagccgtcagtcattaggattcctgcatgctgctttaggggtctttgggccttgcagaatacagctttgtcctccctgaggtgcatctcaaatggatctgtttctcagcattctgccagcactttttcaatgtaatatattttttggtttctcaggcttatggtgaaggctctggtgctgattgtagacgccatgtccaaaagttaaatctactacagggacaagtttcagagctgccactcaggtacagttgtttgagaagagcgtggttgtcttgccctgttttcgtcttgactggataatagaagtacacagtggaaatcctgagctgggcactctgctgtggctggacctgccccaggtccctgctgtcactttgccatctgaggtcagcagctgccctcagaaccgaccccggggatgtttagaatactggggctgagcttcacccgaggagattctcacctgattacctgtgatgaggtccagacctgtggtttttaaagctggcaggccattgctctgtgcctccagagctgaaggctcttgacacagctgttcttgtttgtggctggctcaccagagaggccctggtaggacagaccccactgggcctgggtcagtggagaagtcccttagacttccacgtcttacaatatggcagtcaaacaccctgarcaattctcccactgaaaataactaaaaatgctagctattttaaatgcactgatgagctgacaagaaagtaactctcggccaggcgcagtggctcatgcttgtagtcccagcactttaggaggccaaggcgggcagatcacgaggtcaggagttcgagaccagcctggccagcatggtgaaaccccgtgtatattaaaaatacaaaaaaattagcctggcatgatgttgcatgcctgtgatcccagctactcaggaggctgaggtaggagaatcacttgaccccaggaggcagaggttgcagtgagccgagatcgcgccattgcgctccagcctgggcgacagaacgagactatctcaaaaaaaaaaaaaaaaaaaaaaaaargtaagtaactctcagaggtcaaaaatgaagaagcgggtctgatggtggtgggttatgagaactgattaacattagtgtcactaacgttggtatacaactctccactgctaagtttaactggcttaaaaaaaaatgtagaagccaaaatccagagaggaagcacctgagctgctggggtgattgaagcccggtgctctggagcctccatttcgacggctgggagaggggcaggaggccctcagaagacaaaacctanggcagtgtgggcggaccagtaggacacctcctaacaaaactgagctcccggaggactacaccctcggtgtacaaatgaactagatycactctgcaacaggcagcttgcctgtattgaccttggcaatggctgaagagggggaaatatctctaagawtttggaaataaaaggaagtagttgcatggtttttcagccttttacataccctgtgtgaaaagcctcaagcagaaaatttatgttttaattgtcccaggaagcagaggtaaatggagctcctctttgcagcaatatatcttcaattgctgggccttaaagttcccacagaggccgggtgtggtggctcacccctgtaatcccagcacactgggaggccggggcagatggatcatgaggtcaagagatcgagaccatcctggccaatacgatgaaatcccgtctctactaaaaatacaaaatcagctgggcgtggtggcgggcgcctgtaatcccagctactagggaggctgaggctggagaattgcttgaatctgggaggcggaggctgcagtgttccgaggtggtgccactgcactccagcctgccaatagagtgagactccatctcaaaaaaaaaaaagaaaaaaagaatccccaaagaaaaarttccaagtagcataatatactcaggagtttaaaatcatttaacattcaaggaaatacaccaccaggagcaaaagatcaacagtcagaaaagtcagacccataaagacttcagaatacatgatattgcatgtttaatatatttaatccaataaaagaagtgggtgataagatgagggccttcaaaaaataggtgtatttgagagcttttttggaggttctagcaggggagtgcagctactcatataccctggaccaaagaccgctcctcctctattggaggtggtcgtcctcttcgaccaagcgcacagcttcaggagggacgcacatggagnggtgagggaagaaggggacaccacctagccatccagatcagctaaccaaccctggtgattgatggagtgacagatggtgcagccacatcaccctcacatccaaaaaaataggtgtatttgaaaaagaaccaaaaagaggccgggtgcagtggctcacacctataatcccagcactttgggaggccaaggcaggcggattatttgaggtcaggagttcaagcccagcttggccaacatggtgaaaccctgtctttactaaaaatacaaaagtcaattgggtgtggtggcacatgcctgtaatcccagctactcaggaggctgaggcataagaatcgcttgagcctgggaggcagaggttgcagttagccaacctccgcctcccaggctcaagtgaggcctgcaccagagtgagactctgtctttaaaaaataaaagagwttgtagaacttaaaagtataatcattgaaattaaaaattcatttcaggccgggtgcagtggctcatgcctgtaatcctagcaatttgggaggccaaggcaggcagatcacttgaggtcaggagttcatgaccagcctggccaacatagtgaaaccccatctctactaaaaatacaaaaattagctggaaatcacttgaacccaggaggcggaggttgcagtgagccaagattgtgccactgcacaccagcctgggtgacagagtgagactccatctcaaaaaaaaaagaagaaattaaaaattcagtggacacgttaaacagattaaatgcagctgaagagagaattagtgaaatggaagataaatctagaaaattattcacagtgcaacacagaaaaatggaaaagtagaaaatataagggaaagttgagagacgtggaggttacagaggagagttctagcaaaagataattaagagaatggggcaaaagcaataactgaagagataagagcacagcattttccagaatcaaagacataacatttttagattaaggaaacacagtaaatcccaaactggataaaagcattattttatttgcaaatagcatgattgtgtatgtagaaaatcctaatgaatctacaaaaaagctactagaactaataatttagcaagatcacaagaatacaaggtcaacatacaaaattaaattgtatttctatatatatgcagtggacaattggaaaaatgatttttaaaatcaaataccagctggatgcgtacttcacgcttgtaatcccagcactttgggaggccgaggtgggtagatcacttgagcccaggaatttgagactagcctgggcaagatggcaaaaccgtctctacaataaaaagaagaaaaaaaaagggcaggcgtagtggtgcgtgcctgtggtcccagatactcaggaggctgaggtgggaggatccacctgagcccagggaggttgaagctgcaacttatctccattgtcatgtgattccatcttccagcaatcttggctcactgcagcctctgccttccgggttcaaacattatctgcctcagcctcctgagtagctgggaatataggtatgcaccaccgtgttcntcagacttgtctcgaactcctgacctcaggtgatccacctgcctcagcctcccaaagtgctgggattacaggagtgagccactgtgcccagcccctggtcatttttcaaagggcatatgtatggtcttccctgaaggtctctagaagaaactgtcagtgccagtgaagaagaaaacgtgggacaccagcaggctgggaatgtgaagcagcaggtaagcctcaggcccacctgccccaggctggctctgtgtcagggaagggatgaatgcacasatgtatccagtagtcattatagcaaatgtgtgttgatgccacccaatgacaggcagttggcttaaagctgcagggaacacaaaaataaataaacctgtaccttttgtaaggatggaggcagccatgtgtaccaagcattacaataccctgcaaaggactctctcctctgtctgcttggagaactcctgaatgtagctcaaatatcaccttatactgcttccactttgctcccacagcactctgggcatacctctgagagggaaagaataatggggtgaaacacctgggtttccatctttccttgttccagactgcaagctgttgttttgttttgttttgttttttttctctgaaacgaggtctcactctgtcgcccaggctggaatgcagtggcgcgatcatggttctctgcagccttgacttcctgggctgaagtgatcctcccacctcaggctcctgagtaactgggactacaastgtgccctaccacgcccagctaattttttttcttttttgtagaggcagggtctccctgtgttgtctaggctggtctcaaactcctgggctcagrccatcttcccacctcagctcccraagtactrggattacaggcatgaaccactgcacctggccagactcacactttgttataagcagaggaagatgctcttctggtacctgtgcctgtgcttccaattcagtccatttacagacttaattttatatcattctcatcagaaatacttttttgcatcctagttttgagttgtatcattcttctgtgctgcggtatagttttcagtgattttcatttcttatttattaatttttgagacagggtccctctctgtcacccaggctggagtgtggaggcatgatcgctgctcactggagccccaacgtctcaaaaaacaaaagtatttrcagaatgtagtagatgcaccagtattgattccttattatgtggcatttaggttgtttccacacttctgcttgcctgcttgcctgcctccctccctccctccctcccttccttccttccttccttctttcctcctttcgacagagtctcgctgtgtcccccagccggagtgcagtggcgtgatctcagctcactgcaacttctgcctcctgagttcaagcaattytcctgcctcagcctcccaagaagctgggattacaggcacscaccaccacgcccggctaatttttgtatttttagtagagacggggtttcaccatgttgcctaggctagtcttgaactcctgagctcaggtgacccgcccgcctcagcctcccacggtgctagggttacaggtgtgagccaccgcgcctggccatgtttccacccctctgttctttttttttttttttttttttttttgagacggagtctcgctctgccccccaggctggagtgtaatggcaccatctcggctcactgcaggccccgcctcccgggttcacaccattctcctgcctcagcctcctgagtagctgggactacaggtgcctgccatcacgcccrgctaattttttgttttttttttgttgttgttktttttttagtagagacggggtttcaccgtattggccagggtggtctcgatctcctgaccttgtgatccgccagcctcggcctcccaaggtgctgggattacaggtgtgagccaccgcgcccggctacttctgttcttataaatgaaatttgctattttttataagactgggactggcacctctgccttctctgtgtggaatcactgggccagggagcatagactttcatgagtctcttggtgggccgtgccctgccgccttcccgaggcctgtgccagtgagcactgtcctgccagcattgcatagtattggcgtccatcaccttccagcyggtgcctttcctagagtggagctggacatgactcctgagatcctcaggcccaagagttgggctaggggttttcgataaaactgcctggtttccagtactgagaatcaacttttttctmaatctggcaggaaaaatcgcagccctcagagagtcgctggctgaagtatctagaaaaggactcscaagaactggagctggaaggaacaggagtgtgtttcagcaaacagccttcatccaaaatggaggagccaggcccccgcttcagtcaagacctgcctagaaaaaggtaccaagtgcgtctccgttccagccctggcccagggcctmtgctgcctccagcagtggggcaccagtgagccactgtgagcgtcagccaagcgcgggaagcctaggtggcaagtgccagcaggtggraaatygggcagctgctgccactgctggccccacagcccacctgggcattgggcactgctggtgcagaggcgaaggctgggcaggacacccgtgtgcacaccctttatgatgcccacttaattctgaacatctcagactgtactgaccccaggggagaggtcggagtagctggcaggcctaagagcttttagctcagagaagcagaggcctcagacttgaaggaagttttcttctgcttcaggcatttcagtgagatttttggagagactgctttaggttaaggatctagggaggctcttagagggcaggtgctttcaggaggtagattctgctttcaaaccagaaccttcatccgggtacagtggctcacacctgtaatcccagcactttgggaggctgaggcaggaggatcatttgatcctccagtccgggcaacatagggagaccctatctgtacaacagattttttaaaacaaattcatggggcatggtggtgcatgcctgtggtcccagctacttgggaggctgaggcaggaggatcacctgagcccaggaggtcaaggcggcagtgagccattgcactccagcctgggtgccggtgagaccctgactgaaataaaaacaaaactttctagcacctagaagctgtgaagcaggggagtggggcctgggcggtggctggacaccctgagcagctgcctgggaagccgtaggaacaagcaggtggccacccgagcctgtgggccatgtgatcgtggagtcaggctcggggtgccactggagagtagcacgggactactgacggtcctgtcctgacaggaagtggagcrggagcaccgtccagcctccgtgcagccgtggcgtgcaggactcgggtggytctgaggtcgcctggggaccccagaaggtcagtgacaaacagtttctctctggtcccagtgaccactgagcgtgtgtgtgataattctgtcttttgtcacagttgacgaagtgtgngattcctacccgcagaaagcccatcttcccacccgggtttcttgtcttttctgtctgaagccaactccttcctcgggtctgtacccccttttccctcccatgcctctcgtctcccatgagggtaactcaggaccaaagagcattgtgacccttggagaaactgaggttggccagcaggtcaacctgacgatgggtcagggccatcgtctcattctgcgtggagcacggggacctttgtccgggcaggagtcgtcagcgggccgccctgaatcctgggagatgcttccctccacactcgcatttgccctgctgtgtggactcttgtatgtgaggcactcttcacttagggtgttgtcttgttcttttttgttttctgagacagggtctcactctgtctacccaggctggagtgcagtggcacagtcatagcctactgaagcctcaacctcccaggctcaagtgatcctcctgcctcagccgccaagtagctgggaccacagatgcacaccaccacactggctaatctttaaaaaatattttgtagaggccaggcgcagtggctcacacctgtaatctcagcactttgggaggccgaggtgggtggatcacttgaggtcaggagtctgagaccagcctggccaacatggtgaaaccccatctctactaaaaataattagctgggcgtggttgtgcacgcctataatcccagccactcgagaggctgaggcaggagaattgcttgaacctgagaggcataggttgcagtgagctgagattgcatcactgcgctccagcctgggcaacagaaaaaaaaaaattttttagagacatggtctcactatgttgcccaggcttgtctcaaactcctgagctcaagcaatcttcccacttcccaaagtgctgggactataggtgtgggccactgcgcctggcccatttgtcttgttcttgaagcttccagtccagcaggccccaccgcatatccagtgctgcagagtgcagggtttgctctgcctgtcagaggagccagggcacagcaagggcactgcagttgggagtccactgggcgtcagtcactgcccccacccccacatcagccaaggtcggtctccgctggccttgcaccacgcacagagcactggctcatgccaagaagcagaattcaaactttgatgttgccgccaactagttttgtgatcctgggtaagtaagtggctttgaatctccaaatcctagaagaatgaccagagagtctgccacgggccagtccctgggctgcatgttgtaatggtatcattgtgtttcatgctccctcaagcctgttgctttgttttaaaggtgaggaactgaggcttgcagtttttgtgcagtcatggcaagttcagtggcaaagccaacgtcaagtttcagggccgcagagcctcttctgtactgcctgggtggcagtgctgcagggacccactctatcgctgctttcacattgcttttccctttgtaagcagcacaacccaactgttktttttttttttttttttgagtaggagtttcactcttgttcccctggctggagtgtaatggcacgatcttggctcactgcaacctccgcctcccaggttcaagcgattctcctgcctcagcctcctgagtagctgggattacaggcacccgccaccacgcctggctaatttttgtatttttagtagagacagggcttccccatgttggccaggctggtcttgaactcctgacctcaagtgatccacccgcctcggcctcccaaagtactgggattacaggcatgagccactgcacccagccttttgtttttgagatggggtgtcactctgtcacctaggctggagtgcaatggtacaatcacacctcatagcagcctccatctcccgggcttaagtgatcctcccgagcagctgggatcacaggcactcaccaccacagttggctaattttttgtagaagagggggtttcaccatgttgcccaaactggtgtcaaactcctgggctcaagcaatctgcctgcctcagcctcccaaagtgctgggattcaggcatgagccactgctcccagcctacaacccaactttcttttttttgagacagagttcgctctgttgcctaggctggagtggaatggcgtgatttcggctcactgcaacctctgcctcccaggttcaagtgattctcctgcctcagcctcccgagtagctgagattacaggcgcgtgccaccacgccaggttaatttttgtatttttagtagtgatagggtttcgccatgttggccaggttgatctcgaactcctggcctcaggtgatctacctgccttggcctcccaaagtgctgggattacaggcgtgagccactgcgcccggccgacacccaactttcagagcatctttggttcctggggtgagagaagccagaccccagcaccagtcctatcccacagggagctcggtgctgccacctctgcagctgcagaacccggcaggctctggagagctgcyccccggtgggaggtagcagaatggagccagcgcacccctttcccratgtctcgaggcccttctgctcaaaattcttttgtaggcaccggtaacctgattctaaggtccccaggagatggatcacctgatgacatgagaatgtcttgtttttggaaagcctggtcatgcaatttagcagaaggtttgcggtgaggtggaaggcatttatttgctttgtcttgctaaccctcaaaatcaaagcctgtcccagcctgacagcttccagcagaaagtgtcagaaccagaggcccagccaaggcccaggcagggcaggcggtcctcctgggccctggcattgttcttacanatggagggcatggccatcttctctttcagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcnatttgtcctgccacctagaaaaagttcacatgtggayagtgagcagccaaggtctcttcagaggraccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcgatgatgatgtgtgatctgggactggyaggttattaatcgagatacacttgttaggagggacagggttcccctaaggcacttttaaagatactctgtaagaaccattaacaataaacttactgtcaatcatttctctctatgcaaacrtcattggttaaagtgctgatgccatttaattagattgtttacaaatttaacaggatggctacaaagagatcttattttaaaagcagctgatggtttggaaatgaragaactacagtggtgaagrgmccaggaggcagctctcagtgaaaccaacattgcggatgcccttcgtgagccttctcagtcccagcaggaagcccacaacactggcctccccagcctgcctgctgacaacacctaggcttactttatctaaaatcagagtgtaccaggtctgtagcagaaaataatcaactaaatgtcagggacctatgagtcatttaaaacaaaagagaaagtgaaagccattaggcaagctatgtgctgggctgctaacgtagcccctgcagggaggggtcaggagcgcgctgcagtgagccttgggtctcgcaggcccagccctgctgcaaggagccagggcacccaggaaacatcagcacacacacacacagggaccctcccttcatgtcacttgttttgctgccctaaatggcttcttgcaccctaacccctgatcctggaagaaggcagagaaactggcccgtacagagacctgcaattctacgcaagcttaacacaactatgagacagaagaggggcacgcagaagaggtgggcaaaagtggtcacaacggcgggggatgctttgaatactggatggtgtccagagccgctccgatgtcatagttcttggtctgcaggagcctggtgagccagccgccttcatcagagaagcccatggacagcatctgggagagggactcaatcagccgcgggtcagcctctgccgaaacagtaaggaagccatgaggagtggtgctgagccctgtgagtgacccgaaacacataccctgctgccttggccagccaggaccagggtctgccagtgtccgagcctgcccagagctctcgtcctcacaggccacagtggacctgctttccctgtaaagggccaagcagtctttttcacactgctcaactctgccactgcgacaccaggcagccaggtggtgtgtaagcagaaccatcaatggacactgaaataggcatttcacctgtcacatcttttgattttaaaatgtaagaacaggccagttagccaattattacactcctccatgcaagagatgatggggcattgaaatagattgaagatggagagagatgaatggatacaagatacattttggaggtagaatgaacaggacttggaaatgtatgtggagaaggcaaaggagttaaagatgatatctggagcagcacaactcacaattgcaaagatgtggaaccaacctaactgcccatcaagcaatgagtggataaagaaaatgtggtatatatacaccatggaatactactcagccacaaaaaggaacgaaataataccttttgcagcaacttggacggagctggaggccattatcctaagtaaagtaattcaggaatggataccaaatatcatatgttctcacttatgagtagatgctaagctatgatgatgcaaagacataagaatgatatagctttccctctccctctttctccacggtctccctctgatgccgagccaaagctggactgtactgctgccatctcggctcactgcaacctccctgcctgattctcttgcctcagcctgccgagtgcctgcgattgcaggtgcgcgccgccacgactgactggttttcgtgtttttttggtggagacggggtttcgctgtgttggccgggctggtctccagctcctaaccacgagtgatccgccagcctcggcctcccgaggtgccgggattgcagacggagtctggttcactcagtgctcaatggtgcccaggctggagtgcagtggcgtgatctcggctcgctacaacctccacctcccagccgcctgccttagcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccacccatcgtctgagatgtggggagcgcctctgccccgccgccctgtctgggatgtgaggagcacctctgcctggccgtgaccccatccgggaggtgaggagcgtctctgcccggccgccccgtctgagaagtgaggagaccctccgcccggcagccaccccgtccgggatgtgaggggcgcctctgcccggccgcccctactgggaagtgaggagcccctctgcccggccaccaccccgtctgggaggtgtacccaacagctcattgagaacgggccatgatgacaatggcggctttgtggaatagaaagcggggaaaggtggggaaaagattgagaaatcggatggttgccgtgtctgtgtggaaagaagtagacatgggagacttttcattttgttctgtactaagaaaaattcttatcctgttgatctgtgaccttacccccaaccccgtgctctctgaaacatgtgctgtgtccactcagggttcaatggattaagggcggtgcaagatgtgctttgttaaacagatgcttgaaggcagcattctcattaagagtcatcaccactccctaatctcaagtacccagggacacaaacgctgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaataaataaataaataaacaaaaataagaactactcttggcccataggccatagctcgccatcccctgccctaaggcagagaagacacacagcggcggcccacagcaggttgtgcacacggaccttggtttacacacggctgccatgtgacaatgaggagtttctgtcagctgtccccaccccccacccccccactgctgcctgccacaccatccacttcaacggtggcttctgcctggctcctacagggatcttggctatgacccccccccccctctcagaccagcactccctgaggcggcacttgagtgtgagtagtagggacacacccagtgctgccccctctctgtgtcacacctgccttaattcctggtctgcatgttaagttttagaaactcctacaattaatattcctggctctggagtttgcttaaagaaaaacattttcagaactgcattagcagagcttactcgctattgctcagggtacacataataggacaaaaccaactcctaacctcccacacctacagacagccctgcagtggagaacatctcatccttctgtttgtgtcgctgaaatcagaggagggcaggatgctctaaagggaaaggtaggaatatgtacaaaacctcttggttcacttgcctggcgggagatgtgggtacaaggcagcttccttcagccctgtgggtccctcctgggaggggtccagagagcttggcccttcggattctggcatctgtagggactggagttcacctgtagacgggtccacttcttttgaagacagatgggtccagtcatcatctcctcctgaacagttatccgactccatctgttcctggaacaaaactcaccatgagcacacaggagacacgcgcaacaggccaagcctgaccgtggccctggctcctggcagacagtcggggagcatgcatgcacacgtgcagttaaggctgcaggggtctagggggaacagtggccactcacaaagaccaagtaactacaaagttctagcaggttcccagcgtgactttaatggcacagacatcactgcagcagcagcagctccctcgggtttgtaagtggggctgcagaggtgctgaggatgaggcggaggtgcaggccacagatcactaggctggccgtggtcccaggtggcgggaggggcacaggcttgcctcagggcgcccctcggactccaaggcgatctttctcatctgctccgccagagactgcgtggcgccctcaacattcccacccggcttgctgggatcagagcagcagctgcttggctgtgagctgctcttctcctctgtgctggaactctctggagagacgggggtcaggcggcttcttttccctccgtgctccacatcgatatcaacttcaatgcctagaggcggaggaggaaagagcaagccgtgaagttcccccaaggatgcacctgcaagcaggagcttggcctgtggagactacagactcacgaagatctcaacgttcagtccccacaagcagctaagtgtctggatggtggcactcagcgtgtggatgcaggtgctaggttctacccagctcgaccccggaatcacacagccagtatgggaccagacgatacaaacccatgagtcagaggcttctccccatatcccagctacaaatctctgtggcttctggaaacattcttggtgggcccatgatactggacctttctctttctccaattcagtaaaacattaacctcagctagcatctaaagtcagcttctgagccagaaagtcgaaagagacctttttcctaaccatgcaggacacgggccacacggcaggtggggccaggccctaagtacagggagagccaataccacatgtggcaggcgcttccagccacagtgatggaaggccatgtgcctcctgacacctgcacacagaggctttgtgcgacgacacacacgcacacctcaacgccggagctctgctctgggaggtggatgggccgtgcaggcgctgcgtagggcccaacgctggccccacagggaacctgcacacctccaggctcacgtgactcaccagggacagaggggagaatcacctgcactatttttgaaattaaatgtgtcaaaagtctccacacccacagcttagagtcaccagttgccaaaggctgtggtgcacactccctgcccccatcccactccccaaactctccctgtgccctttcagctcacgctgctcttgcctgctgctggagttcacatctgcgcacttcctactctggaccagtacctgcctctccttccactaccctttccaagacgcaattttttgttaaaagaacattcagtaggccgagcgcagtggctcacgcctgtaatcccagcactttgggaggccgaggtgggcggatcacgagatcaggagatcgagactaccctggctaatatggtgaaaccccgtctctactaaaaatacaaaaaatcagctgggcgtggtggcaatcgcctgtagtctcagttactcgggaggctgaggcagaagaatcgcttgaacctgggaggcggaggttgcagtgagccaagttggcgccactgcactccagcctggtgacagagcaagactccatctcaaaaaaaaaaaaagaacattcaatgtttcagctaggacctctatctaaatgttctttgctgggtcaagtagcagactatttctttgtatcgctttttgttttcctaccactgataatggcttctcttttcctttgttttgtagacagagtctcgctctgttgcccaggctggagcgcagtgccgcaatctctcggctcactgcagcctctgcccaccaggttcaagtgattctcctgcctcagcctcccgagtagctgggactataggcacgtgccaccatgcccagctaatttttatatttttagtagagacggggtttcaccatgttggccaggctggtcttgaactcctgacctcaggtgatctgcctgccttggcctcccaaagtgcttggattacaggcatgagccactgcacccagcctgccttctctttgcatttgctaactttccctatgttctcccacagcatctccatagttttctacaagggtgaagtggatcagagaccccactggttctggtgttttccatagagagtgccgcttgctgtgcagcctcctgttccagccaggactggcagctctctgggcagaggctgcgctgtgatgctgtgaccccctttacgttcaccctctgtcctgttaggtcccccgtttcctaatacctctgtgcttcattttgggtttctctcttcatgtggttcaaaccaaggttaaaataattaagactgtataccagaaagtaactttgttctgccctgatacttgatcgttttagctgggtatagaattctaggctggaccaggcacagtgactcatgcatgtaatcctaacactttgggagaacaacatgagaaatctcttgagcccaggagttcaaaatcggcctgggcagcatggcaagaccccatctctacaaaaaaattttaaaatagctgggcacggggctgggcacagtggctcatgcctgtaatc

SEQ ID NO: 10557 - DNA, 43692 bp, Homo sapiens
  misc_feature (1)...(43692): n = A,T,C or G, or insertion/deletion polymorphism (see Tables 1-2)
aattcagggcactgcagggaaacaccctggactcaaacaccagtagatgggttctcagcacaggcaggcgggttgctgagggtatgggggagtaactagtacctgactctctccttggggtccccaaaggactctcggaggcgggagaagtcagggtagaagtggggggagggtgagatgacctccaggagcccagaatggatctccgtggggaacctgggggacgggaaggcctagtccgtatgcagcctccaggggntgagaggggccgagcccaccagactgtggccctttcttgaggctcacccagtgccagccccccaccaccccctacacccagccaactgaggtagcagagctccagaggggctgggccacttctgcacacccacccctcccccaccaggtccctgcctccccacgagataggaaaggcactatctcatggggaggcaggaacctgccagcacaacaccccgcaccgagctctcccgccaccagctctctggggtcgccagtactcacaaggccttgatgttctctgtcactgccgaagtgtactgtgagtcagtctgtggggagaccaagcaccctcccttagccctgctgctgccccaaaaggcctggaagggcttggagaaggggcacaggcttcagatgccccccacgtggagggagtgagcctgctgtgctgagggcggagtaagggggcccccagagacggccctttccctttgggactcgcatggccaaggactagggggtggcgggggcgatgggtaggggtagagggtgccagaaagccctttcaactttctatctcggagcatttgcgaatgaaactagcaactgaacttccgacagctttctcctcggaatggttcctgctgtcagttctgcaccgcgggggctcctctgaatgtcccccaaccccgcgtcccggctcactcgcctcggcgatcagcaccacgatgaccgagtcctccttctcctgcgggctcagctcggagatgagcgagtgcagagtgtcagtcaggtacgagtgcacctcgcgccgcacgctcgggatgcccatcaccaccgacactatgggggacggaggcccgacgctggaaagggtgcgggggccacccgtccccccaccccgtgctcctccctgtctgcgcccatacctccggtgcggccctggcccacgcgcaccgcgggctgcagactgctctccttggccagcaggtgtggcangtgatggaagacggtgggcaggtgcagcacgtgccggtgtgagccgttccacggcttcaatcgggggtcctctgggtgggtcgggaaggatcgggactgagaccagggaacctacaaccagcccgcccccgccttttccccctcccgccccagacctcacctgttaggcggccccaggtgcgattgccgtctccgtctcgcagcgcctgcctttctgacacggccctcttgatctcgtccagcaccaggttgagctccttggagcgcttgaggctctcctgctcagctgcgtgcaaccgatcgcgcagcgccaggaactcccgctggtaaacgtccacaacgtcgcctgcaggtggtaggcaagccgtcacgagggggcggtctagagccaccctacgggcccctccagtgtgccagcgcacacatctgggtgtccacctctgcaatagctcattgacatctgttcttgtgcctgccacacgtgacatagctggggtcactctaaaattacactgacactaatgctcatggggagaaaaccaggggaattagccctcttccagtactctcccccaccgggggttattttatcctctgagaaggcatctgaagtggaaatacgatttccagacctaggtaggtggatcctaagcaagggctggaacagcctcagactgaatccgctccatccgttggcctccaaagcccactcttgctttttgcagcacacgctccctccagcgggtgggctacccaaggtcctggtgctagctcttcactgtccttgtagcggtcgctggttgctcaccctgcactggattcttagcctcacgatggccccggggggtggctgctgcagttccaggagcccacctcacttcattgctcaggtgagcaaatgaggttgagaaaccggccctggggctgctcaaggacagtcaacagcagcgaggggactagctctgaacgccctggtgcctgtgtctctggagacctgtgctgcgcctggggcaccctgaagggtccgcatgccaccccagggggcccctgtcagaacctccagctgggcccaggcatgagggctgtaggtggatggggcagcacagaggtggggctgcccgacagtagagaggcaccaccagtctggcagggaccagtgagcaagaatgagatcaacaacctcctggtggctcggtgcccacagtccacgcagcaggacgctccaggcctctgccaggcgagtctctgaaaacctatgtggcctacaaggccttctgtttccaagtctccaagtttaagaagcctgaccgaactccctctacactcaggcagctcttccattccttgatccttggtggcttcacagaccccagagttgcgtgggatggcctcaccccaccagcagccctgtgcatgatcaaggtcatgatcaggcaaagttcagtcacctcagggcacacccctttccgaaacgggcaggaggtcgaagtgccaagtgaccagggaagaggaaggggtggacctgggcaggagggaaaggtttaaggagcagggagccaggtagatcttccctgaggcatctcttacccaagaagccagcccccaccctccacaccctgcctctctggggctaaaggctgaggcaaagcggagcctctggacagcccctggcgggagggaaaggggagtcagattactggctctgccaggctccacgctgggctcaggggctcggttaccctggaaacctaaccccttgaatgcagagctggctatccccagggctcacccattgctgggtgacaccaggtgtaggcagcactcgcccacagggatgggactggaggtgcagaggcctagagagccatcaggaatgggttcagagccacctgcacctgcaggtgcgcctccctcctgcctagatgccagtccccgcttgcctacttacagccactgcccacccccacccccgagccccaccctggctttctctgtcccacacgactgcctcagatggacaggctgggtgggcagtggtgggtgatgctgcctgaatcaccctggcaacagcctgcgccttaccctcgcttccttcctaggggcctcccctctcccccgggtcctgtttaccaggagataaagggccccacgggctcccgcccacaccaacccttctgtcatttccctacacactgcaggccctggccctgggcagcctcccccgcctgccagctcctccacccgccttgccctcagcttctctgactgtgggtccaactctgtgactgcctccccatgggccaggccctatgccagggctctgccaagccatgctggcaccctataaccctcgggagctggggaggcagctcaggtgaggagagggaccagcctgggagcccctgccacactttcttgcctcaggaccacgttgttaagagcagcagcaatgaggcctggaggctgtgtcaccctcccctggaggcgagtcattaggacatcctggggcccacaaaccacagttccccctgcttccctcttggttggggaaagattaaagagccaagctggggcacaacctttgtgccttgtactcagggaaaagggacaggctcagaggggcataggcagatatcaggcccgttaacggtctgctgtcaccatgcatgtgtgtggcaggtgtctgcctcctctccagaccctgcaacctcctaggagtaagggtgtccatcattgctgaagtccaggcctggggaggcggacagcytgaaggctgggagcgctgcatggctgagaccccgggctgcccccaagggtctgcctccctgggcagatcctcagcaggtgcttgaccgagggccacagtttgagcgctggcagagctgctgcacgggctagataggaaattgggccccaaacccttctccagggtccattttgcgttggtctaagaggccgtcctgggcttgaccttgcgtttccaggatgatgcccacacctgctgcccttcctctctggttccctgcccacctccttccttccctgcagattccacttmctgggtccttccctcaagttcctggacccccgctggctgcaaagtggaggccaggttccaatctggcctccgactggctacgtctggtttcaccaggggtttaagacagattttctacatgtgacaacgagatgggttcacataagagcccagattcccagcttctcttgaggcctccaaagacctggtactactgggtcaccacagaaacagtgacagcccctcgacaagggaggcctatgtcaccccatactcatacctcacaggatccttaggcttctatcccctaggggctgggctcgtgaatctaagtgctccccttctttgctctcctgttccccaggccctcagagagccagcctcctggatgccccccagacacagtgggtgccatggagccagtgcctctccctcactctgctgtcctggagcctggctccctgtggtaagccaggcttgcagaggtggctcctgacatcaatccgcgggcatgtggctgctgcgggaggcacacactggctcaggacaaagggcaagggctcacggctctacccacgactcaaagagcatgccccagcccttcagatatggccccacctaggccttcatgccagtgtgcttttatagtcaccctgccaaggacccagaatgtccttccccaggtgacacaccctacctacagagaattctgccccagccatgcctgcccttgataatataccccgccagcacggcctctgcccagccatccctcccgtgtcaggcaggctccccgcagagtccctgggtgatgcctctctggccctggagccccaaggccagcccaggcctctgctctggcagaacaagtgcggcaggcgggcgtgctggcagagctcggcgtgggtagatggagctcggagggtccggaagggtccaggttccctcgccctcctccgcagcctctctgggatggcgctccgggacagggaaacagggaagcaggtggcggggaggccgaggggcagctggactcagcccgcttaggcctccagcaggcaggcaggcaggaggccactctcccggaacctccaggccgggggaagagcgcctccgagggctcaggccctactcggccccaccatcgccaagaccggccagcggggcggcgcggggggatcggcccgcaccctccgcctgcaagagcgctgggcgcacgcggagggcgggggccagcccgggaagctcggggtgcggaggacgggctggggccgcacgggagcgcagggcagcaggggccgggctgcctcaggacgcctccctccctccctccctccctcccacaggccggatgctgccgacgcgttctgggcgccgaagggagtcccaggaccgggtgtcacgccggggtcgcccaggccggcgcggggcagcaggcagcagggtgggggggtgccctcgcgcctgtgtccctcacgccgccccagctcctgcccaggtggctgtggctggcgttccgggacctctgtgaccttgggtctctgcccctctccgagaaccccacgggtccccagctcagcgtcgggacagctgcgcccgcggagtccggtccggagcacccacgggcgcggcccgggcccgaggagaacgccgcggctccagcagcaaacaagtgggggagggtgggaggggcgtcctcgcgccgcccgggcggggaaggggcgcctgcgtcggcttccggccgccttccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcgggtgcgcggcgggcgcccgcggggccgaggctgcatggcccgggggaccggggccggggcgcaggggtcggaaggcggcggcggcggcggcaggggccccggccccgggtcggggaggggcggggggcccggggccgggcggggaccgggccagggagcgcgccggccgcccctcagggcgcaagctttgtgccctgtactcagggaagaggaacaggctcagaagggcagaggcaggtatcaggctcactgcagatatcaggggcgcgggacactggcggcctcgcctccgcggcagggccgggccgggccgggctgggctgggctgggcggcgagagccgcggcccggcctggatctggggcctggatctggggccgccgcggagtcgacggcgcagggcggggcggcccggatttaaaggggccgcagcaccgccgtcgccggcgccgcgagggggtggggtgggggccggcggccgggatcccgatcggctcccgcagccccgcgtgggctcgtgcgagtcggcctcaggtaaggctggagtgggagtgcaggtcgaccgcagccggggcggggggcgggcggcgggggcggcgctccgggaccccggtacccttctcagcaacatctcctccgcgcgcggaccccgaccccattcgcacgttctcggggctctttcccgggcgtgaggggctctgggtggcgcgggggactgggcggttgaagccgggagcgaccgctgccttcgctgccgcccagggcgcttccccgctcaggagcttcctctgggcctctggacggaggcgcgcaggggcccgggaggcgggaacgatgggcctttctaggcggtatcagggccgatgctcgtggatgcagagcagtgaccagcccagaaccgtaccggcttcccggggcaggggcggcccgagmgcgccgctaacgggagcaacgggccctgcccccggtggtgtaggggccacctcgccccgcccagcccagcccgatattgatgggggcccacgccttcattgtttttttgttgttgttgttttttgttgttttttgtttgtttgtttttgagacggagtctcgctctgttgcccaggctgcagtgcagtggcgcaatctcggctcactgcaccctccgcctcccgggttcaagcgattcccctgccccagcctcccgagtagctgggactacaggcggccgccaccacacctggctaatttttgtatttttagtagacacgaggtttcaccgtattggccaggctggtctcgaactcctgaccttgtgatccgcccgcctcggcctcacaaagtgctgggattacaggcgtgagccaccacgcacggcccatttgcgttctaatttcaggcgttcctcaatcctctgtggaaccaggaagggcgcaaattataaagggactggcccagcgccgcctctgggcaggctttgggcagcgcctggcccgctgccggcttggacctcccagacctaggggcccggttcctggtggaggctgcagggacctctgccccacccgcccgggggaggcccgaggggctggactcagactgagattgaatgcggctttgtcttcctagttcagccccggcccacacctggggctgagtggaatcgggagcttcgaggggtctggacagagagattgatgccaagaagggggtggccgagccagaggttgaagtgggctggatcctgaggccccctgttaaaggagagggctccccactcagtgctcctggaactttccgaactagagactgggacttataggagccttctagaggaaactgtcgtgttttcacaggtgtcttctatttgtggcaaaggataatggcttttcacttaggttgtgacataaagggccttagaaattgttaatgagttacttaatgttaaaacttagtcacccagaggccgggcgcggtggctcatgcctgtaatcccagcactttgtgaggccgaggcaggcgaatcacgaggtcaggagatcgagaccatcctggctaacacggtgaaaccccgtctctactaaaaaatacaaaaaattagccgggtgtggtggctcatgcctgtaatcccagcactctgagaggctaaggcaggaggatcatttgagctcatcagttcaagaccagcctgggcaacatagtgacacctcatctcattaaaaattttaaaacaaatttttttggatttttttgtaattttatttatttatttatttatttttagtttatcttatttttttttttgagacggagtcttgctctgtcgcccaggctggagtgcagtggcactatctgggctcactgcaagctccgcctcccaccttcaccccattctcctgcctcagcctcccgagtagctgggactacaggcacccaccaccacgctcggctgattttttgtatttttattagagacggggtttcaccgtgttagccaggatggtctcgatctcctgacctcgtgatctacctgcctcggcctcccaaaatgctgggattacaggcgtgagtcaccaccccggcctttttttttttttttttttttaaracggagtctcggtctgtcgcccaggttggagtgcagtggcaccatctcggctcactgcaacctcagcctcccaggttcaagcgattctcctgcctcagcctcccgagtagctgggattataggcgcccgccaccacgcctggctaatttttttttttttttttttttttttttttgagacagagtctcgctatgtcgcccaggctggagtgcgatggcagaatctcggcttactgcaacttccacctcctggatacaagcaattctgctgcctcatcctcctgagtagctgggattacaggtgcacggcaccaagcccggctaatttttttgtatttttagtagagatagggtgtcaccatgttggtcaggctggtctcaaactcctgacctcgtgatccacctgcttcagcctcccaaagtgctgggattacaggcatgagccactgcgcctggcccttttttttttttttttttttttttgaaacggagtcttgctccctggcccaggctggagtgcagttgagtgatctgggctcactgcaacctccgcttcccgggttcaagcgattctcctgcctcagccacctgagtagctgagattacaggcgtgtgctaccacacccggctaatttttatatttttagtagagatggggtttcaccatgttggtcaggctggtttcgaactcctgacctcaggtgatccacctgcctcagcctcccaaagtgctgggattacaggtgtgagccaccggcggcgcccagcctaatttttgtatttttagtagagatggggtttcaccatgttgtccaggctggtctccaactcctgacctcaggtgatctgctcactttggcccctcagagtgctgggattacaggcgtgagccaacgcaccgggccaacaatttttttttaatttaaatttaaatttttattttttaattttttattttactttaagttctagggtacatgtgcacaatttgcaggtttgttacatatgtatacatgtgcccggttggtatgctgcacccattaactcatcatttacattagatatatctcctaatgctatccctcccctcttcccccaccccacgacaggccccagtgtgtgacgttccccaccctgtgtccaagtgttctcattgttcaattcccacctatgagtgagaacatgcggtgtttggttttctgtccttgtgatagtttgctcagaatggtttccagcttcatccgtgtccctacaaaggacatgaactcattcttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagtaatgggattgctgggtcaaatggcatttctagttctagatccctgaggaatcgctacactgacttccacaatggttgaactagtttacagtcccaccaacagtgtaaaagcattcctatttctccacatcctctccagcacctgttgtttcctgggtttttaatgattggcattctaactggtgtgagatgctatctcaatgtggttttgatttgcatttctctgatggccagtgatgctgagcattttttcatgtgtctgcrggccaacaatttttttaaggaaaaaaaaaaagtgactcagttgggcactgtggcctacgcctgtaatccaagtgagacagccaagtctaaaggggtcccgctttgggaggccgagacgggcggatcacgaggtcaggagaccgagrccatcttagctaacacggtgaaaccccgtctctactaaaaattagccgggagtggtggcgggcacctgtagtcccagctactcgggaggctgaggcaggagaatagcttcaacctgtgaggcggagctttcagtgagccgagatcgcaccactgcactccagcctgggcgacagagcgagactccgtctcaaaaaaaaaaagaggtccaggagaaactcccacacctgcctaagcactggaagaactgggtagagccacagaagctctgcaggggggaggagctttgcagggggaggagctatgcagggggaggagctatgcagggggaggagcatgcagggggaggagctatgcagggggaggagctatgcaggggggaggagcttggtctcatgttcggggtggaacttgggattctatctgggaggcgagaaaccagctagcgggactctctctcgctttgctgagagtccctgtttccctttttttccttcttgcccaataaattccatttttctcactcttcaaagtgtctgcgagattaatctctcatggccgctgcacaagaacctggcttttagctgaactaaggagaaagtcctacaacagtttggcgtgcaacatggggcttgagaaagggtgagtgagatgcaaaccaagaaatttttttcctctctttctaagcctatttatcttcggacttctgagggggaggggaggggaaaccgtgaccccacccccttggtctccatggccttttccttacttctggacggatgggcgaacggcggttctctgtcgcccaggctggagtgcagtggcgccatctcggctcactgcaagctccacctcccgggttcacaccattctcctgcctcagcctcctgagtagctgggactacaggcgcccgccaccacgcccggctgattttttgtatttttagtagagacggggtttcaccgtgttagccaggatggtctcgatctcctgacytcrtgatccgcccgcctyggcctcccaaagtgctgggattacaggcgtgagccaccgcgcccacccctccatgaagaaagtttttctaaatgaaaaatgtttaggacgctcaggagagaaagaacagattaaggaatgatctccaccgcacagacctcaaggctgttatgcatgcagggcacagttccagtgcaaatgtccgcaggcacggcatgagggcccccactgggtgcctcgggctccttccagggcagcagttgaagcgggtcgtactgcaggcctgcagaaaggctggggttcctctccttttcgggttccttcctgatggaatcctaggttttcagcggttccttcctgatggaatcctaggttttcagcagcttccggaggccgcctggactgcagaaggcgccctgggcgtgtgtacttccacctccgcaggcgctggcatctccaggctgcttcaggccgctttggacctcaccatcggtagcatctgcgtcttcttgaggtgactggagcccgtctatggtttcagccattgacttctggacatggaagtgtcgaggccatttttggcccctctcatatccgggaagggctccgtgcccagtagaggtgcagtgcagcagccagctcgcagcagtgctcccgtagagctgatggcattggcaggagtggcggctcagcacagggaagttctccagtgcccaggcccaggcttgctctcggtttaggtcccatggcacgtggggctctggacctgcctgcctccaagacagctcttccaaggttgagggttggaactccacagcctcagcctcccaaagcttgaccaggcccagccatagctagtctaggaaaagagcaaatggccgtgtttttatattttgacttttgcatttcaatattaatttttttggtaatgtaatgcattcaaaacatggtccccccccccccaaaaaaaaaagaaaagaaaaagaaaaaagcatgtttctaaccaggggtccttcatcttctgcagatgccaagggtgtccctggcacagtaaaagtttggaagccctgccctaaagcctcacctcacctggcagctgggtgtttcattcatagcaaatgttctgtatattcaccatgtaccaaacacacatgtcactaatgatacaaacacatgtgcactgacattgacctcctcactgtcttactatagtcccatccacagccaccttatcagagtccatgggactctgacaacttgtaatgggaaaattaaccgtgcctgtaggggccgcctgggtagcgggaggtggttcatgagtaccaggaaagctggccctggggcagacctgggcagggcagagcacagcttgcaggacctagtacacagtgttgggaattgaatttgggttttgacctttgaagctgtgcataaagtctaaaacaagaagaggagtggaggctgrggttgtatttgtattttaaaatgagcatttgccacacaaagccaggagcttcagaccagcgtggttaacacagcgagaccctcctctctgtgagaaattaaaaaaaaaacaataataaaagccaggcatgttggcatgtacctgtagtcctagctsctcagggggtgaggcgggaggatcacttgactcctgggttacagtgagctctaattrccactgcacttcagcctgggccacagagtgagaccttttctcwaaataaaataaaatataaccttttgggcaggcatggaaaggggctggagagaataagaggaaacagagataagccccctccctgggagcacaagggactcatccccagacatggcaccacaggcaaacagacactgtcacaaaactagcatattmtctttcctagaagtcctttgttttccccaagtgccctttcccccaaccttttgttggtttacgagctctcaattctaacctcctagtacacgaataaaaatgtctatcggggtggtggcgtgagcctgtagtcccaggtacttgagaggcagaggtgggaggatcctctgaccataagagttcctgaccagcctgtgcaatactgactccatctcaaacaaaaaacagaaagctatacaactccgtttctcttgctaatttgtcttttgtcagtttaatttgcaggccccagatgctgaatctaagagggcagaggaaaagcttttcctccctgacataaccatccaggagaaagtctggaatggagggtcagaggggtagggaatggagttaggagaagtagatagattcaggacagtctttggagaatgtacatcactgaggtcaagatgtcctagggaatggcccttctgggttcacaattctgcttccgtcggttaacagcaacttagtcccttctatgcctgtggggataatcagtcaggataggctggattatgctgctctaacaaccccaaatttctctgatctaataaaagtatactcaaagctgtayacccttcaagggtcccctggggtctctgctcattgtagttcctgccctggctacaggcataaccatgtggaaatcaaaggctttcttggcaaagagaaagagagctctagaagctttagcactggcaaataaataaatgcttggcgtataggtgatatatggctcttctggctcaggtccttggccagaattaatcacatggtctcacctcaagggaacaggtgagttaaatgcagaaaaatattcaagctgggtgaggtggctcacgcctctaatcccagcactttaggaggccgaggcgggaggatcgcttgagcccaagaagatcatggttgccgtgatccatgatcataccacggcactccagactggggaccaaagtgagaccttgtctctaaaaattaaaatatttagaatgtttcctagcataaaagatgtgctacgtgtgtattattactgttgctattgccagaaagtacaatcaacaggaactgctggtggcttgagggggagcatatggtcatagctgactcccaggtttctggcttgtattgtgactgtttctggcctgtattgtgaccatcactgccatcaggaaccctagagcaggtcgggtgtggtggctcacgcctgtaatcccagtactttgggaggctgaggtgggtggatcacttgaggccaagagttcaagaccagcctggccaacatggtgaaaccccgtctctactaaaaatacaaaaattagccagatatggtggtgggcgcctgtaatcccagctacttgggaggctgaggcacaagaattgcttgaatccgagaggtggaggttgcagtgagcagagatcaagccactgtaccccagcctgggcaacagagcaagactctgtctcgaaaaaaaaaaagaaaagaaaacctggagcaggcatggggtatacgtcatgggtcactactcttggatacaattgacgaaaaccacaatcaactggcttaagccgttttataacccagcattaggccagcctggatccaggggtcagatactgagatcaagctttgatctgctcaggattcccccctccccaaggctcctgcttccagatgaccccagtgtgcatttcgtccgccagcgtgggtcacatgtccatccctgaccagggtgctacagtgctctggttggccaagctttggccatggggtttacctcaccctacttttacgcaagagtatgtggtggcctaacacaggtgggggaccctgcttcaataccagcctttatccacagatgaccccacgccttctgctccagagcatcagggttataacacatgggacacacggggcacacatacactcccacgcaacatccacacaccccacaaaactacctgagcccacatagtcagggcagggacaggcacagaacaaagtgggtgcacagggactcgcagggaggtcgaagagctgagtctcgtcrggaggctgagggggaagagcgggcactgggctgcgagtgtgcagagctggaggtgggggactgcggtaagtacccgtcctggggtgcgggccctgctgggaagcattgggagcaagaagggttagatcctcaaaggaggataattcttccagaaggttttctttgttttgttttgttttgttgaggcaccaagattggagtgcagtggcgccatgtcagctcactgcaacctccgcctccgaggctcaagcaattctcttgcctcagcctcccgactagctgggactacaggcacctgccgccacgcccaactaatttttttaatttttagtacagatggggtttcactctgttggccaggctggtctcgaactcctgacctcgtgatccgcccacctcggcctcccagtgctgggactacaggtgtgagccaccgcgcctggcctcttccagaaggttttcgatggcagcaggtggaggggagcgagagggccatcgctcctgctgcaagggcagcccctccacgggatcccacactcctgacccgttcagtatagacggggtactcccggtgcggcctgtcaccgctctgtctggcgctggcgctcctagagaaggccatgccgacctctcccccacctcgctccagattccccttcttgagctgcttttcccacagtccccccaggcgccactgagagcctcccgtcttcgatgggcttggggcgcctggacccttccggggtcactttgccgtcttcctccagcccccctccctactccttgtcgccgccyccccgtcttttcaggaccttgcgcactcaggctggccctatgctttggggtaccccagcagtgcccccgggtctccggccacccngtgacggagggagggagaggctggcgagggggcggcgccttaggtcccagcgcgacccgcctctcagcccctcccgccggctacagccgcgcgggacggggcagggacctcgagaacaccggggacttgcgggccggtggccccgggcaggccacttctgacgcgggtgcgaggccttccgcgggcgtgcacggttgggccggagccgcgccgggggccgggacacgcctggggtcagcgctggcgtcgccrctcgggtggggtgggccgggttcgggtccagtctcctccccacgggcggcccgcgccccgtcttccagtgacccccacatcccttgcgccccgagctggaacttcggcaggttctgccccgggccgcgcgcgctttctggggaccagggctgtggttcctgctccgcgtcgtgcctttagacaccgccgggcgttcgtcctccatccctccccccttttccccactccgcggttgacgagggccgcccccaagtggccatgtcccccggcatggacgacccctcagtgcccctgagggcccagggtctcgcccccgtcccgaggcaggccatgtttgaatttatttggagaaattcgcccagcccaggggacctctttctgcagctctggccttccagtaggagagggtccctggggctctcaggcctgacaacttggcatcactgaattctctaaccatgtctgtccatgacttgaactccttttcttttagaaagatctttgcaaaccccttgtgggcgtgcccctcccatggcccccgtgcctcttgcctgggctttgggcttgtctgaaagggctaaaagggggtgatgcctggccgggcgggtggctcacgcctgcagtcccagcactttgggaggccgaggtgggcggatcncctgaagtcaggagttcaagaccatcctggccaacatagtgaaacccatctctactaaaaatacaaaaattagcaaggcttggtggcaggcacctgtagtcccagctacttgggaggctgaggcaggagcaggagaattgcttgaacctgggaggcagaggttgcagtgagctgagatcgtgccmctgcacttcagcctgggtgacagagagagactgtctcaaaaaaaaaaaaaaaaaaaaaaaaaaaagtgatgtccagtgcctggggatttttcctagggagtggtcaaggaaggccccgctgaggaggagacatttagggtgggaagttgccatgtagggcaggagtggaaagggttttggaccagagggagagccagggaaaagtcaccaggtagaatgagctggcatgattaggaagayggcaagggagggctgtggccctcccatgtgagtggaagggagtggctgcagcgcagaaggcctggaggcccccgcacagaccaggacctctgtagaggaactcatcccctgtgtyccctgtgattgtcaatctccctaaagatggcccagagcagtgcggcctgaatccctcagtggccttgtctctggctgccccagcacccacgcggacacttgactccacgccccaaagaaaagaagcgaacctgggaacaccactgccaaggcataggattatttgggaggggggaagggggaactgaggaggtggttacaacatgctgggcagcaacagacagaaccagaccacccctgtggctgccccggctggtctcctgggaccactgggcgcttggctcaggcctctcctgccctccccactcttccacctcagcccccctgcagtctctgtcctgccctgaccccccagcttacagccccaaaagcagctaaacaactcgcacacccacggggcatcgcctgggagggcagccsaaatccttccacttcagccccatttgaaagatgaggaaatgagaggctggtccatagtgggtctcgcggctcaggtgccgagccttccctgggcatgcacgccgggccctggagggtgggaaggggccagtggacgcggggagcctgcggggtgggactgcatcgggaaaggggaaggagtcagaggcgagaagggggagagtgtctgtntggctccagccgctgcacgctcttcctgctcaggggactcacggtgaccccggagccactccccagcccagcctccaggtaagaggtcactgagatgggtggcagcaggggccggggatccccctattacgacagcggtcatgggacgctgactcactgccggccagaccacctgacctccgcggcgggaggagagggccctgccagggggttcccgccgcgccttgtttacctccgggaggcctcggcctcgcgtgggggcagggcggccgctggggccgcaaggcgtgcggggaagggccagagccgggtgtccaccccagcttcccaaagactccctcttctgtgcttccttctcccctccccgcccccccccagtctcttcacatgcccctagcccccgcggaaacttcccgcgatcccaaacgggccaaatggcgagaaagcaaaggagctccttcttgggggtgagtggggcgccttgagcgcttcctcaaagctatgttcccagagccacaggccttccttgtgtccctcaccctgctcagaccgggccatagccgggggctggggcaggaaagccggccctcggcgggggccacgtggctctcaggcgcctgggctgctgagtcacgcttggccagcacctgtctgtaggccacagcctctgccagcacgcccctctgtgtcccctgcccctgtctgcaaggcagtggctccagcaggccctggggcattttccactctccaccgccggatgcagggagaggcctgaaccctctccacagggctgctctgggcagggtggaagccttgcccacttcggagccctccgggaaggatcattcacacctgtggaccagcccctgctgtgcgcacacccacacatcaccttcgcacctgactggccccatccagccactcttgcctccctctgggtttcctcccctgggaggtttctccagctcctgcaagccctgggctgaaatggcatgagttggacccagcaggttctgacctcctactcacaggaccttgcctgggaggctccagagggtgaccactcgtcctgcccctctccttgccccagttctggcggacaggttactctggtggcataaagcagtgtttcttccttcctagctgaggaggctgttggctgacccccttggctgcccacaaggccaacgggcctgagcccccacagggccatgggcattacctgctgaattgaggagcccataaggagtcacttggaccacagtgaacacttggcgaccactgacactcaggagaccttagctggtcctccagcacctctcaactccactcctactaaactgggaacttctctggtgctcaggccagagtcggggtccgtcaccgagtatgctatgcgctgcccatcaccgaggatgccatgcgctgtaagagggctgccaccgcggcaggctgaccatggcagggtcggaacagcaacctgagagccagcttgttctggccagcagtgcccactgggcgacctagcagcctcctgatatgggggctgtgtccccctctccctgcactgggtacccccaactgaggatattgctgagtcatggccaggcccaagcctgggaggggcgaggggctggacccccgccagtaccctgatcccaggtgcagaggctggagcccaggcctgtatgagtgccagggccggtttcctggggtccttggtgcaccggggcaatgaagagaggggtcagcaatgagggggccgggagacctggagcgaggggtagcggggaaggggagagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggtgagcgggccggggagcggcgggggcggtgacgcaggccggacacggcctcctgccgcggggtggctgccccctcccttctcggcgacgcctggcgggccgtgagggggtctgcyctggctgctccctggatggcggtggcctgcatgggtccccagttcggccatgggagccggcctggtgactggagtggtgaccaaggccgggacccgctgctcagcgtcggccccctggggcggtggagccctgccggccgggggctcgagcctgggggcgtcagacgccccgctccaccccccgcgctgttggggattttggcaaggacgcgccggggcgaacgctctggctctccgcgggcactgggtggtcaggcgggcactcgggttacactgacaccttgctgcgccaggtggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccaggtcgagtacagatgttttcccattggcaagtggacgagaacgttcttcagaagtgttggtgttggcccagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcmtcaccttataaacgccatacataccatttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtgccctcggtggatggcgtggtttggtctgcacagctgtgctttaaagccatttcagctcatatgtatctgtcacaaatggagactacatacaaatacgtgtctttcagctttgttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctcygtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaaggtaaggggctgctctgggggctgcctgaagccagctcagyttgtactcagttccctgctgagtaaaaaacagggctcgatgttccaccaatgaaggggtcagcaatttgagggctgtttaagacagagacataggccaggtgtggctcacgcctgtaattccagcactttgggaggccgaggcgggcaggtcacctgaggtcaggagtttaagaacagcctggccaacatggtgaaaccttgtcgctactaaaaatacaaaaattagccgggtgtggtggtacatgcttctagtcccagctactcaggaggctgagacgagaatcacttaaacctggagagcggaggttgccatgagccgaaatcacatgactgtactccagcctaggcgacaaaaaaaaaaaaaaaaaaaaaaaaaaaggacattttaagtgctgtgcctgacctgagaaagaggagtccatgttcactctagggatggggtctggtgccgtggtgcttgggttagggatggggtctggtgccgtggcgcttgggtgaagggcaaggccaaagctgtgcagacagggctccttgctgctgctctgctgcctgggccaaacagacacagggactgggaacctcctagcaggttcttggtggctctgctgccctcacctaagtggctgaattttgtgtggattccatgctggagagcagggccgggggccttgctggcagtgacagccccacagtgacgacagagggggaggactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggyttgcaccgggggcacaccaagctcgcattccccagccccttcgggcacctgtctgaggtgagcaggccctctgtgcaggcctggggtgggctcagggtggcaggaaccttgacccgctcactgcctgcygctctgctaattcctcccccagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcaggtgaggcttgtgttggaacctgcttctgattggtgacagtagtcaggcagcctgtgtgcagggcccttgtgcaaagcgtgtgtgcaaggcaagaattcaggataccccccaccttcctggtgccctacaatcacacaagaaccctgcaaagtggggtgtattctctccatttcccaaatggggaaactgaggtgcctaagtgcctgaggccacaaatttacctgcacagcccttcctacctcaggaggctgccctctcaaggtaccctgaggtgcaggcagggaggcccttccagcccaggggtctttgatgcactttgttctcttttgtgatggttgtcaggaagatcagagccaaagttgctgaagtcctttgaaacatagttataagtgaaagacttaccgttagctttgtagtctagatttttggattctgattttattaatgttactgtgtcctgtgaatcacctcaccctttgggacaaagatggggatgtttgcttgactttgagtaaataacatatttactcaaggaggtgatcaatattcacagtgtactgagcctgagcctctgtggggttgctgagcaccagggtcacagatgagggggagatggcacgggagagtggagatgctctctgtgcagggccagggggtgcagagtgggaggaaggagagggggatgctgagtgggtcactggacaagatgtccgggttaaaggtcacccrggaacacagggaccttggcaagraggtgacaggactgtgacaggtatccaaggcattaaagatatctttatcttatctttgtaaaaatcaaagcttctggtccatcggaggatccgagtgtgaatttcctgaagaacgttggggagagtgtggcagctgcccttagccctctgggtgagtgcacctccttgcccagtgcttccctaactcagcctgcactttatgtaactttcacctggaatactgcaaaggaatgggtaattgacatgcccttgacactggtgaggatttgttgcctcaaatcaacytttagtagtgctggaccacgggcaactcaaggttgaattccctgacaaaattctcgagctttctacatggagtgaagtmgaatcagctggcatttggttgggataatcccagtgagggagggtgaccagactgtggttgcaggtcttgcctgtcacctctgactgccctcctttggrtgaacaatagtctgcaatttcccctaagccaggccttgggatttggacttttgaggacctgggtagtagttagttgacatgctatttatcttttccttcttttagtttacaacccccaaacctttctggtgcttctgagtgctgggcctgcctcagagcggggagaaggtggaggcaggtgctctgggtgacacccggttctggtgcctcaggttgcacagtgggtctgtggggtgggtgaaggtgccacctgaccccaggcatgagctcaggctctgagacccctccctgctgggctttagaaagtgcctgttgcgtctggctaagggtctcgggtgggtgctgcagggttaggcatgcggcagtgagaatcagtgaatgaagccaacttctagttcaagatgacggtggatctgtgatggcagatggatcgctgggacacctgcatctctcgctagacgagtgagcttgtttttgtgactgcagtggcaggctgtgtccacccagcctgtccaaaggttgtgttcagtgtctgaaagaatgctgctaggaggggcgtccgaaccatgcctgctgcctcctgtggctacagggcgtgactgccatctgctccaactttgctcattccgatttttttttttttttgagatggagtcttgctctgtcacggaggctggagtgcagtggtgccatctctgctcactgcaacctccccctcctgggttcaagtgattctcctgcttcagcctcctgggtaagtgggattacaggtacccgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgayatcttggcattgcttctgaactaaacagcccaaacacgcatggcttctgtactagagtttagaggygaagtcagagaataggaaagaagaatcgctagtctgtttttttttttttttctttgagacagactttcacccttgtcgcctaggctggagtgcagtggtgtgatctcggctcactgcaacctctgccttccaggttcaagcrattctcctgcctcagcctcccaagtagctgggattataggtgcccaccayaacgcctagctattttttgtatttttagtagagacggggtttcactgtgttggccaggctgatctcgacacctgcctcggcctcccaaagtgctgggattacaggtgtgagccaccgagcycggccaagaatcagtattcttaatgctttccaaggagggtaaacagtggagcaccgaggtcatgattgagagatcggctgtgcctaaatcctgccactcactctggacgtagtaaaggtctgagagattgccggtgaatttggagatatgaacaagagtccttcactcaaagaacaaaggagacatcccgggaagtcacaaaaccaagtctaggttcaggtagagacttttaaaacagtgcagatccccagaccttaccttttttgatcctggtgagtgagtgttggtggggcctgggatttgtctgggaggctgcccaggtgcttggggtcacactgtctcaagacccacctgtgctggtgcagcatctcggaactgaactggacgccccacttggcacagacaggaataatcttgcagatgctcagatgtctttttttttctgagacggagtctcgctctgtcgcccaggctggagtgcagtggcacgatcttggctcctgggttcacgccattctcctgtctcagcctcccgagtagctgggaccacaggcgcccaccaccacgcccggctagttttttgtatttttagtagagacggggtttcaccttgttggccaggatggtctcgatatcctgacctcgtgatccacccgcctcagcctccccaagtgctgggattacaggcgtgagccactgcacccggccctcagatgtctttgagcactaaaagctaaaggcttaaagtggatagaattgctttctccgaactagggaggagcctgaagctctacaaacaaggaatatttcagtaaaatagactgagtggtttcagctgaggagagccagtggaggagcggcttagactgttgtggaagttagggctagtttctttctttatgaggaactataagctggatgactcacaggttaactgcctagaagggactgttcccagagcagggcccaarggggaacgaacgagtcaacagctgcctcccggtggcagtgtgtgtagggtaagcggcagctttcatgtgaagtgccaaggccttttggttggggggctgagaacctgctgagggagccacaactgagacccaggctgctcctggctgggaggctacaggccccgaagccacagggcccctcctggtcgtgggatctttgataaaccgacacgcagaggctttgtgaggcagcagggcacggagcatcgtctagtcttttttttaagtgaaagcacatttcttaagaaagtaaaggaatacaagaatggctactccgtagacaaagtagcctgtccagtcttacgacaaggcctgaaaatctcacgctttcatcaccaagttggagagatcctaattctataatttctctgatctgcttacaggcgagtctcattacccatttacaaagcatatgggtattgattgtactattctttcaacttttcaacttttctgtttgtttcaaccttttttttttcttatctttttttttttttttttttttgagacagacttttgctcttgttgtccaggctggagtgcaayggtgtgatcttggctcactacaacctctgcctcccgggttcaagcgattctcctgcctcagcctttcccagtagctgggattacaggcatgcaccatcacgcctggctaattttgtatttttagtagagacgaggtttctctgtgttggtcaggctggtctcgaactcccgacctcaggtgatctgcccgccttggcctcccaaaatgctgggattacaggcgtgagccactgtacccggcagcttcaaccttttcataatcacaagttgggaagaataaaggagaaaaataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctgagggaagcttcagaaatctctgtgccagaacagggcatcctggtgagaagsaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagacctcatgtttaattccaggagcacctgacccagggaagcttcagcatgggatactagagacaggccagggtgaggcaccagcctgaaactgggcatcccgaatgagcaatgggcccagcagtcagttccctggccaggcaggaggtggggagtccctgctgagggaggttgaatgcccccagagaagtgtcctacagctcctgcctgccagacccccaggcaccctgcagagggaaagttagtgatggcgctggccccacagaaggcttcctgtcaaccttagtgcttcagtgggatcagacccctgggtcaccagccatctgaggaaagcccccacacatgggagaaaaggtcttaaagggaagagaatgttaatgtcctcagtgagatacaaaagagcattgtctgcatgaaaaaggaacaggatactagaaaaaggataacaaagggaacagaataagaaagttcttaaaattaaaaaatagaaaaaaaacttcaaaagaaggcttagattctactattgtctcaaggagatattccaaaagcaaaatagagataggaggagaggaaagataaaaaaactaatgtaggaacaagtctagaagcccaatataggatgagtaggaattccagaaagaatagaaaactgaaaggaggaaatgaacatagaatgcaagatagtttcttggcaccaggcatggtggctcatgcctgtaatcccaacactttgggagaccaaggcaggcagatgacttgagctcacgagtttgagaccagccttggcaacatagggagacaccatcccccacttcccgtgtctacaaacactatgaaaattagccaggcatggagttgtgtacttatggccccagctacgtgggaggctgaggttggggatggcttgagcctggaaggcagagggtgcaacgagcctggattgtaccactgcactccatcctgggagacagaaacagaccttgtctcaaacaaaacaaaacaaaacaaaacaaaaaacaaacaaaaatgcaagatagtttcttggcaatgaggacattatcttctagattgaaagcggccctgacaatgactgagaaagaccccacagcaaagcttatcattgtcaagtgtcagaaccctgaggataaagaaagaggggcttctaaaactctaggttattgtaaatacttgggaatacaaagagcaaacaaacatgaacagctaggagacaatggaacaactgatgactccagaaatcagttaaaaaggcttttcggcctagaattcttttgtttttgaaaccgggtctcactgtcatctgggctggagagcagtggtacagttgtcttcatctcgtgggctcaagtgatccttctgcttcagcctccccagtagctgggactacaggcatgtgccactgtgcctagatatttttttttttctttttctttccccacccccgagtcagagtctcgctgtcgcccaggctggagtgcagcggcgtgatctcagctcactgcagtttccacctcctgggttcaagcaattttctgcctcagcctcccgagtagctgggattacaggcacccgccaccatgcctggctaatttttatatttttagtagagatggggtttcaccatcttggccaggctggtcttgaactcctgacctcatgatctacctgccttcgtctcccaaagtgctgggattacaggcatgagccactgtgcccagccccgtgcccagctattttaaaatttttttgtagagatggggtcttgccatgctgcccaggccgattttgaactcctgggctcaagagatttctcatgttgttctcccaaagtgttaggattacatgcatgagtcactgtgcctggtccagcctagaattctatacccagctaaaacgatcaagtatcagggcagaacaaagttactttctggtatacagtcttaattattttaaccttggtttgaaccacatgaagagagaaacccaaaatgaagcacagaggtattaggaaacgggggacctaacaggacagagggtgaacgtaaagggggtcacagcatcacagcgcagcctctgcccagagagctgccagtcctggctggaacaggaggctgcacagcaagcggcactctctatggaaaacaccagaaccagtggggtctctgatccacttcacccttgtagaaaactatggagatgctgtgggagaacatagggaaagttagcaaatgcaaagagaaggcaggctgggtgcagtggctcatgcctgtaatccaagcactttgggaggccaaggcaggcagatcacctgaggtcaggagttcaagaccagcctggccaacatggtgaaaccccgtctctactaaaaatataaaaattagctgggcatggtggcacgtgcctatagtcccagctactcgggaggctgaggcaggagaatcacttgaacctggtgggcagaggctgcagtgagccgagagattgcggcactgcgctccagcctgggcaacagagcgagactctgtctacaaaacaaaggaaaagagaagccattatcagtggtaggaaaacaaaaagcgatacaaagaaatagtctgctacttgacccagcaaagaacatttagatagaggtcctagctgaaacattgaatgttctttttttttttttgagatggagtcttgctctgtcaccaggctggagtgcagtggcgccaacttggctcactgcaacctccgcctcccaggttcaagcgattcttctgcctcrgcctcccgagtaactgagactacaggcgattgccaccacgcccagctgattttttgtatttttagtagagacggggtttcaccatattagccagggtagtctcgatctcctgatctcgtgatccgcccncctcggcctcccaaagtgctgggattacaggcgtgagccactgcgctcggcctactgaatgttcttttaacaaaaaattgcgtcttggaaagggtagtggaaggagaggcaggtactggtccagagtaggaagtgcgcagatgtgaactccagcagcaggcaagagcagcgtgagctgaaagggcacagggagagtttggggagtgggatgggggcagggagtgtgcaccacagcctttggcaactggtgactctaagctgtgggtgtggagacttttgacacatttaatttcaaaaatagtgcaggtgattctcccctctgtccctggtgagtcacgtgagcctggaggtgtgcaggttccctgtggggccagcgttgggccctacgcagcgcctgcacggcccatccacctcccagagcagagctccggcgttgaggtgtgcgtgtgtgtcgtcgcacaaagcctctgtgtgcaggtgtcaggaggcacatggccttccatcactgtggctggaagcgcctgccacatgtggtattggctctccctgtacttagggcctggccccacctgccgtgtggcccgtgtcctgcatggttaggaaaaaggtctctttygactttctggctcagaagctgactttagatgctagctgaggttaatgttttactgaattggagaaagagaaaggtccagtatcatgggcccaccaagaatgtttccagaagccacagagatttgtagctgggatatggggagaagcctctgactcatgggtttgtatcgtctggtcccatactggctgtgtgattscggggtcgagctgggtagaacctagcacctgcatccacacgctgagtgccaccatccagacacttagctgcttgtggggactgaaygttgagatcttcgtgagtctgtagtctccacaggccaagctcctgcttgcaggtgcatccttgggggaacttcacggcttnctctttcctcctccgcctctaggcattgaagttgatatcgatgtggagcacggagggaaaagaagccgcctgacccccgtctctccagasagttccagcacagaggagaagagcagctcacagccaagcagctgctgctctgancccagcaagccgggtgggaatgttgagggygccacgcagtctctggcggagcagatgagnaagatcgccttggagtcyraggggcgccctgaggcaagcctgtgcccctcccgccacctgggaccacngccagcctagtgatctgtggcctgcacctccgcctcatcctcagcacctstgcagccccacttacaaacccgagggagctgctgctgctgcagtgatgtctgtgccattaaagtcacgctgggaacctgctagaactttgtagttacttggtctttgtgagtggccactgttccccctagacccctgcagccttaastgcacgtgtgcatgcntgctccccgactgtytgccaggagccagggccanggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggmtgtctgtaggtgtgggaggttaggagttggttttgtcctattatgtgtaccctgagcaatagcgagtaagctctgctaatgcagttctgaaaatgtttttctttargcaaactccagagccaggaatattarttgtaggagtttctaaaacttaacatgcagaccaggaattaaggcaggtgtgacacagagagggggcagcactgggtgtgtccctactactcacactcaagtgccgcctcagggagtgctggtctgagrggggggggggggtcatagccaagatccctgtaggagccaggcagaagccaccgttgaagtggatggtgtggcaggcagcagtgggggggtggggggtggggacagctgacagaaactcctcattgtcacatggcagccgtgtgtaaaccaaggtccgtgtgcacaacctgctgtgggccgccgctgtgtgtcttctctgccttagggcaggggatggcgagctatggcctatgggccaagagtagttcttatttttrtttatttatttatttatttttattgatcattcttgggtgtttctcgcagagggggatttggcagggtcataggacaatagtggagggaaggtcagcagataaacawgtgaacaarggtctctggttttcctaggcagaggaccctgcggccttccgcagcgtttgtgtccctgggtacttragattagggagtggtgatgactcttaatgagaatgctgccttcaagcatctgtttaacaaagcacatcttgcaccrcccttaatccattgaaccctgagtggacacagcacatgtttcagagagcacggggttgggggtaaggtcacagatcaacaggataagaatttttcttagtacagaacaaaatgaaaagtctcccatgtctacttctttccacacagacacggcaaccatccgatttctcaatcttttccccacctttccccgctttctattccacaaagccgccattgtcatcatggcccgttctcaatgagctgttgggtacacctcccagacggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcrcggccaggcagaggygctcctcacatcccagacagggcggcggggcagaggcgctccccacatctcagacgatgggtggccgggcagagacgctcctcactttccagactgggcagccaggcagaggggctcctcacatyccagacgatgggcggccaggcagagacgctcctcacttcccagacggggtggcggccrggcagaggctgcaatctcggcactttgggaggctaaggcaggcrgctgggaggtggaggttgtagcgagccgagatcacgccactgcactccagcctgggcaccattgagcactgagtgaaccagactccgtctgcaatcccggcacctcgggaggccgaggctggcggatcactcgtggttaggagctggagaccagcccrgccaacacagcgaaaccccgtctccaccaaaaaaacacgaaaaccagtcagtcgtggcggcgcgcacctgcaatcgcaggcactcggcaggctgaggcaagagaatcaggcagggaggttgcagtgagccgagatggcagcagtacagtccagctttggctcggcatcagagggagaccgtggagaaagagggagagggaaagctatatcattcttatgtctttgcatcatcatagcttngcatctactcataagtgagaacatatgatatttggtatccattcctgaattactttacttaggataatggcctccagctccgtccaagttgctgcaaaaggtattatttcgttcctttttgtggctgagtagtattccatggtgtatatataccacattttctttatccactcattgcttgatgggcagttaggttggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacnggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggkcycttcaccactgtagttctytcatttccaaaccatcagctgcttttaaaataagatctctttgtagccatcctgttaaatttgtaaacaatctaattaaatggcatcagcactttaaccaatgaygtttgcatagagagaaatgattgacagtaagtttattgttaatggttcttacagagtatctttaaaagtgccttaggggaaccctgtccctcctaacaagtgtatctcgattaataacctrccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtycctctgaagagaccttggctgctcactrtccacatgtgaactttttctaggtggcaggacaaatngcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatntgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaaaccttctgctaaattgcatgaccaggctttccaaaaacaagacattctcatgtcatcaggtgatccatctcctggggaccttagaatcaggttaccggtgcctacaaaagaattttgagcagaagggcctcgagacatcgggaaaggggtgcgctggctccattctgctacctcccaccggggggcagctctccagagcctgccgggttctgcagctgcagaggtggcagcaccgagctccctgtgggataggactggtgctggggtctggcttctctcaccccaggaaccaaagatgctctgaaagttgggtgtcggccgggcgcagtggctcacgcctgtaatcccagcactttgggaggccaaggcaggtagatcacctgaggccaggagttcgagatcaacctggccaacatggcgaaaccctatcactactaaaaatacaaaaattaacctggcgtggtggcacgcgcctgtaatctcagctactcgggaggctgaggcaggagaatcacttgaacctgggaggcagaggttgcagtgagccgaaatcacgccattccactccagcctaggcaacagagcgaactctgtctcaaaaaaaagaaagttgggttgtaggctgggagcagtggctcatgcctgaatcccagcactttgggaggctgaggcaggcagattgcttgagcccaggagtttgacaccagtttgggcaacatggtgaaaccccctcttctacaaaaaattagccaactgtggtggtgagtgcctgtgatcccagctgctcgggaggatcacttaagcccgggagatggaggctgctatgaggtgtgattgtaccattgcactccagcctaggtgacagagtgacaccccatctcaaaaacaaaaggctgggtgcagtggctcatgcctgtaatcccagtactttgggaggccgaggcgggtggatcacttgaggtcaggagttcaagaccagcctggccaacatggggaagccctgtctctactaaaaatacaaaaattagccaggcgtggtggcgggtgcctgtaatcccagctactcaggaggctgaggcaggagaatcgcttgaacctgggaggcggaggttgcagtgagccaagatcgtgccattacactccagccaggggaacaagagtgaaactcctactcaaaaaaaaaaaaaaaaaaaacagttgggttgtgctgcttacaaagggaaaagcaatgtgaaagcagcgatagagtgggtccctgcagcactgccacccaggcagtacagaagaggctctgcggccctgaaacttgacgttggctttgccactgaacttgccatgactgcacaaaaactgcaagcctcagttcctcacctttaaaacaaagcaacaggcttgagggagcatgaaacacaatgataccattacaacatgcagcccagggactggcccgtggcagactctctggtcattcttctaggatttggagattcaaagccacttacttacccaggatcacaaaactagttggcggcaacatcaaagtttgaattctgcttcttggcatgagccagtgctctgtgcgtggtgcaaggccagcggagaccgaccttggctgatgtgggggtgggggcagtgactgacgcccagtggactcccaactgcagtgcccttgctgtgccctggctcctctgacaggcagagcaaaccctgcactctgcagcactggatatgcggtggggcctgctggactggaagcttcaagaacaagacaaatgggccaggcgcagtggcccacacctatagtcccagcactttgggaagtgggaagattgcttgagctcaggagtttgagacaagcctgggcaacatagtgagaccatgtctctaaaaaatttttttttttctgttgcccaggctggagcgcagtgatgcaatctcagctcactgcaacctatgcctctcaggttcaagcaattctcctgcctcagcctctcgagtggctgggattataggcgtgcacaaccacgcccagctaattatttttagtagagatggggtttcaccatgttggccaggctggtctcagactcctgacctcaagtgatccacccacctcggcctcccaaagtgctgagattacaggtgtgagccactgcgcctggcctctacaaaatattttttaaagattagccagtgtggtggtgtgcatctgtggtcccagctacttggcggctgaggcaggaggatcacttgagcctgggaggttgaggcttcagtaggctatgactgtgccactgcactccagcctgggtagacagagtgagaccctgtctcagaaaacaaaaaagaacaagacaacaccctaagtgaagagtgcctcacatacaagagtccacacagcagggcaaatgcgagtgtggagggaagcatctcccaggattcagggcggcccgctgacgactcctgcccggacaaaggtccccgtgctccacgcagaatgagacgatggccctgacccatcgtcaggttgacctgctggccaacctcagtttctccaagggtcacaatgctctttggtcctgagttaccctcatgggagacgagaggcatgggagggaaaagggggtacagacccgaggaaggagttggcttcagacagaaaagacaagaaacccgggtgggaagatgggctttctgcgggtaggaatcacacacttcgtcaactgtgacaaaagacagaattatcacacacacgctcagtggtcactgggaccagagagaaactgtttgtcactgaccttctggggtccccaggcgacctcagagccacccgagtcctgcacgccacggctgcacggaggctggacggtgctccngctccacttcctgtcaggacaggaccgtcagtagtcccgtgctactctccagtggcaccccgagcctgactccacgatcacatggcccacaggctcgggtggccacctgcttgttcctacggcttcccaggcagctgctcagggtgtccagccaccgcccaggccccactcccctgcttcacagcttctaggtgctagaaagttttgtttttatttcagtcagggtctcaccggcacccaggctggagtgcaatggctcactgccgccttgacctcctgggctcaggtgatcctcctgcctcagcctcccaagtagctgggaccacaggcatgcaccaccatgccccatgaatttgttttaaaaaatctgttgtacagatagggtctccctatgttgcccggactggaggatcaaatgatcctcctgcctcagcctcccaaagtgctgggattacaggtgtgagccactgtacccggatgaaggttctggtttgaaagcagaatctacctcctgaaagcacctgccctctaagagcctccctagatccttaacctaaagcagtctctccaaaaatctcactgaaatgcctgaagcagaagaaaacttccttcaagtctgaggcctctgcttctctgagctaaaagctcttaggcctgccagctactccgacctctcccctggggtcagtacagtctgagatgttcagaattaagtgggcatcataaagggtgtgcacacgggtgtcctgcccagccttcgcctctgcaccagcagtgcccaatgcccaggtgggctgtggggccagcagtggcagcagctgcccgatttcccacctgctggcacttgccacctaggcttcccgcgcttggctgacgctcacagtggctcactggtgccccactgctggaggcagcagaggccctgggccagggctggaacggagacgcacttggtacctttttctaggcaggtcttgactgaagcgggggcctggctcctccattttggatgaaggctgtttgctgaaacacactcctgttccttccagctccagttcttgggagtccttttctagatacttcagccagcgactctctgagggctgcgatttttcctgccagattgagaaaaaagttgattctcagtactggaaaccaggcagttttatcgaaaacccctagcccaactcttgggcctgaggatctcaggagtcatgtccagctccactctaggaaaggcaccggctggaaggtgatggacgccaatactatgcaatgctggcaggacagtgctcactggcacaggcctcgggaaggcggcagggcacggcccaccaagagactcatgaaagtctatgctccctggcccagtgattccacacagagaaggcagaggtgccagtcccagtcttataaaaaatagcaaatttcatttataagaacagaagtagccgggcgcggtggctcacacctgtaatcccagcaccttgggaggccgaggctggcggatcacaaggtcaggagatcgagaccaccctggccaatacggtgaaaccccgtctctactaaaaaaacaacaacaacaaaaaaaaaacaaaaaattagctgggcgtgatggcaggcacctgtagtcccagctactcaggaggctgaggcaggagaatggtgtgaacccgggaggcggggcctgcagtgagccgagatggtgccattacactccagcctggggggcagagcgagactccgtctcaaaaaaaaaaaaaaaaaaaaaaaaagaacagaggggtggaaacatggccaggcgcggtggctcacacctgtaaccctagcaccgtgggaggctgaggcgggcgggtcacctgagctcaggagttcaagactagcctaggcaacatggtgaaaccccgtctctactaaaaatacaaaaattagccgggcgtggtggtgcgtgcctgtaatcccagcttcttgggaggctgaggcaggagaattgcttgaactcaggaggcagaagttgcagtgagctgagatcacgccactgcactccggctgggggacacagcgagactctgtcgaaaggaggaaagaaggaaggaaggaaggaagggagggagggagggagggaggcaggcaagcaggcaagcagaagtgtggaaacaacctaaatgccacataataaggaatcaatactggtgcatctactacattctgtaaatacttttgttttttgagacgttggggctccagtgagcagcgatcatgcctccacactccagcctgggtgacagagagggaccctgtctcaaaaattaataaataagaaatgaaaatcactgaaaactataccgcagcacagaagaatgatacaactcaaaactaggatgcaaaaaagtatttctgatgagaatgatataaaattaagtctgtaaatggactgaattggaagcacaggcacaggtaccagaagagcatcttcctctgcttataacaaagtgtgagtctggccaggtgcagtggttcatgcctgtaatcccagtactttgggagctgaggtgggaagatggyctgagcccaggagtttgagaccagcctagacaacacagggagaccctgcctctacaaaaaagaaaaaaaattagctgggcgtggtagggcacacttgtagtcccagttactcaggagcctgaggtgggaggatcacttcagcccaggaagtcaaggctgcagagaaccatgatcgcgccactgcattccagcctgggcgacagagtgagacctcgtttcagagaaaaaaaacaaaacaaaacaaaacaacagcttgcagtctggaacaaggaaagatggaaacccaggtgtttcaccccattattctttccctctcagaggtatgcccagagtgctgtgggagcaaagtggaagcagtataaggtgatatttgagctacattcaggagttctccaagcagacagaggagagagtcctttgcagggtattgtaatgcttggtacacatggctgcctccatccttacaaaaggtacaggtttatttatttttgtgttccctgcagctttaagccaactgcctgtcattgggtggcatcaacacacatttgctataatg

SEQ ID NO: 10558 - DNA, 13535 bp, Homo sapiens
  misc_feature (1)...(13535): n = A,T,C or G, or insertion/deletion polymorphism (see Tables 1-2)
acagaaaaatgagctgggaaatagaacagtcacatctggccaagagagttgtggacttttgaggtgttgcctgggtctcctgggcagtagaatcagctgacccaatgtttaatagagaaactacaaattttcaaacataagaaaaccatgtaaaaaaaaaaaatcaatgggggagggggtgtttaaatgcatttgagaccagccatatgacagcgatttggaagcccttataacccttagttttaataacataagaattccctatgaaattctaaataaggctgggcatggtggttcatgcttgtaattccagcgcttaaggaggctgagttgaggtgggcagatctcctgaggttaggagtttgagatcagcctggccaacacggtgaaaccccatctctgctaaaaatacaaaaattagctgggcatggtggtgcgcacacgtaatcccagctacttgggaggctgaggcaggagaatggcttgaacccaggaggtgggggttgcagacagctaagatcgtgccactgcacgccagcctcggtgacaaggcaagactctatctccaaaaataataattctaaataaagcaaaataaaatgtatgcataaacatatatatgcaaaggtatatgtatatgcacatacatgcatacatgtgtatagatatatgtacagtatagcctgccagctatgttaaaagaagttttttgcaaagccaccttttgtgtatggaactgtgtgtgaaaaaagacttatagaactgtgagaaacttggataaaatgaggcatgcgtacttccccatctgaaatagccaagatgatgaccattcttataagtgaaagagttttttttttttgtttggggaagtgtttttttttttctttttatctttcattcctgttcaaattcttttttaatttacacataagaaaaagtggtctggcacagtggctcacatctgtaatcctagcactttgggagactgagagggaggactgcttgagaccaggaattcgagaccaacctgggcaatatattgagaccctgtctctatttaaaattgttttaatttaaaaaaatttacaataaataaataaaaataagaaaaamctcccaaatcccaccactctagtacaaccaaagtggccacaccatcacacgtgaggttgttcacagcatccttctctggggatgattctaagtcccttgaagatagggagcgtgactagtttgtctctgaatccctggtacctggaagtggcctgacccccagaaggcactccgatgacgtctgttgaatggatagatgagaatgcacataagaaaaagtgatttttttcctaacaaagtaaaatggcattccacggactttggggaagttggctccttcacttctagagaaaaaaggagaataaggcaggaattcaaaatactcttatgaacagaaaggcaacaggtagagcaggacatggagggattcatgaagggagagaaggaaggcagggaagctgggctgtgcaataagcagcaagcctgggtgttatttcagcctcccgagaacatgccagaatagacattgccattacctccattttcagaggaagaaactaagacaaatgaatcagacagaagacatgatgttcatctcataaatggacatgtggagatttgaacccagctcagctggctttgaattcagaaatctttacccctaagggacatcatgaagcaagacaaagaatgaaatggagggctaggatgatgactggatttcctgctgattgaaggaatgttgaaccaagcacatgtacttcaatcctaaccatacacagggaagttctttctgtatttggaagagctaagcggaagatctcagcactagtcccagcccctgtgtccatgccatttcagcactagataacaagatatatccatgtaggaagatggatgaggaaagcagggtggatctgtctcccccaaaggaaaccacaaggcataaacagcagcagtccccagaggacaatgtacacacaacctctttcctccaactctggtgttgaaactgccctgagctgactttaaatccactgcaggtagttgcatgaggagtacttacaggatcctgctggctctgttgctactctctatcatggagtcctgcagcctttgaataaatacctgccaggccaagctagcaaatagcacagtttcatgtctggaatttgcagaccagggctgaaggaagttagacaygcttctgtgaagaaaactgatattctgctgggrtttgcaagatccctaaaggtcccgtcctccccctgggaatcccagcagtttagaagattcctgaaagggaaaggagcagctcacctgagacaagcaagggccagattgttgaagccatcgttgccctgctgagcttcaggacactcaactcacagttgcagatttcataagcaacaaaaagaagaatccatttcacaggcatttttcagtgcctgtctgaccacactgatcaaggcagtgagggtacagaggtgcacaaaacgtgcaaagtgcctgctacagtgatgcttaccctctggtggggagagctgaagttctgggaaagtacagtttgagggaatgcctcatatgcaaaaggccaaccctgggctagatcctactcatgtatgtctcatccagttcctcccaataatcccaagattaggtactccttgcatcaaatcattttaaagaagagaaaattgagtgtattagtccattttcatgctgctgataaagacataactgaaactgggaagaaaaagaggtttaatggacttacagttccacatggctgggaaggcctcacaatcatggtggaaagcaagaaggtgcaagtcaagtcttacatggatggcagcaggcaaagacagagagcttgtgcaggagaattcctctttttgaaaccattggatctcatgagaccttattcactattgtgagaacagcataagaaagatccacccccatgattcagttacctcccactgggtccctcccacaacatgtgggaattgtgggagttaaaattcaagatgagatttgagtggggacacagccaaaccatatcattgggtctcagagaagtaattgcctcaagaatcacacagctgacaggtaacagagccagaactcaaaccccaggcctcctgatcacagctgccatgttgcacaaccctcatctcagaaggaatcagaatttgtgttcacggttacacgtgttcagggtcacacacttagtgtacgatgtagccggggttaaagctgagatgagccaactctagaccctagtctcttaaccactatagatactgctgtgctagcatacttggaaaccaccatatatgttcttggaaattcaccaagcacattaccatgttaggcagacttattactattctgcaatatctgcaagtaacatagaagcaaaaaaagcacataacacataaaataattacacatagacctgaggtagaaaacaaataatcagaggagaaggcaagagaaaggtgaagccaccttaggtagaatggtcaggaaacatcctttctgagaaaacatttaggctgagaagctaattaagaaataacagagaaaactaatgaaacccaaagctgattctctttaaaaaaaaaaaaaaaaacaaaattgataaacctaggtagactgatcaagaagaaaagagactatcagaaataaagtctggtgcattactacagactttcagatattaaaaggattaaaaaacccttatgcctataaatttgacaacctagatgaaatggacaaattcctggaaagatacaaattaccaaagctttttcaaaaagaaatagaaaccttcaccaaccctgtatcaattaaagaaattgaacccatagtttaaaaccctcccacaaagtaaacttcaggcccagatgtcttctctgctgcactctataaaacatttaaggaaaaaaaaaaaagagtcctacacaaattatttcagaaactagtgttcagaaggcaatacttcccaattcatgttatgaggatagtattaccctgattccaaaaccagaggaagccattataaggaaactctagaccaaccttcctcgcaaacatacatgcaaaagtgccccacaaaatatgagcagatcaaatagaaaaatgtaacaaaaggcaatgcattataaccaagtacgttcacaccatgaaggtaggctgaaatccaaagaacaagaaataatcagattacaaaaaaaaaaaaaataggaagaatgaataagacctaccatttaataaatagcacaacagggtgactatagtcaataattgaacatttttaaataacaaaaaatatataattggatcgtttgtaacacaaaggataaatgctcaaggggatggagacctcattttccatgatgtgattatttcacattgcatgcctgtattaaaacatctcatgtaccccataaatatatacacctactatgtacccacaaaaaaaataaatttttttttaattttattattattatactttaagttttagggtacatgtgcacaatgtgcaggttagttacatatgtatacatgtgccatgctggtgtgctgcatccattaactcgtcatctagcattagctatatctcctaatgctatccctcccccatccccccaccccacaacagtccccagagtgtgatgttccccttcctgtgtccatgtgttctcattgttattaaataaaaagaattttaaataaaaacagaaataacctgtcaagtgaagaacaacaagaaagttctgggcaaagggagtggcacacgcagaggctacagggtaagaaagagcttggcaaatttgaaaagttgaatggaaaccatttggaatagcatttaacgagttaggggaacgtggtaatggatgagactggagaatagacaaggctagatcacacaggacctcatcaaggtaaatagtttggattttttaataaattctaatggacgctattacatggtttttacctggggaatgtcgtggaactgtttgttttaataaagatttcttaacagaatatggagaagcaagtggcaagggggcaaagtggaagagagataccaatgaggaagctattggagtgatccaggggagtgatggcgccagccaggactggggggtgcatgggcaagggagaaaagtgggtaagtcaagggatatttcaaagataaaaccaacaggatttgctgacagactgcaagtatgagataaggagaaatcttgtagcaggttctggataagtgatcataaatcctactccgttttcctcctgggaatatttagtccataaaaaacttcccaggctccactcctttcacagctcaacacagatgatgtcagtggccttagaagccatatgttgaaggtggcagaaccaaaagatgaaaggagctgagcccctgaatcgtcacttgtcagagggccgccctctgaatacaaacatccacatttgacttcagacgagtaagaagtacatctgtggtggattcagtttctgctattcagggatgtatgtgttaaactaacttttcttaacctaattacttcagacaaaaatcaagaaaaagctagtatatcagctcgaccaattaagtggagctaagaatactcttacttcagctcttaaaagaactgattgaaatgagacagtttggaggctttcaagggatttgttcaattccatttctaaaaggaatctatactgagaaaataacagtaaatataaaggtttatgcacagagatgtttatcagtggcatttatattagcaaaagtttccatgaaaatgaccaaggcacccaacactaagtggttaaataaccaccactatgggcattaaaaattatgcttacagttcccaggcccacagcgtcagcagcagcggcagcagcggcaggcggccgcgcgggtgtttgtcgcttcgcggggccttgcggcagcatggcgnaccatctgatcagtggcggcaccggctacgtgccccaggactggctcaccgtgcagcagctcttcctcggcgccaactgccgcacccacaacaacttcctgattctcccatggttcatagatttcatagctgatgaggtagacctaacttcagccctgacccggaagatcatgctgaagacaccactgatctcttcccctatggacactgagacagaggccgacatggccatcgcratggctctgatgggaggtattggtttcattcaccacaactgcaccccagagttccaggccaacgaggtgcataaggtcaagaagtttgaacagggcttcatcacggaccccgtggtgctgagcccctcacacactgtgggtgatgtgctggaggccaagatccggcatggcttctcttgcatcctcatcactgagatgggcaccatgggsagcaagttggtgggcatcatctcctcccgagacatcaactttcttgctgagaaggaccacaccaccctcctcagtgaggtgatgacgccaaggatcaagctgatggtggctccagcaggcatgacattgaaasaggcaaatgagatccttcagcctagcargggaagctgcctytggtcaatgatcgccatgagctagtggccatcgtctcccacaccaacctgaagaagaatcgagactacattctggcctycaaggattcccacaagcagctgctgtgcagggcagctgtgggcacccatgaggatgamaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgaytgacactggtgtggatggactgcatgtagttatgggctrcagctctatctgcatcacccaggaagtgatggcctgcggtcagccccagggcactgctgtgtacaaggtggccaagtacgctcagcactttggtgtgtccatcatagccgatgtggcatccagaccgtggggcacgtggtcaaggccctggcccttggagcctccacagtgatgatgggctccctgctggccaccaccacggaggcccagcrgcgagtacttcttctcagacagggtgcagctcaagaagtactggggcatgggctcgctagatgccatggagaagagcagcagcagccagaaacgatacttcagcgagggggaaaaggtgaatattgtgcagggtgtctcggcctccatccaggacaaagggtccattcagaagtttgtgccctacctcatagcgagtaaccagcatggctccatgatgtactcagragagctcaaatttgagaagtggaccatgtcagcccagatcgagggtggcgtccatggcctgcacgcttaccagaagcagctgtactgaggatagcagtggaggatgaggtggtggagggagcataccccagtgtccaccttcgggcacaacctctctccataactgagtggtccacagatttgcactacgggttccccagctcctttccagggagagaggaggagaggtcctgagggctctgcagcccctcgctgagcatcccctacagagtcgggcctgctccctgggccaggctgcctgggggcgccccccagcccagccagccaggctctcaggccctgcgcctgcctcaggtctttcttgctgcagcatgctccagcatggcccccaccccagggacaggaggccccacctggcttctcctgtagggtacctccctgcccccagcccccccaggaaatggtgctttcctggctctgcctctggctcttcccgggccgctgccccctcagccatgtggcacttctgagctcctgacctaggccaaggggaggtctctgcccccttccccggtcctgggctacccttgggtcctggctccttaggccattcccctgtccctggccccggggaggaggctgccctgctcatggccgcctgcccatcattcgtgactcaccaccgtccccatataccattcctgccctctcctcagctgcagttgaaggctttaactttgcacattttgggatcacagttacatcactgtgtattaaataatcagaataaataaaaattatgcttacagagattttgatagtaagtgaaacatgcagcttatacactactgcatgtataaattgtgtgcaattacaaataggtatggatatatttatatcttatgtacttgtataaatacagatacatacatacacatgcacatcaatgcacacatatatatgcagaaggaaataaatgggaaaatgccattattgtttaatatgtgtgacagcgttattgagttgaaaataaaatacactcagcattatttttaacaaatttaaaagactatttcatgaccttgaggagtagagtcttgaagggcatcttaagatttttaaccttagttgggcatggtggctcacacatgtaatcccagctactcagaaggctagggcagagttcaagaccaacctggataacaaagaccctcgttcttaaaaaaaaaagaaaaaaaaagatttaattagccatgcatggtggtgtgtgcctgtagtgccagctactctggaggctgaggcaagaaaaattgcctgagcctgagttcaacgctgcagtgagctatgatcatgccactgcactccagcctgggcaacagagcaagaccctgcctctaaagacacaaaaatagaaaataaattttaaaaaacaaatccttcataaaaccacacagtgagactgtgctctgcagcaatgccaatgctaaacactcttagaaaagccccacaggggagcctgcttggaaactcaagagagagttgaagaggttttgatccacccaagagattatgtgcgggtaaagccaaaaggaccccagactcgaagatgccagcctgggtgaaatgaaccaaatcaagcaaagcaggcagatgctgtaggccagtcgcccacagaagaatcataacctttcaaagcagattgtgtaaacacaggagagggaggaggaagatgtatcttctgtgtccccagaaacccgcaggcaccggtcccagcgatcccaggaagtgaatagctagtttgttttgggtagctaagaacactgcccactcaaccaaaataagagtgacttcttcaaaaggttatgaacccactgatttctgacagtatttcccaagaaggcaaacagagcccaaagcctgtgcttaaaaagctagtgatctaataaccaaagaatcacaaattaaagtgtcctatatgagccaaataggaacactggcaaaatagagaatttatgcttcatttaatggggcaaagtcacgcccccgatgtgccaggtctgcatgctgttttaaaaattttttgtttagatattttctatgtaaaactaaggttatttcacttaaaattccaattttcagtttcttcctgaaaacatggaagaactgtcaacactggacccacgtccccacatggcattaatccatcaactggcctctttcacttgtttaaaattattctctggttcatttaattttttgagtttgcagcccttgctgtgcatgttccttccctgcttaaaatgtgctgctttcaatgctctgttgcaattgtgtataaagtaaaagtaaactagcctggagagacagtcttaagacggctctcctttgtgtagaatacatggactttgttgaccactcttttgcatgatctaagtttttttttttcagcttactttgtaatttccttatggtttcaaaatgctggagaactggtctccaattagtgaagtatttctgggggccttctttaaagttacttgctataccatcaacatagtatttgtatgttttcatttgtaggtagtaggagagatgcttaaacaggaagagacagaagctctccttgttgaccccactcctctcttgtcttagatgccagaaacctatctggaggaggataagcagagcatccatccatgtgcacaccctggggcctgcgcccccccataaatcattatctgaaccaacaggacaggctgctgggacacccactctacttatcagagcccagcagttgtgcccaaggcaacagcacctgaattttataattctgcaggtgaaatttagtgcaaaccagatattcctgagacccaacttggcttccgcaactgtattctcaagctgaaaacattttgtgtgaatggggtatgggggcgtggggacactgtttctcagaagccttcattatttcatttctcaagcaaatactggggatggaaatatggagcataattactcaggactttttttttgttttaagaatgaccagaaatagaaccatgaacacttttggtgggaatgtaaattagttcaaccattgtggaagacagtgtagtgattcttctaagatctagaaccagaaataccatttgacccagcaatcccgttacagggtatatacttaaaggaatataaaccattccgtcataaagatacatgcacacgtatgtttattttagcactatccacaatagcaaagacatggaattaacccaaatgcccatcaatgatagactggataaagaaaatgtggtacatacatattatggaatactatccagccataaaaaggaatgagatcacgtcctttgcagggacatggatgaagctggaagccatcatcctcaacaaaccaacacaggaacagaaaaccaaaaaccacatgttctcactcataagtgagagctgaacaatgagaacacatggacacagggaggggaacacacaccagagtctgttggtggtggggaagggagagcatcaggataaatagctaatgcatatggggcttaatacctaggtgataggttgagaggtgcagcaatccattatggcaaatgtctacctaggtaacaaacctatgttctgtacatgtatcccagaacttaaaattaaatagaaatttttaaaaaggaaatagaaccatggaagcttaagcaaaatgaagcaaaggggaattacttcagttaagttttactttagagcagatgctaaagcaagaaactggggggacatggtttagttgggaggtgatcacaggaagtgtggtgaggaagtagaaaaataagacaggaaaggaaaagaagccagcagcagggaaattcatgggaaggttacttctggggataacagggatttaaccccacaagggccctccaataacagtgtaggacacacctcattactgtctccctgagcagcaaagaagccagggtatgccaacttctatccctcatcattaaagacagttctggggggcatttatttatcccctgccacttcaggtctgccatatgcaggagccaaacacaatcgtatggccagagaacattcttaggcagagagatgcctgtgcttgaggtgagaagccatcactgtgttgggaactgtccatctaagcttcaggtgaccctcagggtgggccaagaggatatgagtggggcatcaacaacatagctacagggaatattctagctcaagtgactgaaaaaaaaaaaaaaagtagctaagcttactccatgcacaggtgaattcaggacccaaaatctgtcatctggatttcgtgttcctccttcttgctgttctgctgccacacagttggctctagttgttggctccaattgttggctccaagtggaagcaagatggtagcagtgattttattccctacatcttttcaggttcacttttaatagaaaataccaagtcttttcccccaggagctcttatctttagagacgcatattgaaaagtatagagatgaaatgataggatgttgggaatttgctccaaaataatctactgtgggtggcaataaaatgaattaagattgtccatgagttgataaatgctgaagctggatggtgagtataggagagttatctctgcttatgattagagttacctctattttcatgcattttggaaaatcatcataataaaaagttaattttgaaaaaagaatctcttttactcaagtttgaggtaaagtctcatttcacctcactgggtcttcctggaccagataaccatccccgaactgttcacagggaccaggagcatataatgaccacattgttccagcactgaaccatatgctccatctctgcaccaggaggaatctctacaaaaagctcaggggctacagctggggagagggcttaacagagattgattacatacaattaccagaagaatggaaatgagtgttaagataaaaaatacacaggttcattccataatgacaatagaaatatagtggacatagaatatctttcctcatcaagcatccattctagttttttactgaagaattgtccctgcttgcccctttatccctgtggactgggcaccccttgtgctaatggtgcacaagtgacttggtctgaacaatgagagggagaccctggtgatgggtgcagagatgagcacatggcactggaccagccaatgataatcttggggcattctctggagcccctcttccttctgaggtggccaagttgaaggatgaacatctgttgtggctggtgttatctttgccatcacttaaggagaatctgccaaagactgagtctgacagaggaaagcggagcccaggtacaggaagacgttctcgaagacattgttatatatctgtattcagccgtgctggaagccagataccctgaactttttagttacctgatcaaataaatgttcctgtttggcttcaggttctcatttagactcctgtcacttatatctctggctaataaagggaactatggtcacccccaccccaccccacgcagcaattgtagtttttcccgccccgatacttgcgacatcaatgtactgctgtgggtacagctctacaagcacctgttttgcaattttcaggttaacaagtaaaatcttccttgagtgtatacctctaagcctgtgaacaatatttctcatccattcatcccctctgaaaatattttacatgcccaatcctctggtaggtaattaggatatagaaattgggcacaatctatgtcttccagtcctggtatggcggagaagaaaagattcaagtagcagacagactgctgtatctaaaaacttgggttcttttcccagctccatcttaaactgtgcagaaagagaattctgctaaactctccccactgctgaataaagtgtcctatgtgaacaggatcctgatggtaaattttcataaccagagactgtcacagaattttagccaagatgagccattcaatattgatttattctacttgatcggaaatcatcagtagtccaattgtcctttctaat

SEQ ID NO: 10559 - DNA, 15324 bp, Homo sapiens
gttttttgagtcaagatcccactctgtggtctgggctggagtccagtgatgcgatcacagctcactacagacttgaatccataagcccaagggatcttcccatctcagcctccccaatacctgggaatacaagtgcccaccaccgtgcccagctaagtttacttatttttatatcttttagagacgaggttctcacaatgttgttcaagctggtctccaactcctgatctcaagcaatcctcttgccttagcgtcctgaattgctgggattacaggggtgagctgtcatgcccagcttgtaatgtactgacaccttcaagatttccttctccaagtgtggacacagcagcagacgccccttgtctcttgggtcaggacactgggtagagtggaagagcaagacaacaaagtcactgcagaaagcatccatgtggaagaggtccagcagggagggccagctgtcccagggacaccatatttagggataactcctctttctgggcaggactgttctttgattacttttatattcacgatagttctgaaatcgtaggatgatgatactcaagactggctaggatttgttttcaaaaaaccatctccgagacttgtcgatcttttgaatggtttttagtgtcacaatttccttcagaacttaactcattcttaacatttcacagactactttcagttaataatgtactagtgcccataaatatagaaatattgcaaccatttatcctctataaaatgtccatcttttatggtatagatattatatgtaatatatctatataggttgtaagtcccacgataaaaaactttttcttatctttaaacagttctatgtatataaagtaagaataaatgaggggagcaagatagccttttgcacttagctcaatatttaccatttttgatcatcttcatcttttttgataatctcattttccacctggtatcatttgcctctagtctgaagaattttctttaccaattgtaattgtacagatctgctggtgacaaattcttttaattttcttttacctgaaatatctcatttgcctatccttgaaggacatctatgctggatatagaattcttagttgatctttttgtcttccagcactttaaagatgttattctactttcttttgtttctatggtttctaataaaaagtcattgatcaggacaagaggaacagagaaacaaaaaccgggaaaataacatggtagacgtgaaacttatcatatcaataatgacaaaaacctatatgaatcaacactccaatgaagggcagagattgtgtgacttggtttaaaaaaacacggaacccaaccatacgctctttccagacatgcactttctttgttttttttttttaatttaacttttatttttagttaaggggtacatgtgcaggtttgttatataggtaaacttgtgtcatggggttttgtttcacaaattatttctatacccattagtacccacccaagtattaagtcttagttcccattagctatttttcctgatcctctccctcctcccaccctccaccctcaagtggaccccagtgtgtgttgttcccctctgcatgtccatgtgttctcatcatttagctcccacttataagtgagaacatgtggtatatagttttctgttcctgcattagtttgctaagaataatggcctccagctccatccatgttcctgcaaaggacgtaatctcattcttttttatggctgtatagtattctatggtgtatatgtgccacattttctttatccagtctaccattgatgggcatttaggttgattccaagtctttgctatggtgaatagtgcttcaatgaacatatgtgtacatgtaagtcacgcactttctctttttatttaatttattttattttgctttaagttccagatacatgtgcagaacgtgcaggtttgttacatacgtatagtctgccatagtggtttgctgcacctattcacccatcctctaagttccctcctcttacccccgactccccaaaaggccctggtgtgtgttgttcccctccctgtgtccatgtgttctcattgttcacctcccacttaagagtgaggacacgtggtgttaggttttctgttcccatgttagtttgctgacgatgacttccagcttcatccatgtccctgcaaaggacatgaactcattcctttttatggctgtgtagtattccatggtgtatatctaccacattttctttacccagactatcattgatgggcatgtgggttggttccatgtctttgctattgaaaatagtgctgcaataaacatacctgtgcatgtgtctttatagtagaatgattgatattcctttgggtatatacccagtaaagggattgctgggtcaaatagtatttctggttctacatctttgaggaatggtcacaccatcctccgtaatggttgaactattttacattcccaccaacagtgaaaaagcattcctatttctccacagcctcaccagcatctattgtttcctcactttttaataatcgccattctggctcgcaggagatagtacatcattgtggttttgatttgcttttctctaatgatcattgatattgagcttttttttcatatgttttttcttctgagaagtgtctgttcataccctttgccaatttttgatagggctgttttttttcttgtaaatttgtttaagttccttgtaaacatacatgtgagctctcatcattcttgtttaaacacctaagaggcatccaaatcagtgcaacatggcaagaaaatgaaataagaaaccaatagaaggaccaggcatggtggctcatgcctgtaatccctgcattttgggaggctgaggtggaaggatcacttgagttcaggagtttgagaccagcctgatagtgagacctcatctctaccaaataaaaataattttaaaagaaaaaagatcaatagataggaaaggaagaaacaaaagtctttgtcaccaacttcattgcatatgtagaaaacactagggaattctgaaaaagtctctggaattaatcattgaatttgcaaaatagttcataaaatatatgtaataagtcacttagatgaacatgaaaagacagcaaacaatactagtcatcaaagaagtgcaagttaaaaccacaatgagaaaccatcacacatcacctagaatagataaagttaaaaagacattggataagtctaaatactgtcaagaatatggaaaaaataggaatgtctgatattgctggtaggaatgcaaaaaatgtggcagccaatttgtaaagtggtatggcagtttcttatacagttacccatctattaccacatggcccagcaattccacaaatatgtatttatccaaaagaaataaaaatgtaaggccacacttgtaagcagttatttatagtggcttcattaataacaagccctaactggaggaatccacatgtctatcaactggaggcagagaaaccaatgaataagctgggattccagcaatactcagcagctgctcagcaacaaaaatgagtgaatggcatcatctcaaacatcgttatgctaaaggagagaccaaacgaaggactacataacatacgactgcacgtccattacattctagaaatttcagtattgcagtgacagaaaacagagtggtggttgagtgaagggaaggggtgagggtgggaggcaaggattaaatagaaaggggcagaaagaaagtttttagggaaaagaaacggttctctacagcgccacaactcagaggtaactgggtggtgggaactaaggggagaggagggtgtgagggaagaggacagagagaagggctggggaagcaggaggtgaggacaaggagcaggagaaaggactctaaagcagtggaggagcctagcaggggattctttgcattctgggtttctctactgggcagtgtggtagttacatgactataaataattaccaatattcgccaaaaaagcgcagctaaaactggtgaattttattacatataaatgccctaataagcaaaaataaataaataaataaaagggggggaggggaggcaaaaataaagacatttttagataatcaaagccataaaattaatttcctaggggtcctgtactacatttaatttaaaaggaagtgcttcagggtgaaggaaaatgatactagatggtgacccagatatacagaaaggaacaattaacaacagaaatgatgcacatacacatgtcacattcacactcattttcttaatttcctgaagacatatggctacttgtttaaaacaaaaagtattacactgtatcattgagcttataatataggttgatgtaatatatacaacaataatagcacaatggtaggttacaagaaactacactgttagaagtgtcctttattttctggatgcagcttaatataacctgaacttcactgtgaaaagtcaaggaatcgggtttccattctttgctattgtgtaaagaaatatagccaaaagccactaggagaattaaaaccataaactaaaaaatgtttatttgacacataagaaagtagtaaaggaggaacagaaacaaaaagatatgagacaaattgaaaacatatagcaaaatggtagaccaaaacccaaccattgcaagtgaagaaatgacatgacctgagtcacattagcaggactgctgagcactgtggggagaacagatatgggcaggaggtgagggacagtgttagtgccacaattcaggagtgaaagggtggcggggactaaggggagcgggggtgtgagggatgagaggggcagacagaagggctggagaggcaggaggtgaggaaaaggagcaggagaaagaattctaaagcagtggaagagcctggcagagggttctttgcattcggtatttaatacattttgttggacttcctaaaaactaattggctccttatgattaaaaaaaaaagagttacaaaaataccaagtgttcagataaaatacgcacactgcttggatgtgcagagttcaggaaaacaggcagtgcttcagcgtcggtgaagagcattgggactgcatggagcactcgcaactttgaggtgatgactacaggctcccggttgcaatagacagtaacaaaccctgcttctttatattcaggagatgttctggactcacacagggaaactcagggtggggaatgaagataattttaaatgcaacaacccagagttacagatccacagtctgggaaagtaaaacttaggagctttgagagtttaattgtaatgctgttttgacacaggtcttttgcaaattggaattctaatcattcagggattaccaatattgtgctacctactgtattaacaaacaaaaaggaaactggtctctatgagaatctctgtgtggtggcttcagagaaaacttcgccaggtttagagagaaaacccctgtctctacacctccattcccagggcgagctcactctctggcatcaagttccccgtgatcagtttccctacacaagatccaagaggagaggtaaggagtgagaggcagggagtccagttcagggacagggattccaggaggagaagtgaaggggaaggggctgggcgcagcctgggggtctctccctggtttccacagacagatccttgtccaggactcaggcagacagtgtgacaaagaggcttggtgtaggagaagagggatcaggacgaagtcccaggtcccggacggggctctcagggtctcaggctccgagggccgcgtctgcaatggggaggcgcagcgttggggattccccactcccacgagtttcacttcttctcccaacctatgtcgggtccttcttccaggatactcgtgacgcgtccccatttcccactcccattgggtgtcgggtgtctagagaagccaatcagtgtcgccggggtcccagttctaaagtccccacgcacccacccggactcagaatctcctcagacgccgagatgckggtcayggmrccccgaaccgtcctcctgctgctctsggsrgcmstggccctgaccgagacctgggcbggtgagtgcggggtcgggagggaaatggcctctgtggggaggagcgaggggaccgcaggcgggggcgcaggacccggggagccgcgccgggaggagggtcgggcgggtctcagcccctcctcgcccccaggctcccactccatgaggyatttcbacacckccrtgtcccggcccggccgcggggagccccgcttcatydcmgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccggtgagtgaccccggcccggggcgcaggtcacgactccccatcccccacggacggcccgggtcgccccgagtctccgggtccgagatccgcccccgaggccgcgggacccgcccagaccctcgaccggcgagagccccaggcgcgtttacccggtttcattttcagttgaggccaaaatccccgcgggttggtcggggcggggcggggctcgggggacggggctgaccgcggggccggggccagggtctcacatcatccagaggatgtacggctgcgacgtggggccggacgggcgcctcctccgcgggyayvaccagghcgcctacgacggcaargattacatcgccctgaacgaggacctgmgctcctggaccgcsgcggacacsgcggctcagatcwcccagcgcaagtgggaggcggcccgtgwggcggagcagykgagarcctacctggagggcvhgtgcgtggabksgctccgcagryacctggagaacgggaaggasamgctgsagcgcgckggtaccaggggcagtggggagccttccccatctcctataggtcgccggggatggcctcccacgagaagaggaggaaaatgggatcagcgctagaatgtcgccctccsttgaatggagaatggcatgagttttcctgagtttcctctgagggccccctcttctctctaggacaattaaggratgacgtctctgaggaaatggaggggaagacagtccctagaatactgatcaggggtcccctttgacccctgcagcagccttgggaaccgtgacttttcctctcaggccttgttctctgcctcacactcagtgtgtttggggctctgattccagcacttctgagtcactttacctccactcagatcaggagcagaagtccctgttccccrctcagagactcgaactttccaatgaataggagattatcccaggtgcctgcgtccaggctggtgtctgggttctgtgccccttccccacmccaggtgtcctgtccattctcaggctggtcacatgggtggtcctagggtgtsccatgaragatgcaaagcgcctgaattttctgactcttcccatcagaccccccdaagacacaygtgacccaccaccccrtctctgaccatgaggycaccctgaggtgctgggccctgggyttctaccctgsggagatcacactgacctggcagcgggatggcgaggaccaaactcaggacacygagcttgtggagaccagrccagcaggagayrgaaccttccagaagtggrcagctgtggtggtgcyttctggasaagarcagagatacacrtgccatgtrcagcaygaggggctgcmrragcccykcaccctgagatggrgtaaggagggggatgaggggtcatatctsttctcagggaaagcaggagcccttcagcagggtcagggcccctcrtcttcccytcctttcccagagccrtcttcccartccaccrtccccatygtgggcattgttgctggcctggctgtcctwkymrttgtggtyrtsgkmgctgtggtygctrctgtgrtgtgtaggaggaagagytcwggtagggaaggggtgaggggtggggtytgrgttttcttgtcccactgggggtttcaagccccaggtagaagtgttccctgcmtcattactgggawgcagcatscacacaggggctaacgcagcctgggaccctgtgtgccagcacttactcttttgtgcagcacatgtgacaatgaaggayggatgtatcaccttgrtggttgtggtgttggggtcctgattccagcattcatgagtcaggggaaggtccctgctaaggacagaccttaggagggcagttggtccaggacccacacttgctttcctcgtgtttcctgatcctgccytgggtctgtagtcatacttctggaaattccttttgggtccaagacgaggaggttcctctaagatctcatggccctgcttcctcccagtsccctcacagggcattttcttcccacaggtggaaaaggagggagctactctcaggctgcgtgtaagtgrtgggggygggagtgtggaggagctcacccaccccataattcctcctgtcccacgtctcctgcgggctctgaccaggtcctgtttttgttctactccaggcagcgacagtgcccagggctctgatgtgtctctcacagcttgaaaaggtgagattcttggggtctagagtgggtggggtggcrggtctgggggtgggtggggcagaggggaaaggcctgggtaatggagattctttgattgggatgtttcgcgtgtgtggtgggctgttyagagtgtcatcrcttaccatgactaaccagaatttgttcatgactgttgttttctgtagcctgagacagctgtcttgtgagggacygagatgcaggatttcttcackcctcccctttgtgacttcaagascctctggcatctctttctgcaaaggcacctgaatgtgtctgcgtycctgttagcmtaatgtgaggaggtggagagacagcccamccyygtgtccacygtgacccctgttcccatgctgayytgtgtttcctccccagtcatctttcytgttccagagrggtggggctggatgtctccatctctgtctcaactttayrtgcactgagctgcaacttcttacttccctrctgaaaataagaatctgaatataaatttgttttctcaaatatttgctatgagaggttgatggattaattaaataagtcaattcctggaatktgaragagcaaataaagacctgagaaccttccagaatctgcatgttcgctgtgctgagtctgttgcaggtggggtgtggagaaggctgtggggggccgagtgtggacggggcctgtgcccatttggtgttgagtccatcatgggctttatgtggttagtcctcagctgggtcaccttcactgctccattgtccttgtcccttcagtggaaacttgtccagtgggagctgtgaccacagaggctcacacatcgcccagggcggcccctgcacacgggggtctctgtgcattctgagacaaattttcagagccattcacctcctgccctgcttctagagctccttttctgctctgctcttctgccctctctccctgccctggttctagtgatcttggtgctgaatccaatcccaactcatgaatctgtaaagcagagtctaatttagacttacatttgtctgtgaaattggacccgtcatcaaggactgttctttcctgaagagagaacctgattgtgtgctgcagtgtgctggggcagggggtgcggggagggggttgctgtagaaagagggatggggagggagggcacacaagcagcactgctgagaaaaacataggcggcctctatctcagtgtgaggggtccttgtgctgtagctgccacaaaacagcacttggcctgaggctatgttaataaagatactgccttcaaaatagggaggtgctctacagtgatcattcattcaactgacctttgtcattggccagacataggacagaatggttctgcatctggggaacaccactgaagtaaaagaaaaatctctggccttttgtagcatatgttccagtgggaagaggcagacgatagatacactataaccagagtaaggaaggaaagtgctagaaggtggtaagtgctgtgaggcaggtgatccaggatgtgggcagtggggacagggaaggtggctgttgtgctgggtagtcagtgtgtgccttgttgcaaaggtgacttttgaggaaagatttgagagacatgaggatgtctggggaagttctttccaggcagaggaagctccagtccaaatgcactatggcaggaaggtgtttgtgttcccagaagagcaaggaggccaggagggctggacagagagaaactgaggtgaggtcagaggtgcggccagaacaggtgggcttgaggggagtggggttggatctggcctttgctctgagtgggatggggagttagaggacagttttgagcagaagagagccatgatatgacttctgttttaaaaggatctctctgacggctgtgctgagaacagaattgagaggcgagggacgagggaggcagaagggaaaacagtaggaatcaagtgcagtattccaggctggagatgtcggttaccttgactggggcgtgagcaggggaaatagtgggacgtgaggggattctggatgcatttgaagatggactcacagcatttgccaatggattgtatctgtggtgtgagaaagacgaatcaaggacacccatagttgtaagatgagtgagtagaagggtggagctgctgtcagtggagatggggagactctggcaggagcgtcctgaggagggggcatcacaggcactcagtggaggagatgtctactaggaaggcaggtgggggagctggggtggaatttggacagacaactccagagtttaggggaaaggactgggctggagaaatagatttaggaggtcacaccatatatatgagacttaaaacctcaagcatggatgaggcacaaagggagtgactgactatggaaaagaatgagcacaaggactgaaccctggacctccagttctaaggggtgtgatcagaccacacccagagcagactgcacagttctggccccacgtctagaggacactcagacaaggaacccccatgtgcaccaggatcacctggatgtggtgctgagatccaggaagtctggagtcgagcaagagattctggatttatgacaaggctggagctcatgttgctggtctccagatcacacttggagtagcaagagcaccaggatcccacacgtctgagcatcagcctcacctctagggcttgtcatataaatgattccttggtcttgtgcataatactctgagacaagggttctggggagtggcctgtgtattttctaagtccccgccagcaatcctattgctcagacagattgggaaccactgagatcagtgatcagagagtgcccagggtgggtgggtggggtgggttttcaaaccctgtttaaaagaggatttttctcacagaaagaaaagggaggctgtatatcatcagttatgagaggtgatattctctgttgttctctccaccatggggtagaggccaggtagacaattcaggatgtggctctcgcacaaagaacacctctgaatgccgctctctgacactcgcccgcagactcatttctcactcacttcttggagaaaactatggaaaccaaatttctgtaatgtacacataaagttgtatattggtattgggggctagttttattgtggggaaggccacagaaccaggctggaaactacacatccaagaacagaattcacagcccaccctggatcaggtccctcctaggaacaactgcccctgctgctgagcacagacaccactgctcacacctctgacaccctggtcctggacactggaccctgaggctaggacagatgtcactgctgcacctggaaattggacatcactactgtcactcagccatctttactaaaatgctttctgcacagtcctagcctctctgtcacctcattctggctgagtctggcagtgatataggagttaagaagaaattatttagacaggtagtgagggtacgcaaggcttttaatggaaagcaggctccaaattattttcttttctaacaaggagcagcctgtaatatcaagattcagacatagacaagtaagctggaagtttgcacgggtgaatgccagcagctgtccaataggaataggacgcctgggactgggtatgttcacaatggcggctccatcttcccttctctttgccaggcacgtttacagtaaggagcagacaacatgtcaccagccaagtggaaagcccatttgcataataggatgagggtggggtgaacagccttccacacgcactatgtaaatatcacacctggtacaaccaacctgtgggccctacataaatcagacaccatctcctcaagcctgcctgtaaaatccgatgcactcccattccaggccggaattcccttttgggtgcccctctctctcacaagaaggagctgtttccctttgtctttcttttgcctattaaaccctttgatcctaactcactcctcgtgtgtcagtgtccttaatcttcttggcgtgagatgacgaacacttagtatttacctgagacaatgacacctcttcagcaggtggtcatcagactggtggagcttaaaactcatgtccatgagcaactgcaggggtgactggagtgttgttgtcctcttccagggagggaggtggtgtctgtctcctctcaacattttacatgttgtaaaccaaaaataaacatcaaagccaccccttcccaatcattttaatggacaccctcagccagggtgctcaaaagttaacctgaaagactggctcaggccaccaagggaagcaggtattgaacatgtcttattatgccctcttccctcttggaattcaggaaaagttgaccagcatttaccatcaacacagaccttcagtctgatcagaaacatttacaatctattctctctgaagcctggcacctggaggcatcatctgcatgagaattttggactccacaaccttttatcataacccagacattcctttctattgataataactcaaccaattgccaatcagaaaaattaaaaatctacttataacccagaagcactaccccgcaacccttgcttgcttcaaattgttccaactttctggaccgaaccaatgtatagcttaaatgtatttgattgatgtctcatatattccttaaatgtgtaaaaccaacctgtgcctcaaccaccttgagcacatgttctcagggtctcctgagggctgtgtcatgggctgtggtcactcatttttggctcagaataaatctctttaaatatgttactgagtttgactcttttcattgacagtgtggaattctgatgtagtaagagggttcaagtgctggagtgtgaggggtggggaaaagtgacaaattttaattcttggagcagtgatccaggacgagaactttatctggtacccagtaggcacgaagagtggctgaatgaaccagtgactaataaataacatatttccacccattcccttgaggataggtttacatcaagtttttgtctatcccagtttatactctagattattggagtggcattctgtaatgatgaaatgattattcaaacatcttccctcagcatgactcttactaggattaaaactcccaggtttgtaagatctcagaggttctgggtccacacgatgttttctattaatatttatattttcttgtgtgtggaaatatttctggggagagaatctctaacatttattagtttttatgtgacaccctcaaaggcctaaaaaatcctaacttctagattaaaggtaggaccactccacgtctagacaatgaacagctggtagcaacctgtgtttagggacatgaaacaaatgcttacatttgtttatcttttcctctgggaccgaagaaggtagaggtttacttgcttactcttactataagtttctctctgtgggatggtgatggggttttcttccacccaaataactttctgattctccaacagcagctgggagtcctagagtttgactcaattctgacactaactacctggagttcgcctcagactccacaggtttaccagctcagtcctacaagtctgtcctcacttcagaagcaagtcacaagtatcacgtcccaggttacctgcacttctgtctaacatggctgcaaagtcaggggtttctcacctcccaaggattgagaattcttaaactaactcaaagaactcaggaagttgctatagccatgtaaaccaaaaaacgtctgagacaggtctcagtcagtttagaagtttatttcgccaagctgaagatgcaccttggaaacagagacacaaatcattgtagcatctgtggcccatgctttttcctaacaggcttttgaggacttcaatgtgtacaggggaaagagcagccaggagaggaaaaaaatagtcaactatgcattcatctcatgctcagtaaatctgcattttaaataagataaagtaaacattgggtggaaaagtcaaatatgcgtttgactctgggtgggtggagggatgatttctagtcttgtctttgtcctgtacctgtgaagataagctgttaatttacattgtcaggggaaaattcaacaaaactgttttagggtaaacacgttggggcccacaaggaattatcttgtgagcagtttgtgagggaggccacctggggagatatgtggtcttctatctttgcagttatttgtttaggaacgaaagaaaggcagtttttccatcagtctccaaacttaatttttccttttggtatagtgaatttggagtcctgaaattttattttcttttcacactcagtattgcagttttttattgttatagcttaaatccccacctttttggcacctgggaccggtttcatggaagacagtttttccatggactagtggaggtggtggagggcagagggaaatggtttcggatgaaactgttgtacctcagatgatcaggcattagcgcttcataaggagcatgcaacctagatctctcgcatgcagagttcacaatagggttcgtgcttctatgagaatctaattccgccactgatctgacaggaggcggaactctggtgttatgctcatgctctctcac

SEQ ID NO: 10560 - DNA, 14785 bp, Homo sapiens
  misc_feature (1)...(14785): n = A,T,C or G, or insertion/deletion polymorphism (see Tables 1-2)
gaatacaacaatctagtaactctggataccatattctttccactccccagagtttcttgttgccacttgaggatggagttgtttcttagtgacttttctaaactattgttaagctgttctatgtcatgtgtggtcactaaaatctattctgttagcttcatggtcagctagtgatttgacagaggtttccttaaacagctggagccaaaaaaataaataattaatgccctcccaggttttgcagatggactctgagttgggacacttcttcaacacttaaccaggcagtttagacgtccaccttaaccttcactggctgcttacttggaggctaaagatcacccagaggtaaaagcctaaggtcatctcaggtctttttaaagagtgtgggcatccagggctaaatatccagtgtttagccctggccatgtatgtgacattctgatttcctcagtatatgcgggatattttgaaagccatattgccttatgtatctccatctccagcctctacctccctaggcttttcagtctgtctgctgttaacccatccatcattccatgccccaggcatctgtgactagtatttgcctttaaatgcttttgacaaacattgctatggagacctctccaatcttaataaagttccaagaggagtgaagcaaagaccagcctctaagctgatctttttgggggctatcatacatgtcaaaggacacaaacacaattctttgaaaagaaagttcattttgccttttctggcatcaggaaactacaccaggaatgtgggacaccgtccccatggctgcctcatagctgagggtgtgggggtgggagtgagtaggtggctaaggaatagtggcacatgctctcctaccaaaatctagagctcctttttcattaagcactactttggttgttgtaaaaaaaaaaaaaaaattcatagactccagagtacagaaaaacttaattttgatagtttttttccaggttaatagttgctttagttggggaatgtgttgttggagttctctaccatttttggtgaaggcattacagttgtcttttaataagattttaaaattatgaaaaaatcttatgtatctacccatgtgcttaccatttctggtgctcttcattacatatttgcttttggtataattttctttttgcctgaaggactgaaacacttattacagttcgtgtctgctggttatgtattttttcactccctataagtctaaaatccctttttttatagatatctttagagtctgttaagtagcttgatgcaatcattacacatggtatacatatatcagtacatcacacagtacctcatgaatgtattattatatgtcaattaaaattatacatatatatatgtttttaaaaggttttttttctggaaatagaatctagtttgacagcagttgtctttcagaactttagcgatgttggtcatctgtccctcatttgcattgtttccaatgaaataactgctgtcatctttattattcttcttatgtgttgtgttttgtgtttttcatttttgctttctgctttttcaattttctctccttctctggttttgaacaaatacatgttactctcactcacaactataaagcgaacttaggaaacaatctatagggagagtttgttgatgattggttatacattttcagaaacagttgtttattccttcctttacaaaggctaatttccttagaatattattgtattgaagaatgtcataaataattttatttgtcacctggacctggtgccaagatacgtggtcaagcattattctggatgatctttttaggatgtttcttggatatgattaacatataaattgctatactttgagtaaagtagattgacctctataatgtggacaggcttcattcaattcattgaaggtgtaaattgaatgaaacactgaccttccccaagcaagatggaattctgtcctgggatttgaactgcagtatcagtcasctgacccataaagagctggttggtttgtgtacagcatttgcaagatgaatggacaacaccctgtttggaagtctacccytttgatcaaagaagataaaaacagaacagctcttgtgggctgaattgcagggtgttttcttagcagtgatggaagaattgaacaatgataaaagctcctatgttttagttttactgacttatgggcagtgactgatggcctggccatataattaattaagaaagcagtggaaaactggcctatgaaaagaatgcccatatgagacacagtcctatggaaatcactatggtaatttgaggggtgcattaacgtaagacatgttgatgcctgatatagattggatgttgtccccacccaaatctcatgtcgagatgtaattcccagtgttggagttggggtctggtgggaggtgactcaatcatggggtggtttctcatgaatggtttagtaccatcccctcagtgctgttcaatacccatcagaataactcccttccaggtttggaaggtgattgaaatcaacaagcatttatctctaagtgcttgccaggtgcacctgtagtcccagctatgagagtgtctgaggcagaaggatatcttgagtacaggcatttgggtttagcctgagaaatatttgagtctagcctgggaaacatatcaagaccacatctcaaaaaaatttacatttgcttgtgaagatcaccggggtctacgaaataagtagacactgaggctgtagcaatgcagagatgggctgaatcaagacatactccccttgcatcccccacctctaataagcacaaaatactcagtaaaactgttctttttaacaagactgggcacagtggctcacacctgtaatcccagcactttggcaggccaaggtgggtagatcacttgagatcaggagtttgagaccagcctggccaacatggcgaaaccctgtctcaactaaaactacatcaattagccaggcatggtggtgcacgcctgtaattccagctactcaggaaactgaggcaggacaatggcttgaacctgggaggcagaggctgcagtgagccgagatggcgccactatactgcacccagggcaacagagcaagactgtgtctcaaaagaagaaaaaaaaagaagtattctctttaacaagaaaagagacagagacagagaccaaaaaaaaaaaaaaaaaaacgtgaatgggaggtattgccaccatgtggaccactgagccacattacactaggaaacacacttgcccagaatgtccaacaatggtcagagaaatttgttcctcagaagaagagtttcagagagaattaaaatagtcatttgaaacattgagtgtataaatcaggagcggggagacataagcatgaagggcgggcctatacaccttcatgagtgtgctcgctcttgacatgagtgtggacaaaggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttttctcatacctgatgcagtggtctcaggactagggatgcaaataaaagtccaggcacaggaattattcctgagcaagaaaccgttaacatatttaaaaaccattatgcaagactgcctaagggcctggagtagatgtgccttcactgcatctggcaaagttggagctaacattgaatgcagctgtattgcctggaagccagatagccaaccagttctctgcctgaataaccctaacctctatgaactggaatggactgatgggagacactcgctgttactagcatggtatagctccctgcataggccagcacagcaggaaaacctaatgtcccttccaaaatgagaaatatttggtataaatgcagaagaggaagaatagtagctgaggtgaaatgaatgaataaatggggtatgtaatgaggaaaatccaatataacatgatctcctcaaaagaggtataaacgaatgatgatattgtcttttatctcatttttaccagatgtctgaaaggttgaagccatatgttgctgagaccattgctatttttggactgcaatgggcgaattgataatgactaaacaggactctggtaatgggccagtatctttttactgctatgattcttctgctataggagatctgtggttggccaagcaaaggggctcacatttataatttcaccactttgagaggccatggtgggaagattgcttttgaggccaacagttgcagaacagcctggggcacataatgagactgcatttctacaaaatatttaaaaattagtcagccatggtggtgtgcacctatagtgccagctgctcaggagacttgaggcggaaggatcacttgagtccaagaatttgaggttacagtgagctatgattgtgccactgcattctaccctgggcaacagagcaagacattgtctctaaaataaaataataaataaataaatagaaattataagaagaaataatgtggttaaagaccaggaagtgatctgtgatccaataaatatatttggtctttgcccctagtccctgacaggcaggtcctaaaacgcttgcagtccctcagtgataagcatgattttaatatggcaatgagatgactatggggtgaggggctcctagatagtttcaggatggaggctgcttgccagaaacaccagctgtgattagaggattggaactttcactgccatccccatcctctggggaagaaaagggggctggaagttgagctcagtcatcaatggccaatgatttcaccaatcttgcctacacaatgaaacttccatagacacctctagacagtgagttttggagaacttcccagttggtgagcacatccgcatgtccacgtgctgggaggacggcacacctcatctccatagagacagaggcttctgcgcttatatctttctgtaaggcagacacccttgtttctaggagggacctagggtggactgtggattctttctctggggcaaataaaaatgtagaatcagaaaattcaggcactttgcactcctcatgggacactccagcagcactcacgtgaccatcctgagaatggacaggacacctgaggtggggaagggagcacagaacccagacaccagcctggacacaggcacctgggataatctcctattccttggaaagttccagtatctgagggaggaacagtgacttctggtcctgacctgagtggagaccgagggactcagaagagctggaatcagacccccacacacactgagtatgagtcagagaacaaggcctgagagaaaaagtcacagtgcccaagactgctgcaggggtcaaaggggactgctgatcagtgttccagggatttgctccagattaatctgagtcatggaaaaactgcctttcttttgtttctaaacaaatacctgcaaagacaaaagaccacataaatccccagrtgcacaactttttcagatttaaagaaaaaacaacccccgtctttccctccattcccaggagaagctcactctgtggcatcaagctgcctgggtgagctctcttctagaagagtccagggggacaggcaaggaatgggaggcaggaagtccagttcagggagggggattctgggatgaaaagtgaagggagagggactgagcccatgctgagggtttttctctggtttctcagacagctccggggccaagattcggggagacattgagacagagcgtttgatataaaagaagggggtaagagccaagtcccagggcccggagcttggctctctgggcttcaggccccgagggcggtgcctgggatgggccggctcagctttggggtttcccgagctccgctctctctcttccacctttcccaacctgtgtcaggtccttttacctggatactcatgatgcggcctcagttctcacttccattgggtgttgggttcctagatcagccaatcagtgtcgccgcggttcctggttctaaagtcctcgccggcccaccgggactcagattctccccagacgccaaggttgcgggtcatggagtcccgaaccstcctcctgctgttctcgggagccgtggccctgatccagacctgggcaggtgagtrcggggtcgggagggaaaargcctctgcgggaaggagcgaggggcccgcccggaggagtaaatctgcacatatatttaattacagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatyacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctgkggatcaggatctattacctgtgcctggagagraggggactcctcttctcacccgctggtctctggrcacatactgtccaattcccctgkggcagctgtaatgtgtagttcaatgggcactcatttgtccccttttaagggtaccctcctttagaatccaggaccttctaccctgcagagtgtkgttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggycagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttayacagatgctaattcktaggggcacttggaatcacatggttgttttgtgtcccatggtcaagcattctatcttaycagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcrccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaatcactttatatccacttttgtgtgtgtgtgtgtgaggcagagtcttactctgtcacccaggctggattacaggtgcacaccaccatgcctggctaatgttttgtttttggttttggttttgtttttgttttgtttttggacagagtttcactctttttgcccaggctggagtgcgatggcatgatctcagctcaccgcaatgtccgcctcccaggttcaagttattctccttcctcagtctcccaagtagctgagattagaggcatgtgccaccacgcccggctaatttggtatttttagtagagagaggttttctccatgttggtcaggctggtctcgaactcccagcctcaggtgatccgccctcctctgcctcccaaagtgctgggattacaggcatgagccaccacacccgggctatatccacttctaattggaatggaagggaatgcactcaccacatccacagctgcacactgtgtgcctgaggccttattaatctgctctaccagatatatccagccagcatgctagctgcaatcaggactcctacttggtcacatctggagtaatcccattcattccttagtaatcccattcattccttaggctccatcaggcttatttgctaaattacatggagataataggcaaccccaacaccaccccacatcctccagctctctaatggtggtgctacccccacagcacttgcagtgccttccacaagattcaccctgggacatacgatcatttttgatttggccagaatggaggcagtttcagaggtttccctttggccttcagcacaatgagagcccttactccacagactagggatgcagtgtgggggtgactccagctgccagggcatcagtgtcaattatgcactaggagaatggggagataaccagggctgggtctgtggactcagtgaccccatggtgagccgtgatgtgtccaggtttatttcgtggtctccgtaatccccaatgtgagggggtcatgatgatgctgtgggcctctgggcatcaatgtcatctcacacccaaagtcagtactcccccaagttctccctatttccctttcccagggtacagtctctaaagtaaatggctgtaggtccctttgcacaatggctcagggaattgacccagcatacacttgccacagggttgcagggtccttcctcctaggaatatggacacctcctccgtcactgggttctgaatctgaagcttggctgagatctaggcactgagaatggatcatgattttgtattggttcaaacaccctcagcctcctgctcctcaattcttgctttcttatcatagataccaagcagtgctcttgctggctgcccttctgttctgaccctggaacaccaccctctattaaccttacccacaactgcaggcaggtcaagccccctcggctgctcctctggggttgccatggtaaccgtgtcctctggcttttgcaggtcactgccaccacttgttctctatctcttcagggccacaccctctccrtggatattaatgagcccaactctgggacatcttttcctaccatcaccctcagccttcagagaacaatacaatgaaacttcttagtgatgcaggtccctgttgccagcacgttcctgaggctctggtggaaggtgggccccctgggtcctcttataaagcacggttccggtgggctttccggcctcacgtaatgtctccatcccacaggccaaattcccccagcctcattattccctcttctacatgttccggggcaactaagtcaggtctagcttgtgagataccggcatcattttttcccagtctacatggatcaccccagcagtgggtttgccccatgccctggggtctttgaaaaacccatgtgatacggttggctgtgtccccaaccaaatctcgtcttgaatttccacgtgttgtgggagggaccaggagggaagcaattaaatcatgggggcaggtctttcccatgctgttctcatgatagtgaataagtctcatgagatctgatggttttaaaaggagaaatccctttcgcttggttctcattcttctcttatctgctgccacgtgagacatggctttcaccttctgccgtgattctgaggcctccctagccacatggaactgtgagtccattaaacctcttttggtaaattgcccattctggggtatgtctttatcagcaacatgaaatggactaatacatcatgccttgagaaagtgttcccaagtcaaaggatttttatctatctagcttgaaattctgtccctttgatcaaatgccctcaaattccaatcccagaagtgttccccaggatcctatgtggacatgccagctagttcctgcaaagctcctgagtggaattccygctgcattataagggtgaggcttctgcagcatcttccagcgtaggaagtgggaaccattactggaaaaggcgagccttctctgcatgcccagagggtactggagggcacccatctgataatgctgtcctagtttgcagaatctcatgtttccccaccagggccctgattttccacaacaggcctgccttggctgaatgtcaaacatctctggaggtctgtaaccctcacaatgatatcttcagctaccattccacactatctaccctttcgctacaggaaataagggcctctccatgagacactgcagaggcctcacacgtagccagtgacagctgttagaatccctcagattctcattctccttttatagggcatcaacacagctgagcagtaaccagccagcttccctgttgtaggttttccctcccaccctgtcattattgtgtagaggcttctatcacaccacctgccatagcacccgggaaccagggcatcttctcaggtccgtgctggggatatccacagcagctcagctgcaccttgtgccatggactttctctgtccccaaccaacgtggatggcattctcggcctgccaggcagtgggcaagctcagccccaatccccgtttttgtctgtgtctatggaccactcctgaagccacttgtgttggttagcatcccctgaggagcagactgcaatacagaattaaatgtgccaggatttattaggggaaatagccatgaaagaaattggggagcaagacagaaaagactgggaaagccataagactgtgrcgcaagtggcttttttatttttattttttgagcaatctcagctcactgcaacctccacctcccaggtgcaagtgattctcatgcctcagcctcccaagtagctgggattacatgcatgcaccaccaaacctggcaaatttttgtctttgtagtagaggcgggttttcaccatgttagctaggccggtctcaaactcctgacctcatgtgatctgcccaccttggcctcccaaagtgctgggattacaggcgtgagccactgtgcccaaccagactgcaatgcaagtttaaaccccagtgaaggagagagggaaggaagtttggctgaaagtatcctagacccagtgcaggttaagagaagttcagtaagggtgagccctggagcctcagtgggcctttaaaggagggacaatcctgtctttgtttctcctcttctctcaattattgaatcgaagaagccaatggcaagtatggtctgagagcaaacgtagcaatagatttcaggcggcaacagctggagcatcatcagttgtgcttcctctagctgaggggctgggatgtgcattctcaagactgccacaacaatccagtggggagaaaggacaaagggtaatgatcaaagagaaaaaaaggtatgaactgatgaactgatacctttaagtagatgagaaggatgatgtttgggacaccagtagagggactggctctggctgggagcgggaaggttaacccacaacaaccatccatgtggtagaagacccagcatgcagtgcagctgcaaatgcatgagcagatggaatctgtgaaattgtcttctagtgtgttcagttttctcagtgaagtaggaagcaaggtcatcagctgaagtaagaatgcagatagaaggttggatgtgtgagcagagagaaggtgtgtgagagtcacccagaccagtaggaggctgagggtgagccatgcttggagagggtgattgctggtcgtggtggggggtccccatgaggtttgggtcatgaagttagagagagaagtcagcatgctgtgtgctgctttccagcctccttcagctcatgggggcaggtgcagtgtaggcagaggtggattccaccagctgtgtagttttgccaaacaagtatggcaacgcaagggaggggcaagggagggatggaaattatttacaatagaattcaaaatggctgaagagggaggagaggacatcaagggtgagggacagtgagtagatggcaggatcactggattgggaatcccagagtgggtggaaggattgttggaattgatgtactacagggcagactccaagcctggaaagcaggcacataggcaatgagtggttcactgatattacgtcacagcatatgataaaatgatagtataagtatcctcagagcctgtggcctccgtgcaaggggatgagtggaaagatggtcagagaatggaaagtgtgagatagagagtatggaagggctggggttcttggccatgatgagacctaggactctttaggggagaacaacaacaaagcaacaggatcctggtgtcagggacagaccatggccatggcgggatgatagcagctctcctacgaaataatgcttatatgacaagggcatgagattcaggcagagagaggagaaggtcatggaggagaggagtcccagcatctgagaagccagagggcgatgcatcctctctgctctatgggtgtttattgctgccataaaaattaacacaaaacaagtggctttaaacagcatctctttatcatgtcacagtcatgtgtgttacaatttcaacagtctcatggggctaaaatcaaggtaaggggaggtctgtgttccttctgactctgaggaaaaatctactgtcaagctcattcaggttcttgtctgaattcacttccttgcagataggactgagatccccacttccttgctggctcctgtccaggggccacccttagctcctagagccctctctcagttcctcatacatatcccatgcaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10561 - DNA, 99971 bp, Homo sapiens
  misc_feature (1)...(99971): n = A,T,C or G, or insertion/deletion polymorphism (see Tables 1-2)
tcccaagatatattcccaaaatatgtttgttttctttctttctttctttctttctttttttttttttttttgagacggattctcgctctgtcgcccaggctggagtgcaatggcacgatctcggctcactgcaaccactgcttcccaggttcaggtgattcttctgcctcagactcctgagtaactgggattgcaggcacctgccatcgtgcccggctaatttttgtatttttttagagatgaggtttcaccatgttggccaggctggtctggaactcctgacctcaggtgatccgttcaccttggcctcccaaaatgctgggattaaggcgtgagccactgtgcctggccagtacgtttgttttctaaggaagagaatagcagacgtggttgtggagatagagcagtatcattagtagtaggaaggagaattgttagtttggagcaaacattccttgtcagagaaatgaggttaaatgaacaagtgaagtgttaaaaacaaacacaacaccctagatttgatgtgaaaattaagagagatctgcgagtattggagaaaccacaaaggagaaagggagagggagtcccacggtcattgtcaactgatgctggcatggagctgggtgtctttcttcaagatatttttccttttgaaattctatcccccgcttgtttttgagacaatattctcctagtcttctgtcctaactcttcagctgctcttcataatagagctgtcctctctattattattaatgaacaagtagcaaaataattattcataattgcagttagtagctatatggcttatcatatgctaagaattgtgcaaagtatgttattttagtgtacccagccctgggaagcagatatgcttaccattcccattaaaatgagaaaactaaaatccaagtgttaataagttgtcacagaggtagtaggttgtgaatccaaaaccatgagcttaattatgatgtatggggcttgccactaaaacgttggcatcatccagagttctagccttaatccctttcttcccaagatcaaatctttgtgtttacaatttctctaacctttccttacagatttgtatgccttacagtgtctttattctttactgatctcttcatgtacttttaaaaatagctgcatttccaaactggagattaattaaatagactgagcagaaatgcacagaagtgatgctagtattctcaccaaatcctatcagatggcacgtgatcttgatttgtcccattattgatggcacttgatcatttgattaagatggtgtctgccaagctccttaacactgaaaagttactctagttccctttgtaattagtaagaattttgttgggagatactttgaaactatgaaactattccactgcttatcaaactttcaatttatgtatttctttacactggtatagcttcctatattattcagtgggttataatacatgattttttttaaatgttgaagtacaatttgtccctgatttggctggtgtcctttagacatgcctcattattctttgagcacgtccttatattctggtactacaagaagttccaggctcatcccgtaccctcttctccagtcctggaatcaactattttgccaagaagaaaaatgaagtggagaatggtatttagaagccaagacctgggctagctgttctcattgttttgtggtgtcactactcccagatcctctcaatggacagggtatgtacatatacacctatatctatttctacaaatagtgatagattgatacctccattactagcccaccaccaaagtttcctcttatttgtaattctcttcctgaacattgagaaacctggctcccattttccttaactcattgccagtcacgtgtcgcataatgacatttccgtcaatgatggactgcatattatgatggtgccccataatattatgatgtgatatttttactctcccttttctatatttagaaacacaatttcttaccattgtgttctaaatccctatggaattcagcacagtaacatgctatacaggtgtatagcctaggagtgatgggctacatcatctagcctaggtgtgtagttagctataccaaacacggttgtaagtacactctatggtgttcacacaacgatgaaattgcctaacgatgcatttctcagacttacctctgttgttaagcaacacgactgtattttttttttttttttttttttgagatggagtcttgctctgtagcccaggctggagtgcagtggcgcgatcttggctcactgcaatctctgcctcccgggtttgagcgattctcctgcttcagcctcccgagtagctgggaatacaggtgcgtgccaccacaaccagctaattttttgtatttttagaagggacagggtttcaccatgttagccaggatggtctcaatctcctgacttcatgatccacccgcctgggcctcccaaagtgctgggattacaggcatgagccaccacgtctggccaacacgactgcgtttgatcagttctcttgtacacaactgtatcagtttgttctttcgttgctataaagaaatatctgggctgggtgcggtggctcacacctgtaatctcaacactttgggaggctgaggcaggtggatcacctgaggtcaggaaatcgagaccagcctggccactactaaaaatgcaaaaatttgctggctgtggtggtgcacgtctgtaatcccagatacttgggaggctgaggcaaaagaattccttgaacccagagggcggaggttgcagtgagccaagatcatgccactatactccagcctgggcaacaaagtgagactgtgtctcaaaaaaaaaaaaaaaaaaaaaagaaaaataaataaaaataaataaataaataaataaataaataaatatctgaggcatacaactgtaatcccagcactttgggaggctgaggcaggtggatcacctgaggtcaggagttcaagaccagcctgagtaacatggtgaaacccttctgtactacaattacaaaaattagccgggcatggtggcaggtacctgtaaccccagctactcaggaggctgaggcctaagaattgcttgaacccgggaggtggaggttgcagtgagctgagatcgcaccactgcactccagcctgagcgacagacccagacttcatctcaaaaaaaaaaaagagaaaaatatctgagactgtgtaatttgtaaaggaaagaagtttaattggctcatggaaggcaggctgtacaggaagcatgatgctggcatctgctcagcttctggggaggcctcgggaaacttacaatcatggctgaagacaaattgcatcatatagccggggcaggagcaaaagagagagggaggaggtgccacatatttttcaatgaccagatttcttaagaactcactcattaccacggggacaatacaaagtggatggtactaaaccattcataagaaatccacccccatgatccagtcacctcccaccagtccccacctccaacattggggattacaattcaacatgagatttgggtggggacacagatccaagtcatatggataaccaatctctcattgttgctgctgcctcctgctctgctgggcttccttcttcatacccctgcctagtccctccatgttaacatagcaagtccaggtggcccccagaggacatcccacaacaggctgctttggtgctctttagccagactccaacaagacagctttgcatgccttctcttcactgctgtattgtctcgacaacacacaccttcaacaaagtacatttaaaaatacattgtctttttgctccatgtaaaacctctgtgagataattaaggcattactagccatattttttctttcaacagatcatcagtgatctagttcaggagaaatggagtgactggcccgaggtcacagattatagaaagcaggacctgagtgcatgggtctttccactccagcaatatgtgatgcctatgccaaaattacagtacctttttttctccagtagaaatatgtttcaagcttaatcagtgtgtggtcaactaatttccagcctttccttttcccgctatatatatgccaaacagtgatgtgatagaaaaacgaatagttgcagaattgagacacttaaaaacttcagttacagctctaatatatgagacttcagtcaagttactagctttcctcaactataaaaaggagattaggcaggacttggtggctcacgcctgtaatcccagcactttgagaggccgaggcgggcggatcacttgaggtcaggagttcaaacagcctggccaacatggtgaaaccccgtctctattaaaaatacaaaattaccccgggtgcggtggcgtgcgcctgtaatcccagctacttgggaggctgaggcaggaggatccctcgaacccgggaggtggaagttgcaatgagccgagatcacagcactgcactgcactccagcgcgggcaacaagaacgaaactccgtttcaaagaaagaaaggaaagaaaggaaaggaaaggaaaggaaagggagggagggaaggaaggaaggaaggaaggaaggaaggaaggaaggaaggaaggaaagaaaggaaagaaagaaagaaatggagaattagatcagcgactctttgcctgggggtgggtgacagaacaacacttcttcctcccctaacaaaaattacctatggagctgtgagggctttccccactgatagaaatgccagcagaaattcagctacaaatactcaatccaataatccttaacatcacttccaatccacagttatgattccaacgcaatcttttctatacagtatttgtcagctgtttttattcttcagtttatcatcttatatttggctctcaatttcacccataaattattgatggcttattatacgccaagtaccctgcgctccgctttttgtggtatccctcttcggagcgagaagtcacttagaattttaccccatcttccccacttgggaatcggaagggttcatagctaagttttgttatttataagcacgccggctcttctctatccctctctccaccaaccccatttcaaggttggtccctcccagcggacgacagtgatgaattcctcttggggacagccctcccgcaactaacggtggctccatcgacgctctggtctccttgctgctcgctgggaattcgggtgggacgttttccaaagtttggattccacggcacattcctccctcggaaaggcacaaccggctcggcgtgtcagctcagctggactcacgccggtgcggggccgcagctccggttctcgctgggcggctgcggagggctgggcgattctctcagcgtcgcgaggcgacccgggcagcagcaaacttctccgcttcccctcttcgggacgcggcacctcttctgcccttgagcactccgcaggaacttcccccggcctcggctctcgctccgaaataaccgagccagctcctcgcacgctcccgccgtcctcctccggctgcggccgcgcgcccgccgccaccgccaccaccgcgcgtgtcctcacggggcctcagctccctccgcccccgcagccgcctgcgtgcccttcaacagctccctccgcccggccgtcgcggagaggagcggggagcgcgcgccggcgccagagacgtgcgcgagacgcacggccccgcgccgagcgccggaagcagccgagtctgggcctcgcgcgtcgcgcgcgcctcctccccctccgccagccgccgcggcctcgcgcgcgcgcactgaggcgccgccgccgccgcggctgctgcaggaggcggcgctggctggcggctgcgctcgctccagtcggcgagcggagtagcgagcgagcgtgtgtgtgttttttaaagatggccggagcggcggcggcggtggccgcgggagcagcagctggagccgccgcggcagccgtgtcggtggcggctcccggccgggcctcggcgcctccgccgcccccgcccgtgtactgtgtgtgccggcagccgtacgacgtgaaccgcttcatgatcgagtgcgatatctgcaaggactggttccacggcaggtaaataaaccccctccagccccgcagccgccaccgccggccaccgaccaaccgccgccgccgccggccgcccgcgcctccctcgggccgggccgccgcgccgcgcccagctttcagggggccccggtgcctagccccccggccgggcagtggggcgcgcggtgccccgggttcgccgggcgggctccagaggggagccggtgggctcgcctggcccgggcgaagagtcgccacaacaaacacgaacaaagagggccggcggataagttggcagggggagcctggggcgaggggacgcggccgggcgggcgcggcgggggcgtcgggcggagcgccggccgggtccgcagcccctcgccagcccgggccgccgccgccccgccccgccccgccgcgcccggggctccggccggagtcgccggccgccccgccgctctgcccggccggccgacgcgcctgccttccttccgggcggcgatggggtcgccccggccccgcgtctcctccgcgccgcgggtccctgtcgcgcccccttccccgtctttatcaaacttcctgggccagtgggacgggggcagcggcgggccggagargcgaccgcgccagccagctcggcggggctccgcggagtaaacagagcaacagatgaggcactcgctctcggggacttgaaaggtgccggggaagttggggccgggcccccggcgggcggcaggttgacccgggtcgcggtcctgggcccccgcacacacccgggtcgccgggactggggcagatggagtgggttgcggcggcccgaagggaacgcttctccggaccccctgcgttgccctcgcgccgcggcttaaactttacaaagagtgcagttgccatcgctcgaagctggcgacaccgggaccgcctgcggctgtgcccgggcgccggtgccggcgaacttgagtcggccgggcggacgctgcggggccggctggcggcggcggcggacgctgccctctgattcagccgccgccgcgctccgggtttgacgtttgagagctcgggccgcctccgcagccaggccgccgactcgtgtgttttgtaatcaaagtgtgaggctaataaagggcggcgccacagcctcttgactccggcgtgggagggattcacaggcatttaaacaaagaaactagttggggttgggctcccaaagtccttatttgggtgttgtggcaaagcctgcggtcacctttagttgaagccggtttcccgggccccgtttggtgttgtctcttggcgagagcacgctcacgagtaatagcagatatggtgactgtgattgtaggaagtgtcttttgattgacagcaggacatttaaatacagcctccgctccccccctccccaattttacagaaacactacaagaccaggccagatgtcttagtctccctctactggtccagggagagaaaaccatgtaaatcacaatgttctttgcagtgtttagtgctaggtgtagttaagttttacttaattttcaagtacagttttacttaatcagttttcaggctagccgattctcacaacagaaaacaagacacagtaaattatcactttaaaagaaaggcagcgtcctcgtttcgtataatctttagcagtcttgtatatccaattctatttccacatcctgtttccataacatattctacgcaactagaataaagattatccgaacatttaggttctatatagaataaaatcagaatccctggtgattatgtaaatgcttattttttttcaaagaactattttttgaaatttgaggcggtttaaactgcataaaaatttgtctcgccaggcttggtggctcacgcctgtaatcccagcactttgggaggctgaggcgggtggatcacgaggtaaagagatcgagaccatcctggctaacatggtgaaaccccaacatggtgaaaccccgtctctactaaaaatacaaaaattagctgggcgtggtggtgcatgtctgtaaccctagctacttgggaggctgaggcaggagaatcttttgaacccgggaagcggaggttgcagtgagccgagatcgcgccactgcactccagcctggcgacagagtgagactccgtctcaaaaaaaaagaaaaaagaaacttgtctcattatgcaatgcggatttgataggctaccaaattttagactagaattgtatttatcttaatttaggtcacttaacactataaccatgaaaagccccaggtatttgatggagaattttgtaatacatgtaagtatacacttgtaaatagggaaataggaaatacagagggcttacgggaaggagggagagcaaggccaaaacaaatatgccctctctgctttgacacataaatttgtgtaactttatatctgtggaagtgagtctaaaataggtttttttgagcccagggtctttttgaccatcaatccttgaaacttatgtggttcagatgtcaaaagttagaaaatttagctatattgtcctgccctacaaaagcagtatctttttattaagtttaattctttttctttttcttttttttttttttggagacggagtctcgctctgtcacccaggctggagtgcagtggcgccatctctgctcactgcaaactccgcctcccgggttcaagtgattcttctgcctcagcctcccgagtagctgggattacaggtgcccgtcaccacgcctggctaatttttgtatttttagtaggaacgggatttcaccatgttggctacactggtttcgaactcttgacctcaggttatccgcccacctcggcctcccaaagtgctgggattacaggtgtgagccaccctgcccggcctagtaagtttaattcttaagtattggtaatttggactctgtatgtttttcccgtggtatttactctgatgtttactgtaccataaaatgagtgatcgtttttcggaacacagcaaaatgttcctttatattaactattaaacaaatatcatttgcttccatgagaattgacccctaaaggactaagatgtatctttaccatgcttagatttcattggaccagaggtggtccatctgtagaggagcaaggaggagtaggaggttggatacagagaattgccattgcctgggtaatttcttgttaactttatttctttaagtagaaggactttttaaactgaggaatcagtgaattttgatatatataaattttagtttattctgcctggcgtttctgacataaggaaatctgaaaagttgttgccctaatttcttgtgacagggaaggaagacctgtccttgatgcttttctgtcaggctgcagggtggatggaaccagcgtcttccaggtctgatgctgtcaaactttagctgcataccaattcccatctgtccatctccctaagcctttttgcaagtgagaaaagaacacttgccaggcagggtacagtgtataattgaactctaggggcaatgggttgaggaattaacaggattttgccgggaatgttctgtctaacctggagatacagttctttctccctgagttcttggtggacgtaccactataaacgtctttcctgataaggccccgctcccttatctccaggctagatgtctttctgtaatacttttatatcgtcatatgcaaaattgcctcactgccctaattgaattgtattagagtttctgttttcttcctgttagaatgtaaacaccgtttattagtctttaatcgcattttttagttgataaaagcaatatattaaggaaaaatcggaaagtacagaaaagtataaagaatatgaaagtacgcatgtcttccagtgattaccactattttattaataatgtggtatgtgtatatgtatattcttttttaaaaaaattggaattctttctatgcattccatgttaccttttgtcattgatgtatactttttcctgtatctttaatgttctttgaaaacatttttagtggctacattgtgtttaatttcacagaagtacaatatatttgaaaataattacsctattgttatttactttgtttactacttttttttttttgagacggagtttcgctctgtcgcccaggctggagtgcagtggcgcaatctcagctccctgcaagctccgcctcctgggttctcgccattctcctgcctcagcctccagagtagctgggactacaggcacccgccaccgcgcccagctaattttttgtatttttagtagagatggggtttcactgtgttagccaggatggtctcgatctcctgacctcgtgatccaccctcctcagcctcccaaagtgctgggattacaggtgtgagccaccgcgcctgacctgtttactactttttcttatgtttactaatgatggtatgattgacatactaaacaaattattgtggttatttaattatttccttagaataaataaaatgagttaatacatataaaacacttagaagaagacctggcatgtacaatttctcaataagaaatttccttgaactagtgttattggtcaaagggtatagatgcttgtaggcttcttgtgcctattgccaaactgtcctccagaaaggttatgccgatttctactttcacctacagtgtccacttttagttccctgcatcctcccaatctaaggtattattaaccagcccctaccaaaacaaacaaaaactgttaatctgtagataagtcagtattaccaccaaaagacatacccaagcctgttcatggcagcatttttcatgttgtccccaaactgtaacaacctaaatgtcatcaacagtagattggatatattatagtatagtcataaaatggaataccaagctgtaaaaaagaatacactatggatgcacacaacatgaatggatctcacacataataaagttgaacacagaagcccagtacaaaagagcatactgtttggctctgtttatgtgaagttcaagtacaggcataagtggggctgggagtcagaatagggtttaccttttgggtgggaattgactgagagggagtttctgagattcaggacatataaatataaatatatataaaataaatatatatttataaatatgtaaaaatataaatatataaatacaactatataaaaatatatatatataaatatataaaaataaatatatatttataaatatataaataaatatatatttataaatatatataaaatatgtatataaatataaatataaatatatatttttgagaccgaatcttgctctgtctccaggctagagtgcagtggcgcaatctcggctcactgcaacctctgtctcccaggttcaaatgattctcctgcctcagcctcctgagtagctgggattacaggcacttgccaccatgcccagctaatttttttttttttttgtatttttagtagagatggggtttcaccgtgttagccaggatggtctcgatctcctgacctcgtgacccacccaccttggcctcccaaagtgcctgtaataggtatgagccaccacgcccggccatattctttatcttgatcttgggtggtggttgtatgaatgtgtacagatgtaaagatttactgagctgcatgtgcactgaagtcttttgttgttgttgttgttgttgttgggggatgggggtctcagtacattaccaacccaggctgatcttgaactcctgagtgcaagcaatcctccygtytcagcctctcaagtagctgggattacagatgtgccatgcaccctaaaaatttgccaatttgttaactgacacagtattttaaaatttgttgtttctgtcttgaatgagattgcctcttgtgttttgtcattgagtatgatgttgactttggccaagagtttgtagtgtaccaggtgctaggaatatagtgtatttgtgctagaaatacagcaatgaacaaaacaaagtccttgctgtcttgtgacttacattctcgaagggaaagagagataaatatcgaatctcacttatcgaatgttttacaaagtgctaggcactgttctaattaattagatgtttggttaactcattgaagtctcacagtcaccttgttgagtaattgctattattatcatccccattttacacatgaggaatctgagagttagggagttcagtaactttcccaagatggaaaggctggaaggtgagagagctagcatctgagctcaggcaggctgactccggtgctcatgctgtcaagggggtagatggtactgagtctcctcttcctccttggctgcagccagcttcaggaggaggattagatgtgacttgtctgtctctatctcaggggtgcataggtgagacagttgaggcagggttctgaagagacatgcctgtaaacatcttcctttttttaaatcaaaattattttctttaatgtaaatatgtaaaatattataactgccttggggacacattatgtataaaatatttatttgaaaagttttataatttaactccgctttcatccttgttatataaatggattttttttattagagtgtattttgacttcttaaaattggttagggataggaaatattttacaaatttgtttaatatacatttcaccttcatgattggtgtcataaacttattaggtgaataagtatcttcctataagaaaacaaaaagctcatttattgaacttctcaatttcattgttttgatatgaccgtttattatagaataatgagtatttgtgtgtttcacttataagagttttataatttatacacaattttgctgtttgaacaaaatatgttgtgattatgggaggcttatctcaggctacttggaggcatgggacatagttctctcataagctttttaaaaaccattagttaggttggacacagtggctcacgctaatcccagcactttgggaggctgaggcgggcggatcacaaggtcagaagttcgacaccagcctgaccaacatggtgaaaccctatctctactaaaaatacaaaaattagctgggcatagtggtgtgcacctgtaatcccagctatccgggaggctgaggcaggagaatggcttgaaaccgggaggcggaggttgcagtgagccgagatcacgccactgcactccacggtgggcgacagagcgagactttgtcttaaaaaacaaaacaaaaaaaccccattagtttggggtatatttctgcttggaatgctctcctgttctgtatttttcggtatgaaatcgagttttctgatcatccaaggggaggaatgcttttatttttgaagatttgaagtggaggcttatgagtaagaatagaacaggtatagaagaatttggttataaaagtgagcattggttgatttgagcaatttaaattttgagataatttgtgcagcctttgaacagccagtgctaatcttaacaactaccaccaagtttctggtcttttttgaaaattacattttattactgtagtgattatttattttttccattaatgaaaaggttatttttcccattaactgtaggttgagttaatggtaacttgtatgattttcgtgtctatatgtgtgagccctgtttcctttttattggagaatagtgttagaaaccaaggtctggtattagtgggctcattgtttctaggccttctcagaggacagagctaggaaatacactaattgcacacatgcacacacatttgtctttgtttctgtctgtatatattacgaactgtaagtttcataatgatatctttgattctaatataacaccacaggattcattttagctttcccctttccttacttgtaactttttttgtacaacagtgagaaacctagctgtcattatctacaacatatttgttcaatcctgtaaagtagtccaagaatttgctaacctatatttttgtgagaaacaaatttgctagctagattacagtatttgtgtatatagtacttcttttttgcctttggccttagagtatctaatcagaatattgttttccaaagttacttaggtcaattcttttcacctgactttaatgtatgtcatttactgacaggttcatttgttactgcttgtattacattttgatgcctcctacatccagtttttttttttttttgagatagagtcttgctctgttgcccaggctggagtgcagtggtgcgatcttggctcactgcagcctcgacctctcaggctcaggtgatccttccatctcagcctcctgagtagctgggattataggcatgtgccactgtgcccggctaatttttgtattttttttgtagaaacagagtttcaccatgttggtcaggctggtcttgaactcctgacctcaggtgatctgcccaccttggccttccaaagtgctgggattacaggtatgagccaccacgcccgaccttgtattgagatacagcttcaggttagattgctaaaagtgggattgcttagttaaaagataaatgtatatgttgttttattaggattgctagatttctctctagaatggttggaccagtttgcattcccaccaacagtgtgagagtgcctttttctctagatccttgtcatcaggatgtgttgtcatgtttttaatctttgtcaatccagtagatggaaaatggtatctatgttttaatctgcatttgtctaattataaatgagtttgaacatttgttttttcttagttttaggaccatattctttcaagaatcatctggttacatttttttttctgattctatcaagcttttagtcctttgtccctcaatatttaaggactttttacatattaggggtactagctgtttgtggtaaatgttctaagtattctcttccagctttcagttgtcttktggttttgtttatggtaatttttttgccatgcaaaattttttttaagaaatatgtagtcatatttattagtcttttattggttctggattttgagtcataattarcaatcctttctctacctcaaggtaaagagaattttttcctgtgtttttttctaatacttgtgtggttttattttttaagcttctaaatggatcactaatccatttggattttatttttgtatataatatgaaatataaatagaattttttctaaataaaaagaaattgtccagttgtcccagtactatttattgaaatgtccatttgtcccagtgacttcagatgccaaaacatatttatatataatagtcatatgtcaaagattctgtatatacttgggtctgtttcagcactttctgttttattccactggttgatttgtccmttgatgtttcagcaccacagtgttttaattacagagkcttttgtagtatggtgtaagtctggtaaggcctgtcccatcctcttagtttgttgtatttgttttcagtgtgtttctggttattcttgcagatttattttttaatatgaactttagtatcaacctgtctaattttattcaaaagcattgttgggatttttattagggttacattaaacttatgagagctgatatgttaataatattgagtccttctctctgagaatagtattacctcttttatttattttatttatatctacttttgtgtctttcaggtgtgtttttaatttttctttgtatagattttacacatttttaagattattcctaagtaattttctttgttagtattataaatgagattttctttaccatttgtttgctgttggttattgtttgctgttggttattgtttgttttttaaatgttacttttatattctactactttgstgaaaaaaattatttgagttgtattatcacttagggaactgatatgtaatatacaaatagagagttttagtacttctttgcccattcttatgcctctatttgatttcacttatataattgcacaggcttatacctctcgtatagagttgaatagtggtagatcgtgggtatgcttgctttgttcctgattttagtagaaatgcctctaatatttcctcattaaggaagatactagctttagtactaatttgtcgtattaagacagtattcctccaggtgcagtggcttatgcctataatcccagcactttgggaggccaaggtgggtggatggcgtgagtccaggagtttgagactagcctgggcaacatgacgagcctccrtctacaaaaaatacaaaaattagctgggcattgtggggagtgcctgtattcccagctacttggaaggctgaggcgggaggattgcttgagcttgggaggttgaagctgcagtgagccatgatcccaccagtgcactccagcctgggtgacacagtgagaccctgcctcaaaaaaaaaaaaaaaaaaaaaaggaaaaaaaagtattcctcaattttatgtacgtagttttatcatgaatggatgttgagttttatcaaaggctccttcagcatctgtggagagaatcgtatagttttcttccttagatctattaatatgcatatacagtagtgtgtccccgcttatctgagggagatatgtgttccaagacccccagtggatgccggcaactacggatagtactgaactctgagtataccatgtttttgcctatatatanatacccatgacaaagtttaacttattaatgaggcacacagtaagagattaacaacagtaactgaataaaatagaacattacaacagtgtaccgtagtaaaaggtatacagtgtggctgtaacttttgcartttaaggtgcagcagcaaaactagcatgaatttcttttgcctccttcacaattttatagatagaattgttcttaccatagagcttaggaactcaacatactgttttttttttctttccttacttttcacttaaaggaagcactttatggtttctctttggcatatctgcattgccagcatcacaccagcctcactgctcttgtgctttggggccattattaagtaaaataacggttagctgaacacaagcattgataccccnacagttgatctcataactcagagacttgtgggcaggtagtaaaacagtctggatacactaacagagggatgattcacatcctagatgggatggtgcaagatttcatcatgatgctcaggacggcaggcagtttaaaacttaagaattgtctgtttctggaatatttcatttaatatttttggaccttggctgaccactggtacctgaaaccttagaaagtgaaaccacaaataaggaggggactactgtaacatacttttaagtgtagcttatcattagctactgtgaagaacaacctggtgggaaaatagccctaactacttggtttactattggataattaagttgtatcttaaggatgctttgtagctaaattttaaaatattgtttctaaatttttaaaaaacaccactggctctggtagtttttagaataaaagaaaatcagcaaatatgagtgacatagaataacaaacactgagcaggtaaatgtatataataggagtctctagagcattaatgatccaggcatttccccaaagcagcattttctaacctgtgttttgtgaaccccagggatataaagtatcctgaggttcacttattttaatttgtcttttaaaaagatggtgagtattttcctttcaaaatcgattagtttgaggacttctgagggtatatgagcaagcatacatggcattgttggtggaaatcagtcacctgattatcattcaaccgaatgttgccaggcaccatggtcttcttgacttttaatttttcttaaagagaagataccagacatatgcagaagtagaccgaatagtatcctgtgcttccaggttcaataagcctgcttcagtgagtatcaattcactgccagtttcattactacacccttacctggctactttgaagcaaattcctgataccatatcattatatctgtgagtatttcagcatgtaaatctaaaagataaggcctcaattttaaaaacctgtaatacctttattataattaaaaatagttaacagtttcttaataacattaatatctactgtccaaatttctagttgtctcaaaaatgtcataatttttttcactatttgtttgaatcaagatctaaataaggttcacacatgtgattagttgctacatcttgtaagtttcttaatacatagcagtggttctcaactagatgagatttttgtctcccagggaacaccagtcaatgtctagagacatttttgatttgggagtggcagagtggttgctactagcagctagtaggtagagggcagggatgctactaaacattctgcactggttagcccccacaagaaagaatgatctagtctaaaatctccatagtgttgttgttgagaaaccctgatctataggtttttctttcaggtctttaaccctccccccgtccttgcaaactctttgttgcacaaagtggttgtttatcctaaaaattcccactttctggattttgccgattacatccctgcagaatctttttgcttctcactttcctataaattggtagttggctttagagaagcttgatcagattcaggtccccctaaatccccgaaaatttcacaggagagtggtgtagatttctatcaggaacctaagcagaaggcataaaatgtctggttgtttctctttttgtcatgctggctgccattgatcaatgccaatatccattcatggcagttgcagaatgatacctttatcattataattataaaatgttataactgataattagaaaatttctttttgatttgttacttgtactactataaagagaaaattttcttttatctagtctttggttacctagttgtacagtgtaggagaggcaaaattaaatgcttgattcttttccattatcactgattttttcagttaattgattaattagcatcctcattattaaaggatgagaaatatttaaaggaatataatttaatatgtaatattgagcaatatagagaagttgaaagacaaatatatagaaaggtccatgtttcctttgaccatataaactgtcattaaaaaaacaaacagaaaaatagaacaaaacaaaaacaatctggtaagagggccaggcactgtggctcacacctgtaatcccagtgctttgggagaccgaggcaggaggatcacctgaggacaggagtttgagactagcctgggaagtgtagcaagacctccatctctacaaaaaataaattagctgggtgtggtggcatgtgcctgtagtcctagctactcgggaagctgaggcttgagtgcaggaatttgaggcttcagtgcgctaagattgtgtgatcttgccactgtactccagcctgggtgatagagcaagactgtctgttaaaaagacctggtgccaggcatggtggctcacacctgtaatcccagcactttgggaggctcaggcaggtggatcatgaggtcaggagattgagatcattctggctaacacggtgaaaccccgtctctactaaaaatacaaaaaattagtcgggcatgatggcgggcacctgtagtcccagctacttgggaggctggggcaggagaatggcgtgaacccgggaggaggagcttgcagtgagccgagatagtgccactgcactccagcctgggtgacagagcgggacattgtctcaaaaaaaaaaaaaaaaggaaagaaaagcaaaaatcttactttttatttattaaaatatcctggatatctcagagagcttctcatatcagcatgtacagatatctcattctttttagtagctgcatagaattctattctgtggatttaccacaatttaactggtcctctcttgatggattcttgagttggtttctcttttgttcttactacttaacagtgctgcaggatatatatttttgtgtgtatgtttatctttattcttggcgagcatttgggtatccttatggtaagtttctagcattatccattttgaaattgtttttatctgtagtcataktttaaaattcatgttctgttgatcaaagacaagtgtaaagaacactgataatgaaatagaagtttgagcttaaatatwcaaatttaagattcttatttactggggctataagttgcattcatcttaacacaaaaatcaatgtcagagaaaatacagtgatcttatgtccagtttatattttattatggggaagagggataaaacagtctcaatgttttgttaacatattcttcctttataatttagaaatgccatttttccttgagcacaaaacataggaatttcaaacatctaatatggactcctgtttatcagttagtaatttttttttttttttgggagactgagtttcactctttttgcccaggctggagtgcaatggcgcaatcttggctcaccacaacttccgcctcctgggtttaagcgattctcctgccttagcctcccgagtagctggaattacaggcatgtgccactatgcccggcgaaatttgtatttttagtagagatgggatttctccacgttggtcaggctggtcgcaaactcccaacctcaggtgatccgtctgcctcggcctcccaaagtgccgggattacaggtgtgagccaccatgcctggcctatcagttagtaattataacagtttgatgtgtgcagtaaaatcatgaagttgtgaaagctgggggaacttataccattgtagataatttggtatttttaatgtgcaaaaactgttgtcaggtgagtattcactgtttcacaaagaaactggaatgtggtccagtgtagaccttttgatatatacagtatcccttgaatactttaatattaataaatatcaaatggctcacgcctgtaatcctagcactttgggaggccgaggcgggcggatcacgaggtcaggagatcgagaccatcctggccaacacggtgaaaccccgtctctactaaaaatacaaaaaattagctgggcgtggtggcacacgcctgtagccccagctgctcgggaggctgaggcagaattgcttgaacctgggaggcagaggttgcagtgagccgagatcacgccacagcactccagcctgggtgacagagcgagactccgtcccccccaccgtagaaaaaaaaaacaaaaaaacgaaaaaacaaaactaaaaaagaaaataaaatggtcatggagatgtgacctggatatatttccattgtctggaaccctacagaatagttttaaaaaaagaacaaaggtcagaacatgaaacagttttgrtagcattttaactgagctggtcagtgatgtatgggaccactggtatccttgaaacaggggctttctggccagtttccatcaatggttttggaaactttctgtggggaccacatgggagtgttcctctccaaggactgggtttgtgggttcatgggtttttcctcttctgtgtgaactgccagagtgcctcacttgtcacatatgctacaatgtagacatgtggttagtcttttttactttattactttttgaaggaatcatgggttgtaaactatatgcagattataggaattttatagtctttttacgtaatttaacttgtcacaggtctgattcatattcctctcttacattcttcctatttcggtacttttttgaaggctaactttgtgtgcctgttgttttgagtcagtttcttttttgtgctagcctgtccttattttctttatatcaaaggatcaaagttttctttggagcccatggtgactgggtgaacgcagtccyttctgtttggttcagggacatctttcctcttacctgcttttccaaccatccaaatgccaagtagtcagcgctggagtctactccctgaatttttctcttcttatctttgcctttgtgggcatccagcctgtagtagaagaggtcttatccccagtctgaacttgatttttcagttttctcattctttaccccgtaagcaattgattattctcttaaagctccaaagtcttacaccactctccctcaggatcacttgttggggccacccatctcttcaggagtgttaccacctcagccctaggggaactgctacttgatttaccttggtattacatcctgataagcccatcataaagttgaaaaatcctaaatggaaccattgtaaatcggagactgtctgtcctgtgcttatctcttgcaggtctgcagagtgttttgttttgcagccctacccctnaccccagggcagctgctgattcagtcaccacctcagacattctaagaggacagaacaaagaaagaccctgatacaagcttcttaggacttcaagtaacgttaggatatgagtgacttttcttccctttccttcctttcctctccactgcatcagtgattttttagtttcatttaccaccatcacatttcaggctttcattggcctctatcacagtttctgccatatcagtgtaacacttttgttgcttatttaatatttttctttaaaactgctttaaatggattttatttttaaaaatttacttgccttaaacagaggtgtctgctaaatcgtgttagtgatgctcacgctacattttaataggtgtaagaaaatatgtatttattgaaataaaaaatattatctaaaatgtgtacctataagattgtcagaagggtaatgatgattgataggctagtagacacagagaaagggtacaggttttttttttttttttttttaatggaagtcaaggattgaagaacttaaataagcaaatgagaatggctatacaaagcaggaggcttagtagaatttgtcccactggcaggacaaacttccctggccttcaatttcccataaagctgccctgttgccagtgatatgctgattgcatctggatcccatcaggtctagccattcttgtggttatatgggtcctgaggtcctyttgattcctccctattttactggtgacattgcctgttccagggatgtgagaaactgcccacagcctcaggacggtcctcagtatgaatggcaagattgggtgaattgatgatcaacttctcaggaatctcatcttcctaggaggcctcaagcctgcttgaagtctgttcctccacatatgcataacgcgaaaaggcaactgctaagtcatatagattgtggtctttgctgtagttggaaattatctttaggtgtattagatcccatccactcatccattcaaggacctggcttcaacagttgtatccctacctcaccatttttttttgttagcatgccaattgtaygcatatatcctttattttaatttttaatttttatttttttctccaatatggagttttgctctgttgcccaggctggagtgcagcggcatgaactcggctcactgcaatctccacctcccgggttcaagtgattctcctgcctcagcctcctgagtagttgggattacaggtgtgtgccaccacgcctggctaatttttttgtatttttagtagagacagggtttcaccatgttggccaggctggtcttaaactcccgacctcaagtgatctgtccaccttggcctccccaagtgtgggattacaggtatgagtcaccaagcccggcctgtatcctttattaaaagaaacaaacaaacaaacaaaaaacccttttcttgactgacatcccttttcagctgcagccctgtttctttgctacctttgtagcaaaattcacyaggttgttcctacttgctgtttccagttttttggtttttttcctttcctaggaaatgagaggtcccattttctcttgtactcaatccaatcaggctttcattgttaacacactattgaaacagttcttttcaaagttatcagtgagcatcacttaacttggcatctggggaacccctgtgctgattttccttctgctttgctacccctccttctcagttcttaactgcaattscttctcgtctccctgatcttttatggctgggtaccccatggtaactcagtagtttttccagcgctcacctgttttctttcgtagctctctcccctgagctcaagtcttgaatataaattgccaactttatatctccacttggatgaatagtaggtaggccaaccttgagtgtatgcagaatgaaaccccacgactccctcccttcttgatcagaactgctcctcctgtagtcctcttcayttcatttaatggcagtccttcgtgttgttcagggcagaatctttagagtcatccttgatgcttctctcataatctgcactaaattatttggccaaatcctgttcgcttaccttcagaatctcactactactggttgccttcatcactatccttgtgtaagatgggcttattgaagtagcctcctaactggtccccctctgtctgccctccagaagccagagtggtgcttttaacatgtaagttgtaagtcaatacttaaatgaactttagtggaacatttgtcctcttaaggaaaacttctctgaaaattccctgctcattgccacaatttcttcctttctttttaaatagttcctgaagtacttctttctctggggaacatctcttaagattgctaagatattttaatcccttttgcaggaaagactattgcccttttcccacctgcttcaacatttcaattattattattattattattatwtatttatttatttatttatttwttttttgagacggagtcttgctctgtggcccaggctggagtgcagtggtgtgatctcggctcactgcaacctctgcctcctgggttcaagcaattcttctgtcttggcctctcgagtagctgggattacaggcgtgtgccaccacacctgactaattttttttttttgtatttttagtagagacagtttcgccgtgttggccaggctggtctggaactcctgacctcaagtgatccacccacctcagcctcccaaagtgctgggattacaggcatgagccaccatgccctgtatcaattatttctttgtttgttaattgattaattagagtcttaatctgtcgaccaggctggagtgctgttgcatgatcacagctcactgcagccttgacctcccaggctcaagcgatcctcacacttcagcctcccaagtagctgggactacaggcatgcaccaacacacccagctaatttttaaatatttttgtagagtcagagtctcactatgttgcccaggctggtcttgaactcctgggctcaggcgaccctcccacctcggcctcccaaggccagggttacaggcatgggccactgtgcctggcctcagtgttttcacataatggtgtagtctcataagagattcatggtagctgagcctaccatagttcagcgtaaagctgaggctaccctcagtggtgggacaaaaaaatccatcgattttattcatgtctttagaactgtcacatagtgagttgctaaaaataattatttttccctttggagaattcctaagatccgaagatggttcttttcctcctatacagctcaattgtggatttcctcatcaagttgaacaattttgtccttgatctttgttcagtaattattaaatattacccaagtattatttactgaacctgtacctatttacctgtaactatttattatgccattttgtgtatattcctattcagtgtttatccctrrgaggatgctgagataagagaatggagcagagggtgagtatgaagatgagcatatctgtacaggaaatgtgcaagttaagggtgtgtgcattagaggtttgcgagactaggcttgtacatatgcagcaggctctgtgggagccccacccggatcccctggctttctctatttccatctctgtctctgtctctgtgaaatacttcttgctgaaagcacctgatacttggtctgagggcattctctagctgcaggagctcagcagcttgtacttgaagcaggtctgaaatgctggggcattatgcctctgggatagccctcagccattatctaatgggagatagtagataaatacctagcttcctctctccctttgggtgggacctttctgaagccccttatacttagtcttccaaatgtccccagggctccctccctttctgtgtctcacttttccattcacttaccagtgcttccatggatcacttcccatctgaatgcctgcagtcctgtctcaggttctgcttatgggggactccaaccttaaaccagtaggtaaattgttaatgaaaagaargataataagcaagagataggggatttgaaaatagagtttggatttcattgataacagatttttcacatgataatcgtgtttgtgtattaacgcctgtgtaattatgtgatttcatttacctatgtctgtgtgcaaaatgtattgtgaacatggctgtsaaagtagaatatgaaagctgctttcttactttattgaatagttctctggtcctgctaccttcaaaaaaaatacactgccttgaaggttatttgtgatatgattttaatttgaagctgtttgttgctgtcttatttctcccttcctttagaatcccttctttttcaaaacactagaaacctcccattatggtaagtaacctttagcatgaaaactgttgcaacgaagtgttaacatttcacagattaattggcatataagaaaactagcaaccactttaccatcgttggggaatgatatggtctacatacataagattttcctataactgatagttctacttgtgaaatgtaactgtcctcagaaaagttactcaggagattaaactgctttaaatagtgtagtattctttcaagaagagcatgtctgtcaaaatccttctaaaaatagttggcatataattttgttgactaagtatcacggaccttagttatcttctgtgccrtgtgggctgctggactgtttgtgcaccagattgccccacaccagtggccatttatcgatggtgttttatctccttccttgcgattcttttttcctgttgcctgttagtctgctttgaccagttcccactgtctcctaattttgttttcttaactagagcaaaacaagatgtccacatgggattaggcaacaggtcttcttaaattgcccactccgtattctgatacactggtgacaaaaggatgaccctagccaggaatggagtcaagctgtgcaaaagggatttggcaaatatcacttaaataaacctggcagtcagggttggaatttttgaaatcagagtgcttgtggtgctagattatacctttgaattcttaccctaggatagaagctatgcctggtgggtaaaggtagccctggcttccaggtaatcttatctagaagaaaatcatatggctggcttagagatatgttatatcttgcttcttatgtaggtcttgtattttgatctacataagaagatttgactcagtcattagacttcagcctagaaagtgccttacaaatacttgttaattatgttgtaataagggtaattggagacaaacaatttgtttgtttcttttgaggttaaaaagatagttttagaaagttttagtgtatgatcagttattgacttctttggttcatatgtattcattaacgtgctttgttagtagtcagtaaatgcttggtaatgctgtcaccattttagtctcctgtgttgataaaggggtggttttactatacacttggtttattggtactttgtaccaattgtaaaattgcaaaacattaaaaatgttttaattttgtaaatttaaatcataaagttgtaacacttataattataaaaacaaatttataataaactcttcatagctgatgagtctgaaaattagcttctaaggcaattttccaaggtggaaaataataacccatgaagtgttttgtggggraaaaaaaagggagagagagagagaaagacccgaggttgggtacagtatttatcacttatgcttgatccccatcatggaaattgaaagtgcttgttaacttgttaaattcactgagaagtattgctggtaaatgaaggtgattcgatctcagcccagtgtctcccttatgtttctcttacgaactgtggaatctttttgtgaataactttgactcctgcaggacactgttttttgtctttttttttttttttttttttaattttaagagacagagtcttactttgtctcccaggctggagtgcagcggtgcagtcagctcactacagcctcaaactcccgggctcaagcagtcttcccaccttagcgtcctgagtagctggggctacaggtacatgccaccatacctggctaatttttaaaaactttttttttttttgtagtgacgggggtctcattatgcccaggctggtcttgaacttctggcttcaagaagtcctcccgccttagcctcccaaagtgctgggtttttagacatgagctactgtgcctgtccaggacacttttaaaaaaaatgttttttaagggaatgctgtagagccagtccttgctttgcagggttctggtgtgcactgatttcagttaccattagataacaacactagtcacccaggattcaaatttcagtcaccatggtgtgttacctatgaatgcataagtacagactcttcagtatgcagatcagaaatcactgcaaaaataacaggcacgcgtctgttcttcagtttacacgcagacaggagagcatgttttgctgcctccttgcctctcagtaataaacttacatgacctattagcaaaatagayaatcgaaagtgggaagtggccagtaaaaatgaaagagcaacaaagaaacaaaaaatgataactctggaagtaaaatccaattgagcataaatggagtaataaaataagtaactgacagtgggaacgctgccactgccgccatttgcggaactctagacaggcagccagaggcacttagtgaaggcatgctaaatggcataatgttttaaattatagtgtactaaagaagtattagttttactgttttttcatttctctgtacattataaccaacagtaagagagttcttaatgctttgacaaacatttttaaagttcaccagaacaattgtgatttcccccattgattattaaaatcacttggcatgatttcagcttgtgtgattacttttttttttttttctttttgagacggagtctcgctctgtcgcccaggctggagtgcactggcgtgatctcggctyactgcaagctccgtctccygggttcacgccattctcctgcctcagcctcctgagtagctgggactacaggtgcctgccaccacgcccagctarttttttgtattttyagtagagacgggtttcactgtgttagccaggatggtctcaatctcctgacctcgtgatccgcccgcctcggcctcacgcatggttacttttatggtcctgcactaccatgcaaagtaaggaccgcctatattttccttacatttgcctgtcatcgatcacgtgacctttagtggaaattaagaattacaaaatggccagcactttgggaggccgaggtgggcggatcacgaggtcaggagatcgagaccttcctggccaacatgatgaaaccctgtctctactaaaaatacaaaaattagctgggtgtggtggcgcgtgcctgtattcccagctactcgggaggctgaggcacaagaatcgcttgarcccaggaggcagaggttgcagtgagctgagatggtgccattgcactccagcctggtgacagagcgagaccccgtctcaaaaaaaaggaattacaaaatggactttgaggaacctataatgacaaattatcttttgaagggatccaacatgtgaataggttaaaaatccttcttacactttatgtactttacatattgccctgacttgtatgtttcgaaatagaatggtccagtgcttgctgttgacctttcctggcaactcagcgtcacctattttgctattgatggatacttctgatttgtaattgtgttggatttctttttttttttttgaaacggagtctcactctcgcccaggctggagtgcagtgggatgatctcagctcacactgtaacctccgcctcccgggatcaagtgattctcacgcctcagcctcccaagtagctggaattaaaagtgtgtcccaccacggccagctaacttttgtatttttagtagagttgggttttgccttgtcgcccaggctggtcttgaactgctggcctcaagcaatccatcctcsttggcctcccagagtgctaggattccaggtgtgggccaccacttctggccatgtattaaaattctttgaggtctctgggtcatatataaatttccacgtaggatgttgttaccagttatgtcaagatttttgtggttcagacccctactgtaactcgtctttcatcaagaatgaaaaagcatactaaggatattaagttctccttagaatgttgccttagtttctgttccagcagagaggcctttaatatgaatgctttctcttggcttggcttggtttggaatgtgtttattccccttagatgcaggcactgaagactatttatgagatgagaaaggttagtaggaaaactagatctacttgatttgccttagttgactcttgtccattgtagttgattcatcactaagtgtcctagatatatgtttttgctattatcttttatcccaaggtatgatcttttattcctgtatatattcaatcttctgtaggtttcattaggccctagaaaatatagctttcccttctgtacttgcaatgggaaataaaactgtctgctggattggagagtttcagatgcttattcattcatcttttaaagatcctatttatttcatttataatccatttgtcttcttcttttactgacattccaaatgtcagattaagatagggacatttaggaactacatgaaaggaaaagtaaatgggcataatatatacatttgtgatgaatgaagaccttttttcctgtacaagaggattatagttgcctgaacctaaataatcaggaatactgtgtcctttktcattgaaaaaggtatggacatttcagaataaattcttgaaagaaaaaaataatcagttctgtactttccccctcacattcattttctatccctttatatttgcaaaatttatatttaaacgggctccaagatggtagcccaagcgaatgtctccctgatgttcttggcattcctgctttgtgtcaatcagtaaatattgtgtgagaatccactatgtaatcagctttaggtagatctgtgggcaatgggaaattctgaattaaatattacccatgtctttaaggagcttaaagtccaacgaagctttcatagaaagtcacttcctatgaaaatttggtgtcgcactagccatgatgctagagttttagatcaatagttcctcagtgccatttctctgctgagattgctgcaaaagaatcacctggggaacttgttaagaacagaggttattgtggccgggcacggtggctcacgcctgtaatcccagcactttgggaggccgaggtgggtgtatcacctgaggtcaagagttcgaaaccagcctggccaacatggtgaaaccccatctgtactaaaaatacaaaaaattagctgggtgtggtggctcatgcctgtaatccttakctactcrggaggctgaggcaggagaattgcttgaacctgggaggcggaggttgcattgagctgagattgtgccattgcactccagcctgggcaacaagagtggaactcgtctcaaaaaaaaaaaaaaaaaaagaacagagattattgggccacactcattaactttccctgtagagcaaaggtggggctcaggaatgtgtttttctttttaaaaataaacaatgtacactgctgatttcagaaggtatagagaaggttctatggtgaaaagcaattctcctcttctccattctatatccattcagttttcttttcccagaggcaactgctgttaccaatttcttacatgcccttccagacatataccttgcatttacaaacatagggatgaggggatcgcatacaaactgttacgcacctggcttttgttgctttacagcaagcgtatcttggagatctttccatattcctacttacagagctgcatcattcttttgaaaggctgccgtgtagaagcttatagaagcttgtaggggattctaatgcatagccaggtttgggagccacagatagactgagtgttaaagggatttagaaagtttttagtgtgttaattccttatgtcttgcatttcatgaggaactggactcagtaaacatttcattgtacttctaggtactaacaagtttttgtataatgtttcttcttgtagaattcatcagtcaaaaatagtgacagtagtagggtgtatatatttctttattgatgagaccctgtgtggtggtcaaagctgctagaaacaggaaggttttcccattttccatctctgggctcaaggtgcttagtgctgtttcacctttccttagtgttaagggaggtgggaatggatagagaagaagacagaaagcaggtagtaaattacaccataaaacttgctctgccaaaggaatcatttttctctacgcgactttcactctaatacctatatttaagagaggcatataaatattcacatgtgttgtagaacttcacatacatactgttatgtatatacacacttcagatatatattacagatagcatacttcttgcctttgttaacttaaaaacattgccaagcaaacctttatgaaattgatactatttatcatcatggcaagttttttcttccctaagatgatttacaaagttcttaccaaattctcacatcatattcattttgggatgatatttatttgctgtatcacagtttataaataaaagaatagtctttatctccacaaaaatagcagatatactgggcactgtttgtatcctaatttctttagtctgtgtagacattcctcatacccagccaggtaggcagaaagtaggctgaggaataagagagtattaacttgagaatttcactgtccttttcaccacaggacagtgaaaagtaaatatagttagcttcttgaatatttcagaaatgtaaagcacctcctccttctttagaacattctaataaaaattattaccttcatgaaataatgatttgtgcttatttgtaaggatgcattcaccatttgcattgccagttactctgtgtccaagatgtcaggcagtaaagagcaaaataacaagcatttatgtacttgaagcaaataatgtatcaccatacaaatcatattgatgtgcatatttcacatattcattgtgggacagatttaattagaagcttgtcaacaggatttttagctttttggggagtatgttttgtaccactgagtgcacatcttggctcttcaacctaattttcctctcatgttgtttgatcagttcctttttatactgtctttctcccttcacccttattatcatagattcttttaatcagctggttggaaataactctggaagccctgggacagttggaagcatgagccctgctgttggaggtaggaaaagtgaaccataagtgaaccttaagagatgattgtgaaccaaaggaatttggttcagagtatgcatttacttcagaccccttaagcatatagtatgccactaaacagctttaatgtgtcaattatataatcttcacaaaagtggaaacataccatattcaatttatgaagaaaccatttaattttgtgaaaacagttttatgtcagcaagaaaataatagaagttgggtttttctgagccacaaatttaatcatacattaccagtttgatttttcactggaaataattcatacaaattataaatttttaccttagctgatatctggtaataaagtgatctgtctcagggttaaaacattgtataaaackattaacaatttaaaagtgaaaatgcctattggcatcctagtatttttagtaagaatgtcaacttattaagccaattaataagccttatttttactggctagcaacgtaagatttttggacaacaaaaccattgttctacagtttcattctaagcattttatgtatattaattttcttaaaaatcctttgagggggttactgttactatttcccatctttacagatgagaccaaaaaacaaaaaacaaaacaaaacaaaacaaaaaacaggtaaagtaagttacccgaagtcatacagcttactaagcggggtagctgggattctaacacaggcagactgactcgagagagagagatttttctcaactccaccatctaaaattaattaaaaatagaaaacaaattctctcttttttttttttttcttgaagcatagccatttgagtgcctggtgtgtgctctgaagagaccttattgaagaaaaaaatactaagcccaatcataaaagcctagttcctatttgggctcaaacctcgtagctaatamgctgttgattagggcagtgttggctgactggaacctggtagagacatgataataatattaatagctgctgtttatgacttagtatgtttactgtgccattgcttactataggcttagtcccatgctttacatactgacatacattgtcctgcttaatctcaggggaacgcctgctcctcaggcagattgagaaacctgctccaagtcaaaacaagtagagctggaaatcaaatcaagtctttctaattctacaatctatgcatcccattgaagccagttgatatgtgtttatccggtgtcatggaggtagtagactgaggataccttgcctctcctatagctgtctctagacctaaactgaccccagaatcaagataggaaaggaaacatgcagagcaagctgtcagctatcctctgtattcccggagttaatttacctcaaaggccactccccatcctcctttgttagtgtgggactttaggggtacacaatgactcagtcctctgattatgtcacatgtcacagtgaagaaaatgagtagttgggtgctttggatgagaaggtgaatttctgatacacaggtgaaaacttgaagcaaaatttccratatataaatctcattaccacagccttctactgtctaaggaaagatgaaagttgtactttacatgttgaaagagctttccgtttttaccagctgttaagaattttaagaaaattctttaaaaaattcaaaccgaatagaattttaaaaaattttgccacaatatattagttttcaagtaagtttgcagcacagttaatagtcaacaaaaatttactgtgatcatcttgtacttggtattgagagagaaatcttaaagwgctcagttcagggaataggatataaaaattgctcagtattaaacaatgttaggccataagtcagtggaaatgtgtttttttttttcctacccttttggtaggaaatgtgtatcagtaaaatgttgaaggactttctgtggtgtgatcaagtaaagtatcatcaaggaggaggaatttggggctttgaagactaggtagtgtaagatcrttcagtgaagaatggggagagtatctgaagcaagaggaatatctaatgaagtccacggacagtaagatctgaaagartttggccacccactcttctaacaccaagagtagagaatataaatgagagtgttatccgagaggaaaaaagagaacgtttggctgatcctagggaatttcggttagtcattaattcaattcagttctcatcaagtgtcagaaaaaaatgccagctaagcaacaatttcagaagattaagacaatggaaagtgctaaagttgtcactgccccactcaccaaatggcagtgaggctgttctatagatggaagctattcagcaaaggtcagattgtcaccctgtaggaaaacacctcccttgtgccctcacacacaaagtggtctaataagctaaacattttgcttttaggaaaaagtgtcacagtctatatatgaaggaaagttttacaagagaagtgagtggaagagactaaagaaggttatgtgccaggtttgaaagtgatccttagaaaatttgctttcagagttgtgctctttgtgtgtcctactgcatttcctcttaacatatctgttatagctatcatgattctagcaattttttagtagggaggcagtgagtgaaggatggagtgggtgataaagagagtagggagaagttatgcctccctctgagagagaaacggaagtgtaggcagtagttccttttggttcctttcaaagacctgagataattcttggtttaggaatgttaactttttgtgtttaattttattttttaaaattgtattttgtatggttaatttaaatggactgtttttcagatgtactagtttaccagatttcatgtttttattgatatatcaaatttactgttgtgttgtgttgaatttcaaaataaatggagctatgaatgttttaccagttgattagaactggcccaaacctgaagccttcactgacatttcataaaacagattatatggggtgaggtgggatgacaagtagacactagagagaggaactcatacatcattgaagattaatagtcatgttcagcccaaggtgttcttaactaattgaaatgtccctttctccccttttttccctaaccctcatgggagtcattctgatttatgtatcttagatgtcatggagagtttatgatatgctggtttaggtttttcaggacacatctaaacattttttttctctaattcttttggtgtcacagtcacttcttaggagtgaggaatgtggccatggtcaaggtgagacaagacaaactaggggtttctatagaaaaagtgccaacttggcatctgttaacattgagtttctgttttggtgggagtatagtacctatttcttttgacacttaatgaaccttgcatttaaaatcagggaagtttggttttgaacttgttttattgaatgcagagatagctctcatgcatcttttcacttatctgcagtgatctttttgttgccctttagccacacactgtttccacacttggatcttatcactgttatagatgatgctacctcggaaatgtcagattctgaacattctactctttgggcataatctcgcctccttataggtcagttgctcaaggccttccacggactcagtgctgggagccattaagacccctcagatcatctcaccattttctcactaccttccgtcttcacatcttttttgaccacttacatttcacgggtcatcctttaattcccttgtaaatatcaggaactccttttctggtctttacctacaaaaaccccaactctggatgaatccaatttcctgctctgggtctgcaccacatgggtgaacattgttgaaaaaaaatcacataaatacataggaatggttttgtattaggctgtttaaatggttttgtagtaggctgtttttgcatcattataaagaaatacctgaggctgagtcacttatagagaagaggtttaattgactcatggttctatggctgtacaggaagcgtggtgccagcatctgctcctggtgaggcctcaggaagctttcaatcatggcagaaggcgaagggggagtaggtgctctcatggtgagaagaggtacaagggagtgggagggaggtgctatacatttttaaaccagatctcatgagaactcactgaccatccctaggacagcacaagacattcctgagggatctgcccctatgacccaaacaattsacaccgggctccacctccaacattgtggattacgtttcagcatgagggtgtgtgtgtgtgtgtgtgtgtgtgtgkatggtggggacagacatctggaacctcaggtggatttggactctgaacactagctagcaatcttattgtgtttcttagtctttcgttctacagatcaccccttttatatttcctttcctcatacctctctacctttttccatactcagctgagtgtctcacactaaacttagctgagaaaagtagaagcccttagactgtagtatgaagaccagtttatctactttttcttttgtcccgtgtgcttttggtgtcagatctcaaaacccatattctgatccgaacccttgaagacttactcatgctttatttcaagagtttatagtgttagctcttacctttaggtatatcatccatctgagttaatttttgtatatggtgtgtggtagaggtccaaacacattcttttgcatatgtatgttgtctcatactatttgtagaacagactcttctttcccctttgaatgatcttggcactcttgccaaaaatcgattggccacaaatgtaagagtttatttctggactctcagttctattcggtgtgtctatccttatgccagtaccacagtcttgattaccatagctttgttaagtaagtttgaagtcgggaagtgtgaatcctccatccagtgattcttaaccttttctttgggttacaggaacctttttgagtttcttataagaaactatggaccaagggaattgtatgtaaagatatatacaattttgtataacatttatttattgaattggaaatttatagtctttcagttaaaaaataagtttttaaacaattagcatattcaccttttgctttctatgggaaaagtgatgtaaatccaaattggacaaataaagtaaacttatgttctactcaaaagcaaagtgtaatagcttgatttagttatgtggattcagtattcaagcagcaatgtcatgttatttgttgacatcttttggttttgaccttttgggattgcagcaagctctactcaagctctcaaagactttacagtagcaagtgtactagagttctctcaggtgagagtaggcttgtttttgcatatccggaggtctctgatttattgcttttgatattttgttgtagttattagattaatacatttcaagatttttgtttacctaattttttacatggttgtgggtagaattttaattgtgaaatttagtattttaattgtgtattgtgttgtgtatttttatttagtattttaattgtggaataatagaggaaatgtgtctaaaacataaatctacagtttaatcaataattataaaatatacacccatgtaataattgtctagaaccccaggacaccacctgccatccttttcagatgacagtcctcagaggaaaccattgtcctttcaagatccatctcttccttgtttttttaagatagttttattatccctaaacagtatacttcggctttccctagttttgaattttctgcatacatagaatatatcatatgtactcttttatgtcttttttttttttttttttgagacggggtcttgctctgtcacccgggctggagtgcagtggcaccatctcggctcactgcaagctccgcctcccgagttcatgccgttctcctgcctcagcctccgagtagtggggactacaggcgcccaccaccacgcccggctaattttttgtatttttagtagagatggggtttcaccgtgttagccagggtggtctcgatctcctgacctcgtgatccgcccgccttgattaacttgtagatttcattcatttattgtatgattttttttttaatttgcattaccatatagatttctgttatgagaatatactgtatccattttactatttatagacttcacaaataatgattctataagcggttttgtataggtaggtatcctggtgcacatgtgcctgagtttctttaaggtgtgtttacctaaaagaggatttgcttggtcattgagtaatcatagaatatttgattcttcagttttagtgcagaattgttttccacaatggctgtatcagactatcagtttaaagttcctattgctctacatcatcttcaacacatggtatcatcaggctttttagttttagctggtctgttgggtatgttgtggtatttattgtgcttttaacttatatttcccccagttacttatgaggttgtacacgtttttatgtgtgattcaaccacttagagttccttttatgatgtgcctatccgagtattttgttcatttttctattggtttttttttttgtattgatttataggagttcagtatattctgggtataattcctttggtggccacctgtattgtaatgtcttctgctactctggcttatcatttcactctttatagtttaatgaataggagtttattttaatatggctgaagttatcagttttcccccttatggacagtgctttttgtgttttgattaagacagtccttcctgtcataaagtcataaagatattttctatattatgttatacaacctttgtactttgtgttttatgtgtgtttaggtttatcatctactttggaatacatttttatgagatagcaaaataattttattttgcttcctttaaaaagatatataaatatcttttatatatatatgatatataaatatctttttaatatataaatatatattatatataaatatcatttatggatatataaaatatcaagcctattttatataaatatattttacataaatatgtatgtgtttctttttatcttaacaaagatatatatctttctttttttttgagacagagtctcactgtatcacccaggctggagtgcaatggtgtgatttcggttcactgcaacctccacgtcctgggttcaagcgattctcctggctcagcctcccaagtagctgggattacagatatgcgccaacatgcctggctaatttttgtatttttagtagaggtggggttttgccatgtttgccagactggtctcaaactcctgacctcaagtgatccgcccacctcggcctcccagagtgctgggattacagatgtaagccaccccactaggccaatatatcttttttaaaataaaaagatacatatatataagatattgatatagaggctatataaaaagtgtccaggaccttgtattgaaaagtttattcttgccgtgtgctcttccgtgcctcctgttacatatgagtgcacacatatacatggatctggttttgggcactggcatctgtttcatattgccttgattcctagagctttaaaataagtcttgatacttggtagagttttagggtggggggggtttgttttgtttttgtttttgttttctgtgaatgctttgagtattcttggccctgtacatttccatattaattttagaaccagcttgtcaggttccaccgatcttgattggaattaaattgaatctataaatcactttgaggagaattaattaatatctttacattattgaacctcaaacccatggtcgtggtgtatatctccctttatttaggttttctttaaagtctctcaataatattttatacttttccctaaagaagctttgcatagtttttgttaaatttattccagtgtacttgacatttttatgcagttgtacatggtatttcactttttagctttatattgttggtttatggaactagaatttttaatatactaatatttagcaatctttttcttgattcttatgatttctctatagattcttttgcattttctggatgtgtaaccatagcacttgcagatgacagctttttttcctaattcctatgccttttaattcttttccttattttactgtaccagttcgatcctccagcacagtgttcactagaacactgaatagtattcagtagtaatagcaggtattcttgctattttttttttttttttttgagatgaagtctcactctgttgcctactgcaacctctgccgcctgggttcaagcaattctcctgcctcagcctcccaagtggctgggattacaggcaccggccatcgtgcccagctaatttttgtakttttagtagagacggggtttccccatgttggccagactgatcttgaactcctgatctcgtgatccacccgcctcggcctcccaaagtgctgggattacgggtgtgaaccagcacacccagctgctgtgttcttaatctcagagtgactggtttcatgttatttgcataggatgttttagaagtatccttttccagattatggaagtatcctctaagcttgctaagaggttttgttatttactttttaatcaaacataaatgttgaattttatyaaatacttgtcctgaatctttttaaatggtcatatgatatttttcttttaatctaataatgtggtaagtttcactgatttaagatttttagtgttaaaaaccaccttgtattcctgggatagacccaacttgatatttgcatctttactcataaatgagggtgacttataattctttccaagttttggtaccaaggttatgctgtcattaaatgagttagggagcaaatccttttttcctactctctggagtaaatttgatataatattagatttatttatttcttgaatatttgatagaacttgcatgtgaggtcatctgggcctggagtcttgtttgtgggtcaatttttaaaattactaagtgatcgttcaggactattcaggcactctatttcctcatgactcaggtttgcccatatctaatattttaaatctcttagcatgaaattgttcataatatcctcatttatatctaatgtctttaggatcattcctaaaatgggctatgccttttctcttttatcttggccttgctagaggtttaccagctttgttaatcttttcaaagaatcaatttttgtcttcaatgctgtattacgtgttttttatgtcattgatttctgctgtttatttttccttctatctgtttttaaggtttttttgtctattctttttgtaacttcttgaggtagatacatagctcattaatttcagcctctttttttctagcagatgcatttaaagctatatgtttctgtttacaagtgcttcatcccacaaattttgtcatattgtattatcattgttcacattttaatatgatttatcttttgattcattttattgacatttaataacagtgacatttacataatggttgaggattttatggcttataattgcagtatttctgatgtctctactgctgctaagagaggattactttgagtatagtatattctccctcacactcacttagcaagtttgtagagaacagaataaaatttatctttatatgtgtttctgtgctctacaaaaatgtgttggtgaggtggttgtacatttctcagctaaattccaaccactgtattatagttaagcgaagattttcaacttacttacatactgattttggtttcctttgtcttagctgtgttggagtagaagaacatcatgctgttgacattgacctgtatcactgtcccaactgtgcagttttacatggttcctccttgagtaagtactagatgcttaaataaaaatggacatttcagaaaaactgacatttcaaacttacatgtacatggtaatactttaatgatactctgaggagttntattacacccttcaagaactgtagggaaagattttgctcaaggtatttaggatgtagtttttgtttcattaagtcagaagattaaggggggaaatgtactgtcagtcttaattgccagtgcagagtccccaaactcaactacatagtttgatatctttcaatttgagaagtgtggtaaagtaaaatttttctgtttctggaaactgatttcacttgttttgctctcttcacaaatagaagatctttagtagtattttgggagagtatacagaataagactttaatgcactcatatgccttatattttaaggagaaaatgagagcattgataagctaaaatattacttatattttctgaatttggttgctgtattgagtatggcctggagtcctgcccagccatcctctctgcctgaaaccccttcctgagatctgaggaagtagagatacaaggacacaccagaccaggtttctgaccacactcttcttcctaagaagggagagcaaagccagggaagcctcaggcatcttttggagtggaccaacatcacacctaatatgatatctattttcagctttttacagatgcttcagaatcttttacaggtgcttcagaagaatacattgaaatgttgttattgtgcaaatgtgagagaaaaaggcttggattatgttataaatttttttttttttatttgagacagggtcttgctctgtcacccgtgctggagtgtagtggtgctatcatagctcactgcagccttgacttcctgggcttaagtgatcctcctgcctcaacctctggagtagctgggaccacaggcatgcttcactacayccagttaattttttgatattttgtaaagacaaggtctcactttgttgcccaggctggtctcgaactctgcctcagactcccaaaagtgctgtgatttcaggcatgaaccaccacacctggcctgtaataactatttgttttgacattttaggctgcagactagcatttttatattcacaaaattaaagggaaaattataggctttgtcattttaaaacctttgcctgaatgtaccttgatacacacttgggttggttttaggtaacttatatgacctctttattttacatgcagcttttttcctagtacttttttccaatagagtagacattttgttctattttttcaaaagagacttactggcaactgactgctcatttgttttgttagaaatattagtaatttttctaatatctttgtaagatacttaaaaatttaagctacctgcatacattaaaatatttccttttaaaatagaggctattccttttgttaagtawacagcataaaaattgaggttagcaaattgggggaactgttacatgtgtaattgactagtttattgtcataaatgtttttaaatgatttttctctggctagcactgagtatatgatatataacttgaaataattgttgactgggagtaactcttggagaaagtaaataaataatatgatgttatctcaagggagacttaactaaaatttatagcagttttagtttagaatttaagtatacagtcccaaaatgaaataatttgaatttaacttctatgaaatactaagtaagttactatgaggcagaataatgtgatacacttcatttttttctatatgatttaattttttwaaaaacatgttatactcactaaattgattacacaatccataatggatcacgacttmactttgagtaattatgctttggagagaagcttgcctatgcttctcatccctgaagaacataagaccaggcattgactatcttctggtcagacgtccaactctgtgtacttacagggaaaacrcccaagatccagtcatctgttctatctggatttaaggctcaccttccctactcctcaccttctatccccaacttggttaatcccttttgatccctttccctctgctattaagcttctctctttttttttttttaatttattttttattttttgagacggagtcttgtgctgtcgcccaggctggagtgcagtggcacagtcttggctcactgcaacctccgcctcacaggttcaagcaattctcctgcctcagcctcctgagtagctgggattacggttgtgtgccaccacacctggctaatttttgtattttcagtagagacagagtttcaccatgttggccaggctggtctcgcctcggcctctcaaagtgctgagattacaggcgtgagccactgcgcctggcctcttaggcctgtcttacttgctacctgggtttcctgttggtttcagagattccctaggagtccttattattgataccatttagccagtataataactacttcatatggtgaatttagactttaccctcttactgggaattaagaactctatttgagggcaggtatcaaaaaacagcccacaaataacttaaatatgtattctctgtcttctttaggcacatgcaatccaaacacaaaattttctcctttccctttaaccattactaaaatattccttcactgacctccttcctttaagaaattcaatcagctgttacatagtggctgattttatggttagcatgttggcccaacaggacaattgtatccttctgttaacctcctccaagtcagcacatttaaaaggaaatgatagtgattggcagcttattacatggtaggcactatagtaggtaagtaagtacttaacctatgttatcttctttgayatttataacaactccatgtgagaaatgagaaaaatgatctagctagcccttttatgtagctatttggcagagctggagtttgaacccctagcagtctaattccaaagctgatgcacttcactgattaatctcttctgcaaaaatgaaaattaactactggggttgctgagataggaggattgcttgagcccaggagcttgaggctgcagtgaactgtgattgcgccactgtactccagcctgggtgacagagggagaccatgtcttaaaaaagaaataaaacttaaaaatgcaatatcatactttacctatcaaatgggctgccttttttttttttttcttttaagtactgatgcccattgttaacccaggggtatgaaatacgcttcttatataatactagtaaggaaagtaagttactagtaccacttttttggagacagttttgtaatatgtagcaattatcttaaaaatgttggtcttttttctagcatttcttagaatttattctgaggaattaatcagggaaacattaatatatacaaacatgaatttcaactttgaagaaagattcagaatgaactaagtgcttaagaatcaaaaaatgattayaatatggtatatctacatcttaaaattgtagtctgttttaaatatttaataaaaagaaaatgctcattatataataagaaagataagcaggataaacattgtgatcccaattgaagataaaatggagttatgggctgggcgcagtggctcacacgtgtaatccyagcactttgggaggccaaggtgggcggatcacaaggtcaggagatcgagaccatcctggccaacatggtgaaaccccatctctactaaaatacaaaaaattagccgaatgtggtggcacacccctgtagtccagctactcaggaggctgaggcaggggaattgctggaacctgggaggcggaggttgcaatgagccgagatcatgccactgcactccagcctggcaacagggcaagactctgtctcaaaaaaaaaaaaaaaaaggagttatgtatctatatatagtagaaaaaatctggaatgaaatacactcaaatttaggagtgattttaaatgagaaaaaataacatgcaaaggatgttttaatggaatttcctaggaagtttgctttgtgattctaaatttttgtgagtttgtttttttttttttttaatgggacttacgctcttccatattgaagatttggctgccataagttacttgggaatcttgttttagactcttagatagttgaataagcctgatttccacctctgttaattattgtgacttcttatcgacatgaggacccaatgttgttgtattactgtgatctttgtaaggtggaaaaggtttaaaataacttggaatcataaagttgttttccccaaaacatattgtgaaaatgttcaaacatataggaaaaattggaagaattttacagcaagcacctataagccttatcatctagattctactattaacattttcattacatgctctaacacatatctatccatgtaactattctgctgtctacccatcttatttttttgatgcgtttctaaataaattgcagatatcagtacattttccagaatcatagaggttttaggcttaagagtaattttcaagcttaaaaaaaaaaaagatttaaaacagaaattgtacattgatacaacacacaagagctgtaggtagtgccactctgctggaaagaggaatgaggtccagagatcattccttggctttttccccatctcccctttgtgaagggttcttccacacagtttgaaaattagcagtttaatccaccccttcattcctacattgaggaatctggatccataggtgttaagtgacctgcccaagattgcagagaaagctattggctgaactaggaatcaaatccaaatcttctgatttcgattgctgtgactactcaaggtcatagccttccagagctgtagaattacagggtcttagcattggaataaatgatgaagttatgtattttgtcatgctacccgtctttctttaattatgactcagtcacctgctcttctttatgtcagtgtaactgtgcttatttagggagtaagtcttcacatgaaagaggaaggaatgatgctattagaatagatttctaatgtgagataaaaggccctgtcctgagaagacgatttggattatctggataatcatattaggacctaatgttctgatgaaaatcataattgtatataatttggaaattgtatagtatctataagtgtggacattataaaaggctccatctgctgatttgaatttgttgctttaattttatatgttttgaaataaaaagagtaggttttaaaaatccacagttaattgtctgtaattgcagcattacattaagcaaaattctcaggcctggaaatgcattaaaaacttgagtgtttttaatgtacttacaattgttatttctgattatgtcggatataatgattagaaatcacatagtatcaccagttaccaaaatcatttttttttaatcttttaaaaatccagtgaaaaaaaggaggaactggcacagacatgactacacagaaattgatgatggttccaaaccagtgcaagctggaactagaactttcattaaggaattacgctctcgagtcttcccaaggtatggaaacttactctgataaaagaaaatgtaagaatgtaagaatgtcgtctcatagagtgacattatataaaggcaatgttttcaaacttaggctgcaacccattattgtcctcagccagcttttcaccttttttcttccttaacgaaatagaaaagtatcagtacattccaagaaatagcagtaagtaagcatattttcatggaacttttgttacatctatgtgcacactgggtcaccctgtaaaaacatttaagtgtgggccacagtccaaaaagtttgaaatacactaatctgagggagttgttcccagtacttggttccttatgatatgcagctgctacctgttttgtttcttttgcctcaccttctcttgttttcccaactctgctttttctccattgcttttatatgcatctctgccctacatccaccagaagcacacacaaccactgcaggggtgggctttttgattttttaaaaaataatggaatatatttgagttgtctggctcaaagagagtggaaagcattataaagcatttaatcatgctaatttagatcatttcctactcactgcctgacatctatttcaagtgataatgcttaataggcttttacacaagatcatagtcaggcttgttaaagaggggaagcacaatttaaatttaaatcacagtatcacatgcagcttattatggaattatttcagatcctgaaacgataaaacccctgctatttctcctcagtctttagaattcctctctagccccctgccccttaatccttacgcagaaacatataatggtaagtatctactgttggctccctcaggtctgttgagagacagaaagaacacatatttaaaatgtagtgtttccacgtgatttttgtggtgttaaataccctattcgcaaatattcttttttatcagtttccaagttgtaggataaatgtttgcgtgttttcttttttattggctcatgcttgattggtttggcacctaggcccaaagttttcagtctgcttctggtggtgggtctaagagaggtttgtgagctccctaaaatggtatgtataatttagagtcagttgggagtgtccatttctcagggagaggagctatagctttcttttttttctaaataggtttctgacacaaaaatgtagtgttaaaaacactggcctaataatttatgtgactttactgcctgccagtgaccacaaatgagaacgggttatagagatgatcacaaatgtccaaaatgtaattaccattagttcagggtctttgggttttaatgccacaaagctttacatcatttcaaaccatagtagaatagcagtaattattaaattacacatgcttgatatgattaacacagaggtgtgtaaaataaagtgaatgaattatctttcccctcccctattttaagacttagtgtaagttttttgagacccttttctacataaaaacattaaaacatttatgtatatggatgtatggatatacataatattcttaaaatggggttatgttatgcatagtgttgtacaatttgccttttttactctattatgtttcatagatatccttccatatgtatgcatagatttgcctcactccctaaatgttgtgaggtatgtagtaatctataggtaccataatttgcttaaccgtccccatatatgtttagtttgtctccagattttcctcttgcaaaaaatgtacctatattttaaacacttgtcrttatgtatgtttgatcaaaaggggaaataaaacaccaaacatgtgagatcagggaatacaagtgatttaaaattctcccttagactgaagttgaaggaattatttaatcctcagaggttgggggaaggagggacaattgtggatgcttattggggaaactaagaggtaatacagagctccagttcagtagatgagtcaaatgaagaagaacaagattatctaggaaaggactctcagttttcttaggccttaggcttgcccttgccttacgagaggatgggaagatcagagcccagtaattcagagaaccagcatctcctgtcttcttgctacctaggcagcagatgacatcagatagttaagatctgattgtataagtggagactattgtgttttaacctttaaggcaagtgtcncacttaattttgaatgtgtagcagctgtagagcaattgggagattaaaaactggaatgccccattggaagagatctggtgggcaaagggacaaactccacttatgttaatgtaatgcctgtaacgtgttgatcatcagagagggcaactggagatccaaccattcttggcttaaagttactacctagtattaagacttactaggcctggcgcggtggctcacgcctgtaatcccagcactttgggaggccgaggtgggtggatcatgagctcgggagatcaagaccatcctggctaacacggtgaaaccctgtctctactaaaaaaaacaaaaacaaaaacaaaaaaattagccaggcgtggtggcgggcgcctgtagtcccagctacttgggaggctgaggcaggagaatggcctgaacccaggaggcggagcttgcagtgagctgagatcacgccactgcactccagcctgggcgacagagcaagactctgtctcaaaaaaaaaaaaaaaaaaaaaagacttattaaatactggttgtaacgggtcatttaaatcagtagttgtcaatgggagcattttggacacttgtctcagtgggtggggaccagggatgctagtcatctttcaatatgcagaacaagaattaattgttctatgttccattagactttagatagttgtgtagaattttatagtcagataaaatctgactcgtttttgttttttattttttatttatttatttttgaggtggagttttgctcttgtcactcaggctggagtgcaatggtgagatctcggctcactgcaacctccgtctcccaggttcaagcgattctcctgcctcagcctcccaagtagctaggattacagatgcccaccaccacacccagctaatttttgtatttttagtagagacgaggtttcaccatgttggtcaggctggtctcaaactcctgacctcaggtgatccactcacctcagcctcccaaagtgctggaaattacagacatgagccaccgtgcctggcctgactagtttttattctaatgcacactctaccttttgctctcccaaatttctacgcatcctgtatcaagtggcttctggtgtttctacttaacttaaatctaaccgttcattacaactagttgtaagcatcctattattttatgatgtcttctagtgtagtttacatactaaaatacaggttgagtatcccttatccaaaatgmtaaggaacagaagtgtttcagaaatgatttcagattttttttttcttttggaatatttgcattatacttagcagctgagcatccctaatcggaaaatctgaaatgctccagtgagctcttcaattctcaaaacattttggattttggagcattttagagtttgtatttttggattagggatactcaacttgtacatattttactataaactggttggttttttctttttgcatttagaccagtttatatatatttctaattatatgtattgaattgtgtatattacattatctataaattttagtttaggatagcaaaaggagatttacaaaacatttgtcattaaaagaatgagaagtgataggttaagaaccactgatatagataatccagtatatgaattaacccatcactaccgtattttttttaaactgaccttaccaataaaaatgacatttttattcttatgtttttccttagtgccgatgaaataattataaagatgcatggcagccagctgacacaaagatatctggagaaacatggatttgatgtccctattatggtcccaaaattagatgatctaggactcaggctcccttcacctacattttctgtgatggatgtggaacgttatgtaggtacgaactttatttctttaagtacctgggaaaacatggtaaaagtaaaaatgatagtcctggtaatattaatggttaaatgaagaaatgtcaatttagttttctgctcagaaaagtgaggctcagtatcatctatattgaaaactagtttttctcagcagacctayaactgtcagaaaaacagaatgacaatttacttgattttatttactcagcttcatcctgctgctttsttttgtgccattaagttctctgatacttgcttagggaaaatcattactgagggatagatatagataccaggaagaagatattggaaagttggattggttgtaggcatctgtagaatacaggtgcaaaattcccagatcccagtacaccagctgcacagttagtcctctggagtctgctttgtgacctgctgctgcttagaggaaaggtggtaaaaagagcagatcattttcaaatctgtttttataataatgacttggtgaatattgccatttaatgatgtctggacttaatttttgattttgaaaattccccaaagaaacagaaagacatgagaaataagggggatcccctataccccttgccatgttgttgacattttcagtcatttcattaattctcgtgatatttacagataaagctgactatatgtagatgtcatttcttgtcagcagtagatagagaatatttgagattagattccaaatctattttgactcaaaattgtatatttactatattatctcctcagcatggaatatctgagaacttgtccctttatcgagccattggttgacaattctcattgattattgtttcactgaggaaatctaactaagtattgtaacttcacattcagctaaatttgaatatttgacaagtgagaggatggggctaaggattaacctgaacctatttgcgtagatagcatctgcaaaacaaatagctagtgtaatacatgtgcaggaaaaaaatgctcaaactgcttgatagctaactttttggtactgcagagcacttcagttaaatactatgagcagaaccgtgttgcctcctgatgataaagaagtctataaggcaagactttcttaacctatatgaagttgcattaaagtaagaaaatggcatttatttgttttctatttcagattggttaagtattgccatattttgaattctaccttatcccatagtccattgtcaaactaattatgcttcctagtgtagcagtgcagtggtctgtaaacancacttcatgggtttatacgaaaactgtaaattaatcacaatttggaactcaggccttcggacactggtactaatgtgaactgatttttgcttcccaatcactaattttttcttaaaggagaatattagaagacagtatcaggagggcagaaattatcctggtcaacttgcatgctaattccccaatgagtgatgtgtttttttttgaaatgatagccttagaatattttaggtgttacaaaagtgaaagggaaaagtcagtctcctcattttatgcctgagaaaactgaaatccagacagtgttgcacaatttctacatgccaatataatgtatttttttgtcattatgagctgtacaccaagatatcattagtatacagaaagctttgtaagccatatacacttttatattcagtgtaaattgtgcagctctgtcttactgctttccttttcctctgaaaaatgtcccttttttcctgaaaggtccagttgaacttgagaarttaagagtatagggaaaatatttgtctagactacrtagttttatagttggtttaattatcataccaagttaaaatattttttgattagagcatctrctgatgtaactcttaagtccaataataagactgtaatttttctctgcaggtggtgacaaagtgatagatgtcattgatgtggcgaggcaggcagacagcaaaatgacacttcacaattatgttaaatacttcatgaatcctaacagaccaaaagtgttaaatgtgatcagccttgaattttcagatacaaagtgagtagttctgggtattttggtttagcattctgagtgttagctaaatgtagtgtaatgatgtatttattttaggaagaaacatagttgtgacttctaaagttgtccagtggtagcaatgttataaattttgcattgggacactcagagatacttagaaataagatgtattttaaacttttggctgggcacagtggcttatgccttaatcccagcattttgggaggccaaggcgagtggatcgcttgaggccaggagttcaaaaccagcctggccaacatggcgtaaccccctctctactaaaaatacaaaaatcagctgggcgtggtggcacatgcctgtaatcccagctactcagagaggctgaggcacgagatctctcgaacccggcaggatggagtttgcagtgagccaggatcgcgccactgcactctagcctaggcgacagagcaagactctgtctcaaaaacaaacaaacatgtgttttaaacttttaagtgttgttgttaaccttaagttccatttaattatttggtttgggaatagatgagaaaaacaattcttaagaatttttaatttgcatgatgtgggtgtgtgtgtatgtttgttttttgaaaggatgtctgaattggtggaggtccctgatatagccaaaaaactttcctgggtggaaaattattggccagatgattcagtctttcccaagccatttgttcagaaatattgcttaatgggagttcaagacagctatacagatttccacattgacttcggtggaacttcagtctggtaccatgtcctctgggtaagattggggtattttttgttctctcactgacaaaaacatatagccctagtttttcagtggtatattcatttcttgtaaatgttacttgtaaagggggaagtttttttttttttttttactttttaaccaggaactgtcactttgcctttaaacgttacgattttttttttwaatctcaaataatggaagagccatgacttttaaatttatattagatttactttctgccctcatcttttaagttggtttcttttaggcttttgtctcttcttgattttttttcccctagttaattatcctttaatccctgaattaaatatctgtgaaggagcaaaattacagtaataattgcttctggccttaatgttgggctaggatagcttgttggataagtcaggaatgcctataaaaataccagttcttggctgggtgtagtggcttacacctataatcccagcgctttgagaggaggccaagctgggaaaattatttgagcccaggagttcaagaccagcctgagcaacatagtgagaccctgtctctaaaaataaaaataaaaacattagccaggcatggtggctcattcctgtagtcacagctactcaagaggctcaggcaggaggatcacttgagcccaggaagttgaggctacagtgtgctgtgattgcaccactgcattccagcctgggcaacagagcgagatcctgtctctaaaaataaaaataaaaaaagtagccaggcatggtggctcatgcttgtagtcacagctactcaagaggctgaggcaggaagatcacttgagcccaggaagttgaggctgcagtgtgccgtgatcactccactgcactccagcctgggcaacagagcaagaacctgtctctaaaagtaaaaattaaaaaattagccaggkgtggtggctcatgcctgtagtcgcagctactcaagaggctgaggcaggaggatcacttgagcccaggargttgagggcgcagtgtgctgtgattgcaccrttgcactccagcctgggcaacagagcgagaccctatctcaaaaaaacaaaacaaaagaccagttatttgcaatttatattcaccttgctttatctagagctgcattgttcaaaacagttgccactagccatgtgtractaaatttaaataattaaaatggaatgtaattaaaaattcagttcctcgtttatactaggcacatttcaagtgctcagtagccacatgtggctaatggctactgtgttggttagcacagatacaaaaaatttccatcagcacagaaagttgtattggagagtactgatgtagaaagtcagtcttcatctatatcaaatgcttgtgcctcagcaatgttctgggctatatttgttgctgggtccttgggttcctgtttttttccttcatgaagtagcaaagaattagtttattaaaggaagcttatttataggtttttaaaaataattatgctgtggatcttagtagaaagggcaaagcttgcagagatgactgtgggcctgtcaacacatatttacttctctatttgacaatgagaggaggtcagtgggatgtttgtgcttctctgccctcctgtcttgcagctatttcttcaacactactttattgactccttgtcagttgaggagggggagctttaaacatgaaaatgtttactaagggcaatagctactgatcaggtgtgtgaaatatgtcttttgaacctaaaagaatctgataattatccaatttaatttgtatcattgtattgagaaattgcatcaatgtaggctatcctaagtatggcttttgctttttcaaaaatagtatgatacttccttttagggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacaggtaaggttttcatcccatcccctactcaacatgattgatagtcacatggagttggcttttaactagaacctctggctttaacatgtttggaaagtagtttttatgacatttgttaagaaataattctgatcttggacttttatgttttgttccttagagggtttctcttctagttaggacttcttttggcattgtatttatatcatttgccttcatttttatttttattgagaaaaaattcacataccacaatattcacccttttaaagtgtacagctcagtggtttttagtagattaataaagttgggcaaatatcaccactatctaattccagaacattttcattgtctcaaaaagaaacctcatactctttagcagtcacttcccattcccgcctccactgagcccctggcaaccacgaatgtactttctgtctctgtggatttgcctctttggatactttatgttgatggaatcatacaatatgtgggcttttgcgtctagcttctttcacttagcatattattttcttwcttttttttttttttttgagacagagtcttgctctgtcgctcaggctggagtgcagtggcctgatgtcggctcactgcaagctccccatcccgggttcgtgccattctcctgcctcagccttccaagtagctgggactacaggcgcccgccaccatgcctggctaattttttgtatttttagtagagaccgggtgtcacgtgttagccaggatggtctcaatctcctgacctcgtgatccgcccaccaaagtactgggattacaggcgtgagcctccacgcccggccggcatactattytctaggcttatccatgttgtagcatgtatcattacttcatcttttcatggcccagtaatgttccattgtgggatatacaggttgagcatccctaatgcaaaagtccaaaatctgaaatgctccaaaattgaaagcttttgagcatctgcatgaccctcaaaaggaaatgcttactgaggcattttggattttggattttcagattagggatgctcagctggtaagtatgtaatgcaaatattccaagatccaaaaaaaatgtgaaatctgagtacttctggttccaagcattttggataaggggtactcagctttaccgtattttgtttatccattcaccagttggtggacattgggttgtttccacattttgactatttgaatggtgctgcttcgaacatttgtatacagttttttatgtggaggtatgttttcattgcttttgggtaaatatagcttgtagtagaattgctgcattacatggtttaactacgtttaacttcttgaggaattgctgacccgttctccaaatggctgcaccattttacgttaccaccagcagtgtatttgggttccagtttctccacaccctcaccagtgctgtaattgccttctattctattctagtgggtgtgatgtgtcatgatttggatttgcatttccttaatgagtaatgatgctgagcatttttcttgttgggcatttgcatattttctttggagaaatgtctattcaaaccctttgctcattttaacattgggttgtcctttttaattgttgagtttgtaagcattctttattctctgtactagacccatatcagtatgtatgatttgcaaataatttgctcccattttgtgggttatctgctcactttcttgataatatcctttgatgcacaaaagtttttaattttgatagtcttaactatggtcagctctccattgctgttaaaaaccaagcctgtaagaatctgggctgctgtcccaggacagttaggacagcatagggtgtgtcttgagagaccctcaaagaaaggactgagtatcagccttagctgtagcctcaagtataggtatcaggcctctcattttgagatgtaaatgaatgtagagtatagactgtccagaccagtggtttcgagaactgtgtgctggttttggtgaccctaatgactgtaaagttcacagggatctgtccctgcaggtcctgctgaaagccttgcctctggtgtatataataacaaatgtatgttgaataaatgaagacatgccttagaactaccagaatatttgcctagattagtaacagtattttcattgtgaatgggctcattnacattgtgaatgcccctcccttaaatcttcctacttcttgcttttatgttaggtatttctaatataatcataaattgacatttatgattcttcaaatcataaattgacattcatagaataattttttaaattgatttaatgtcctaactagaatataaagaagaaataaaaaggtaatttataatgaaatgctatttcagtatgtgcctgtctaggcacagcagcattagagaacagaatgaaatagtaattgcataaggaaggaaatcaatctaggtgtgtgtcagtggcaacacaaattctatcagtagcactggtgtaggtactgatacttcctggaatatcagaatcacatggagggctggttacaacacagattgctggacgtcatggccaaggttcggattctgtggatctggagtgggcctgagaatgtgcatttctaacaagttattggctgattcaggtgctgctggtatggggaccatatttggagaaccactgctgtaggcaatgtaattcttttcccaaggttgttagtgactgataagcttccaaactacagtacagtttttgtrtttcaggaaattgtgccaaaaccatgaaaatatactgtgtgtgggtgtctgtatatacagatatatataataatatataataatggagttctaatttctaggctcagatagttaataggacaggctttgtacctatatgaatgcgcaggaaaatttggcagtcccgagtgatgcaggacaatttcattttgtatggaactgtctcacatattgtactcctggctcccactcacaaaatgccagtagtgctcccagatcattgtgacaatcagaaaagcccctaaacgttccaaaacatcctgaacaggcagtactgccgctattgagaaccactgatgtgtaggatttggagttggcacagactgctaatttgtggtttcaaggtcaagctcaaggctttgtgcctttgagcacagcaatgggcacacttgaaagtgagtcctttgagggttttttgttttgtgttacagttcagtgaggggtcaaaagatgaaaaatacaaagaaaaygggatttgtgtattttaaaagctaatttgcatacaaatatgtgtttgtatttatttctggtgaagtcttgaagtctgccaacatttttttcaaaagttagacgtcatgtcttagaaatggttttcactttgtaagcatttgtatgggaatacaaaatatcattttttggcaacacctatatttgtaggaccataacccttcataattaaatgtgagtaatctaccttttccttctacagagtcaggtctcaggttgactcctctgatcctcctctgcttagtcctttcggggcactgatttcaggatgacaccagggcgatggagtgtcccatcaatcccagtgtgttctctaatggaaaatgtgcttttctaattcaaaccagatttggctggtctcaaagagtaaaatctttaatataaagttgggttgtgtttttaagctaaaaaacaaaaacaggctgggcacagtggctcacgccttaatttcagcactttgggaggccmatgtgagaggatgactttgaggccaggagtttgagatcagcctgggcaacaaagtgagaccccatctctatttttaaaaagaaaaaaacaaatacagtaacaactacaaaaacygtcaccttatttctcaaactcagcatagagcctaccatataataggcatttaataaataattaaatctatagattgtaataaacattaacttctctagcactgaaatatgaagtaaactgatattgatattttgagttacttcacaggtagatatcctattggtttagtttacatattgaaaaatgactggtttatatattttcaaccattttagggtggatccatgctgtgctcacttctcaggactgtatggcttttggggggaacttcctgcacaaccttaacattggcatgcagctcaggtttgtgtcatcagtatttaaatgaccttttgtcctttttaaaaataggatacttttttttttaacttaaaaaaaatcaatagcttattttatttgagattccatggaaatagtccctgagatattattagggatagaagcttttaacaaaagtagtattttaaaattttgccaggaggataatttgcatttcaaatctaaaacaacaacaacaaaagggaacttattcagataatattccaaatttcaaaattttgtgaaaatgtatgtgttcttctttggctatttttgcagtgagggagatgaacaaaatctagtcagactcagatgtgacatatggtgctagaaaaaagcaaccgtaagtcaggactgctatcaaaacacctgctttaattttgctgcaggtaaaggattaatagctgtttctcctctatatgagaatttgacctttgcgtaactctcttctcctagtagtctaatgagtgttgacttttactaggtaacattgcttatggtaaaaatgattcctgattgataaactgcatcaggactgggagaactagaaatacctagtaagaagccatatctctggacttgcctgaatgtggtaactcttgtaacttggcacactcatagagatccctagaagctatgcatctgtgtgtggcgttattaggggagatagtggcttttacagggcataaggctttaagcagccttaaacagctcccacacctaccaagtgtggatcttgtctttttgtacctgagctgtccctgagggagggatggctcctgtttaattcttgccaagtgtggtcttgagctggaatgcctagtggagcctaaataaaacttttttgggtgggtattgcactgttgtctaacacatagaggtgttttctgaaacacacagttttatttattgtagtagaaccctcgtaaaaatgtcttttgttaaaaccaggatacaaatcccaaagtgtgatcctgatcttctgtgaagtccaatacaattcttaagtataccatcaaattccttaaagtcagaacctggataagatcacaattcagtcttgtccaaatgtgatgttgctaagaaatgtaaaatactttattggtcttacatatcatgacctggttattttattttccagttggttactttcatctaactttgaaattctaatattaatattaaaaatttcttcaaactcatttaggtgttatgagatggagaaaaggctaaaaacaccagatcttttcaaattccctttctttgaagccatatgttggtttgtagccaaaaacttgctggaaaccctgaaaggtaattaataatttgcatgtttgtatatgatatgatgcatattgtttgtaaattcactcatagccacctgacagaaagagtcccttttctagtagtgtatggatgtcactcctattttgttttttaaataagtggttttcccccatccagcaacctttttagcaagttagagtctttagtccataacctgacaatccatgttcttaaaaatttgttatgaaagacctggatcagaacaacgtaggtaatattagaaatgttcattccatctagtcctctagaagcctgcatacatcatcaagcacgtaacagtgcctgactctcaaaaatgcagtttatgtcaagagactgttacctattatatgttcccaaaatttgcttttaaaaaagcaaactaggctgggcacagtggttcacgccctaatcctagcactttgggaggccgaggcaggcagatcacctgaggtcaggagttcaagaccaacctggccaacatggtgaaatcctgtctctactaaaaaaaaaaaaaaaatacaaaaattagccgggcatcgtggtgcatgcctgtaatcccagctacttgggaggctgaggcaggaagaatcgcttgaacccggcgggaggcagaggttgcattgagccgagatcatgcaatggcgacagagcaaaactccatctccaaaaaaaaaaagtcaggttatgattctgtagttgaagaaaaaaaaccttttttgaacttgtctttatagttgaacccaaaagctactttataaaaggtggaatttcagactttgatgttttaatcttttggtttaattatctttgagcactcaagttggagactgatgtcacttgcttctrttttctgcttttcatcctcttgtgctagtgagaatagtttgtctgctttttgtgttgtctaacttttctagtcagtttgtaaatagtgctactattataattgacaactctcagaatagacataaacagattaaacagtaaagtttattgtgaacatttgcttctttttccattttaaagttaaacaagaagaaaaggtaaaatgaaaagaaataaccaaaaatttacttcccaagataggatgtacagaactaaaatgataaaactcatataacaatggtaccctaaaccccccacctcacagcatagtgcagagatgtcctggcagtgcttctggtgtatgggataggggtagaatcccatgcatgagaaggagacaggtcctttctttacaagaccagtctttgctccagaaatgaatccttatcgtgaatccctgacacattcagtgttttcagttatttttcttggctgtgggaatgtcacaatggactgtagagtgtcatacataattttcagtaaaatactggacaatagagtttatagtctcccatttaagtacaagcctagacagacaggaacacttatatacttataaaaacacaaatttccttgttttgtggaaataaatcccaactattgaaccttctggttaagagattgacaactctatacttggttcaggatactttctcccctcttttctctctgtcccaagactccaagttcctgtcttatggttagctaggagaaactatccacgaacacacacacacacacacgcctctacccttggggtgatgcacagtggtttttttttttctactaatgtctaagagaagctcattctttaacttcttaaaacaaattaagagctttacctgaaagacaaaatcttgccattgctcgtgaagccacaggagcaatttgcttagtcttagaactatttagtctttgtgttaggccatcaaaagttcagaaacatggaggtctgattgaaagtatgaccatacgttaaagacttttttaaaaaggattattagaaaagggtatttgtgggttgttttaagatgtttcattttattagccagatcagtgtagaatacctggcaatcatagtgattcaatccagtctcatcaaggcaaaagccaattgatcattatagcaattgccatcattttaagcattcatcctggaaacaggaatagtggtcttgtgaccccaaattatgtcgttcttttatccgtaacctttttactttacattgtggcctattgtttgccagctctcagactgttctaaggcttatatggtgggttaaatgaggttgaatcacctgaaactctttactgtgtttcatgtcagtgatagtaaaacagtgaaccagtttggatttgtgtaaggaaattagccactgtgcagaagcgaaatcctttgtttcaacttagctgaattttggaccacatctaatatattttgtttgttttagattatcacaatttgattaaaaaactcargacatttttgttgatgtgtgtttatatttactttattatgttattaaaatagttgattatatagatcacacacgcactgcatacacacacacacattcataccgtgtaaagaataaggctgttcttactcaggtaaccaccacccaaattaagcaaaaacagccttgccaataccttagaaatgctctgttacctttctcattacacctttccgcttcccttctagagataaccattatcctgacctttgtgttaatacttttcttcagttttatcacctgtgttataaactaaaataatttaattttctccatttgtaaacttcctacaaataaattcatactggtattctcttgtaaccttttactcagcattgtttgtgagattcatccatgtttttgtgtgtggctgtagttctttttcattgctagagtattctgttgtatgaatatactatgatatacacacacacacacacactgattctgcaagtttgacattttggagttatttttggtttttgacaattacggaaaatgctgctaagaagttcttgtctttgtcacctagtacaagaattactccagaaaacaggcctaattgctaggtcataggtagaatttagcagttgctgccaaattgtttccaattcccatttccatggcagggcaagagagttcccaaagctctatgctctggccaacacttggtattgttaggttataatttttgcaaatctcatggatataaagtagtattctttgtgcttttaatgtgcatttccctgattattgatagaatcgggtagtttttttcatatgtgtataagccttttttttttatgataaaaatattgtatgacatttattttttttttttacttttcttgtactattaatgttttatttttttttatttatttattttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttctgcagtgtttgtgtccctgattacttgagattagggagtggtgatgactcttaacgagcatgctaccttcaagcatctgtttaacaaagcacatcttgcaccgcccttaatccatttaaccctgagtggacacagcacctgtttcagagagcacggggttgggggtaaggtcatagattaacagcatcccaaggcagaagaatttttcttagtacagaacaaaatggagtctcccatgtctacttctttctacacagacacagcaacaatctgatttctctctcttttccccacattttccccttttctattggacaaaactgccattgtcatcatggcccgatctcaatgagctgttgggttacacctcccagacggggtggcggctgggcagaggggctcctcacttcccagaaggggcggccgggcagaggcgccccctacctcccggacggggcggctggctgggtgggggctgccccccacctccctccctgatggggcagctggctggccgggggctggccccaacctgcctcccagacggggtggctggccgggcgggggctgccccccacctccctcccggatggggcggctggccgagcaggggctgcccccaacctcctggacggggcggctgccgggcagagacgctcctcacttcccggatggggcggctgccgggcggaggggctcctcagttatcagaaggggcggcttccgggcggaggggctcctcacttctcagacggggcggcttccgggcggaggggctcctcacttctcagacggggcggctgccgggcggaggggctcctcacctcccagacggggtcgcggccgggcagaggtgctcctcacatcccagacggggcggccgggcagaggcgctccccacatctcagacgatgggcggccgggcagagacgctcctcacttcctagacgggatggcagccgggaagaggcgcttctcactccccagactgggcagccgggcagaggggctcctcacatcccagatgatgggcggccagtcagagacgctcctcacttcccagacggggtggcggctgggcagaggctgcaatctcggcactttgggaggccaaggcaggcggctgggaggtggaggttgtagcgagccgagatcacgccactgcactccagcctgggcaacattgagcactgagtgaacgagactccgtctgcaatcccggcacctcgggaggccraggctggcagatcactcgcggttaggagctggagaccagcccggccaacacagygaaaccccgtctccaccaaaaaaatacgaaaaccaatcaggcgtggtggcgcgcgcctgcaatcccaggcactcggcaggctgaggcaggagaatcaagcagggaggttgcagtgagccgagatggcggcagtacagtccagcttccgcttggcatcagagggagaccgtggaaaggggaggggaagggggaggggcgttttctatattttcaatactatgttattgagtacaaattctaagtggttacatacgtctttctggtgaattgaatccttggtcattatgaaataaccctttattagtgacagttacaccccctttcttttggaagcttggtatctttttcccatccttttatttgaaacctttctatattttttaatatggtatgtgtgcatatttaacttattttaaaatctggccagatacagtggctcatgcctataatcccagmactttggaaggccagggctggaggactgcttgaagccaggagtttgagaccagcctgggcaacatactgagaccccatctctacacaaaaaaattaaatccaatgaaatggcctttcttttaactggagtatttagtaaattacattgaatgtaattctgtttctttattgtctttttgaattgtttcatatttcactttttatatttttattaatttggaagttatatagttttatatttggtggctactcaaaatctgaagttaatccctttaactttagaacattttaactatttttttttctcaccccatttccattcctacagaactgagagaagatggtttccagcctcaaacttacctagtacagggagtgaaagcactgcatactgctttaaaattatggatgaaaaaagaagtaagttgtttcaacagtgaaatcactgtgttttatgccacaagattaggaaaacagagtccttgtgctattttggcagcacgtgtgaatgccagtagtagagggaatagaaatcatgcctttatatacaacctgcattttattattcagtatatacaaatgtactggcttcttttatgagaataaagtatttatttctttaatcttcaatctggaaaagaaagtaattcaagtatatttaggaaattgactaagaaatgaacatataggtaacattgagctcttacagttgtgctatagtgtgctgagagcactgtgcttaatctttatacacataatctcatttaatcctcaatgccaactgtgtgaggtctaggtgctgttggtaccaccattctacatatgggaaagccaaggttcaaagagttaagtaacttgcccaagagaactggtgaagttaggacttaaaacttagatctctgggactgcaaagcctatgctcgttaccactctgctagatttatgtaaaagtgaaggaaaggagagaccaaatttcaagcatgagctttccattttcatgaaaatatgagctagttgtttgcatttgaatcccaccacctccagatctccatttggaattagtgtttccttcccttatgcatccatgctatatttcttgtgcctatgggcttaaaacaaatgtttataaagtaatatatttgtgtttccttcaactgggtctgtgagctcttgaacagggactgtctttctcatctttattataactccatggaactttgcacataatactttaataggtgatacatacatatgtgagctgatgaaaatacatgtccatattaatttctttttttttttttagacagagtcttaatctgttgcccaggctggattgcagtggtgcgatctcggctcgctgcaacctacgcctcctgggttcaagtgattctcctgcctcagcctcccgagtagttgggactacaggcacgcaccaccacgcctagttaatttttgtatgttttagtagaaatgaggtttcgccatgttggccaggctggtcttgagctcctgacctcaggtgatccacccgtcttggccttccaaagtcctggaattacagtcatgagccactgtgcctggctgtgtccatattaatttcttgaatgtccccttgaaataaaaatcttgctcttaagaaatactgggagacagtaattaataggttactgcctcaatgattttatactccctttttactgtattatcattgctacatatctgctagagcacaacagtgtggaagcattcaggaaaataaaaatcatgtcctccactgtgaaagaccttattgtctaggtgacaaggaaagccataagcaaatttaaaactgtttaacaagataaaaacaaaacaaagcatatgttgccaaaactgtataatttgtttcctactgaaggctttagatgtgtgattctcaaatttgtgactttatcagaattccctttagagctttttttttttttttgagacagagtctcactctgttgtgcagactagagtgyagtggcacaatctcggctcactgcaacctccacttcctgggttcaagtgattctcctacctcaccctcctgagtagctgggattccacgccyggcttagttttgtatttttagtagagacggggttttgccatgttggccaggctgggctcaaacttctgacctcaggtgatctgccagccttggcctcccaaagtgttgggattacaggcgtgagtcactgcgcccggccttcccctttcctattgatgggatcttttttctattttgcttttgactattaaaagaaaaaaaagtacaaaaatttattcaaattagatttcccaagagaaattaggattacgttagtgtctgtgttctccttaaaaatccttatgcattatgaattaaatgttaagcttaatttgtcactttacgaattagtagtagtagttagaattacagtaggctttgaggagtagagtacaaggttactactcaatgtaaagcaaaattcactgtgagactagtctgtttttaacacagtctaagaggattttgtatgttaatgagaatctccttagaaggcattatactagctacacgaactctgaaacctggcttactagtatttggcratgtctgtaacagtttagagaatccaaaaattggtttagtaaatttgtttttacatattaaagtgtaaataactttggttttcttatttttgttaatccaaatacagcttgtatctgaacatgcctttgaaattccagacaatgttagacctggacaccttattaaagaactttctaaagtaattcgagcaatagaggtaagagtggaaactgtcatgtaaatgcttgattattatctgctttgagaagcaaatggatctattccactctctacaaatatttaaaaactcttacayacttagaagaaatataatgagctgagtctttggaggtttctcaggttttcaggcctctgaagtccttaagagaaatttaaatattgtattctaatgaattctaatgaagtaataaggaaacagttactagtttaggatacttaaaaaaaatcaaaaatacagagtataaacagtagaactttcagatacagttaatttcagctacccagagaggaatacatgtttatgtaattagaacaagagaagaaatgtaaggtgaatgagtcaagctagggaagctgagatggagagagggatgataagcagtagagtggggcaaggagatgcttaggtaaatgccctttaataaaagctcataaaatctgatgagatgttttaatttattaattgagagctattctcggtgtttaagaaagggtgttttaaagtaattcttcaagaaggttgttctgttagtgtctagcttaaattgagaggaaattaggtggaggaatggaggccagctgatgatttaacagcttacattagggctgtgtttggagaatggaaagaggtatacatttacaaaatactaaaatgcttgctttaatatcaatggatagaatgtgtaattctcaatgtgttcagatagaggagaaaaataygttctgtttttaaagtgttacagtaatcacatttaaattgatttagtatcaaaagtcatatatctaatcttaaatatatatgtaagtttatacatatataaatctcatgcatgataaccaacatgaagaataaacttactgtgaaaggtatgattctatatgaagaaaaactataaatctttacttttaggaagtaaaacagtagttaaawgggagtgtcagtcagctctaaattagtattacaaatttaaagtggtaaaatacacttggaagagtaattaaactggtctagagagcagccagttcaggatggatcagaagaatgaaaggatccatatttgttatgacctgaaattcaagtttaagtgggtgtctgttattttatctggcaatcctatccaggaaggatgtctccagagaaaaatataaaattattagattaccaaatgtgtttgaatgtttgtattcttctagtggataatttgggaatcagttagtgattgaataagggaatgtaatgacaatatgttatgtggcgctgggttatcaataatttttaccaagtccaatttactgartattgaaggaaagggaggtatgtgcatgtttaagagaggtgtgtaaggattaagacttcatcttgcatgataggaattcagtaatatctgaagctgaaaacagtataaacatatcattttgtaatttggaggcaaataactacagggaaaaccatttagaagagttggaagtcctggytatatacctaaaagaattgatagcagggactcaaacaggtatttgtacacctacgtttatagcagcattatccacaatagccaaaagatagaccaagcaacccaggtgtccatcagcaggtgaatagataaagtgtgggacatactcacagtggaatactactcagccttataaaagaaggaaatgctgactgggaggattccaagatggccaaataagaacagctccagtctacagctcccagcgtgagcgacacagaagatgggtcatttctgcatttccaactgaggtactgggttcatctcactggggcttgttggacagtgggtgcagcccacggagcgtgagccaaagcagggcggtgcatcgcctgtcccaggaagtgcaaggggtcggggagttccctttcctagctaagggaagccgtgacagacggtacctggaaaatcaggacactcccaccttaatactgcacttttccaatggtcttagcaaacagcacatcaggacgttatatcctgcgctggctccgagggtcccacacccacggagccttggtcactgctagcacagcagtctgagatcaaactgcaaggtggcagcgaggttaggggaggggcatccaccattgctgaggcttgagtaggtaaatgaagcagccaggaagctcaaactgggtggagcccaccacagctcaaggaggcctgcctgcctctgtagactccacctctgggggcagggcatagctgaacaaaaggcagcagaaacttctgcagacttaaacgtccctgtctgacagctttgaagagagtagtggttctcccagcacacagcttgagatctgagaacggacagactgcctcctcaagtgggtccctgacccctgggtagcctaaatgggagacacctcccagtaagggccgactgacacctcatacagctgggtgcccctctgagacgaagcttccagaggaaggatcaggcagcaacctttgctgttctgcaatatttgcagcctccgctggtgatacccaggcaaacggtctggagtggacctccagcaaattccaacagacctgcagctgaggggtcttgactgttagaaggaaaacaaacagaaaggacatccacaccaaaaccccatctctaggtcaccatcatcaaagaccaaaggtagataaaaccacaaagatggggaaaaaaacagagcagaaaagctgaaaattccaaaaatcagagtgcctcttcccctccagaggaacgcagcttctcgtcagcaacggaacgaagctggacggagaatgactttgacaagttgacagaagtaggcctcagaagatcagtaataacraacttctctgagctaaaggaggatgttcaaacccatcrcaaagaagctaaaaaccttgaaaaaaaagatatgacaaatggctaactagaataagcagcacagagaaaaccttaaatgacctgatggagctgaaaaccatggcaaaagaactatgtgacgcatgcacaagcttcggtagccgatttgatcaagtggaagaaagggtatcagtgattgaagatcaaatgaatgaaatgaagcaagaagagaagtttagagaaaaaagagtaaaaagaaacaaacaaagcctccaagaaatatgggactatatgaaaagaccaaatgtacgtctgataggtgtacctgaaagtgacggggagaatggaaccaagttggaaaacactctkcaggatattatccaggagaacttccccaacctagcaaggcgggccaacattcaaattcaggaaatacagagaacgccacaaagatacttcttgagaagagcaactccaagacacgtaattgtcagattcaccaaagttgaaatgaaggaaaaaaygttaagggcagccagagagaaaggtcgggttacccacaaagggaagcccatcagactgacagcggatctctcggcagaaactctacaagccagaagagagtgggggccaatattcaacattcttgaagaaaacaattttcaacccagaatttcatatccagccaaactaagcttcataagtgaaggagaaataaaatcctttacagagaagcaaatgctgagagattttgtcaccaccaggcctgccttacaagagctcctgaaggaagcactaaacatggaaaggaacaactgagaccagccactgcaaaaacatgccaaattgtaaagaccatcaaggctaggaagaaactgcaccaactaacaagcaaaataagcagctaacatcataatgagtggatcaaattcacacataacaatattaaccttaaatgtagatgggctaaatgctccaattaaaagacacataccggcaaataggataaagagtcaagacccatcagtgtgctgtattcagagacccatctgacgtgcagagacacacataggctcaaaataaagggatggaggaagatctaccaagcaagtggaaaacaaaaaaagagcaggggttgcaatcctagtctctgataaaacagactttaaaccaacaaagatcaaaagagacaaagaaggccattacataatgctaaagggatcaattcaacaagaagagctaactatcctaaatatatatgcacccagattcataaagcaagtccttagagacctacaaaaagacttagactcccacacaataataatgggagacttcaacaccccactgtcaacattagacagatcaacgagacagaaagttaacaagaatatccaggaattgaactcagcttgcaccaagtggacctgatagacatctacagaactctccaccccaaatcaagagaatgtacattcttctcagcactacgtcgcacttattccaaagttgaccacatagttggaagtaaagcactcctcagcgaatgtaaaagaacagaaactataacaaactgtctctcagaccacagtgcaatcaaactagaactcaggattaagaaactcactcaaaactgcacaactacatggaggctgaacaacctgctcctgaatgactactgggtacataatgaaatgaaggcagaaataaggatgttctttgaaaccaatgagaacaaagacacagcataccagaatctctgggacacatttaaagcagtgtgtagagggaaatttatagcactaaatgcccacaagagaaagcaggaaagatgtaaaattgacaccctaacatcacaattaaaagaactagagaagcaagagcaaacacattcaaaagctagcagaaggcaagaaataactaagatcagagcagaactgaaggagatagagacacaaaaaacccttcaaaaaaatcaatgaatctaggagctggtttttcgaaaagattaacaaaattgatagactgctagcaagactaataagaaaagagagaagaatcaaatagatgcaataaaaaatgataaaggggatatcaccaccgatcccacagaaatacaaactaccatcagagaatactataaacacctctgtgcaaataaactagaaaatctagaagaaatagataaattcctcaacacatacacccttccaagactaaaccaggaagaagttgaatccctgaatataccagtaacaggctctgaaattgaggcaataattaagagcctaccacccaaaaaaagtccaggaccagacggattcacagccaaattctaccagaggtacaaagaagagctggtaccattccttttgaaactattccaatcaatagaaaaagagggaatcctccctaactcattttacaagaccagcatcatcctgatagcaaagcctggcagaggcgcaacaaaaaaagagaattttagaccaatatccatgatgaacatcgatgcaagaaatcctcagtaaaatactggcaaaccaaatccagcagcacatcaaaaagcttatccaccacgatcaagtcagcttcatccctgggatgcaagactggttcaacatacgcaaatcaataaacgtaatccatcatataaacagaaccgaagacaaaanccacatgattatctcaatagatgcagaaaaggcctttgatgaaattcagcagcccttcatgctaaaaactcttaataaagtaggtattgatggagtgcatctcaaaataataagagctatttatgacaaactcacagccaatatcataatgaatgggcaaaactggaagcattccctttgaaaactggcacaagacaggaatgccctctctcaccactcctattcaacatagtgttggaagttctggccagggcaatcaggcaggagaaagaaataaagggtattccgttaggaagagaggaagtcaaattgtccctgtttgcagatgacatgattgtatatttagaaaaccccctcatctcagcccaaaatctccttaagctgacaagcaacttcagcaaagtctcaggatacaaaatcaatgtgcaaaaatcacaagcattcctatacaccaataacagacaaacagagccaaatcatgagtgaactcccattcacaattgcttcaaagagagtaaaatacctaggaatccgatttacaagcgatgtgaaggacctcttcaaggagaactacaaaccactgctcaacaaaataaaagaagacacaaacaaatggaagaacattccatgctcatggataggaagaatcaatatgaaaatggccatactgcccaaagtaattaatagattcaatgccatccccatcaagctaccaatgactttcttcacagaattggaaaaaactactttaaagttcatatggaaccaaaaaagagcctacattgccaagacaatcctaagcaaaaagaacaaagctggaggcatcatgctacctgacttcaaactatactacaaggctacagtaaccaaaacagcatggtactggcaccaaaacagagatacagaccaatggaacagaacagagccctcagaaataataccacacatctacaaccatctgatctttgacaaatctgcaatggggaaacgattccctatttaataaatggtgctgggaatggctagccatatgtagaaagctgaaactggatcccttccttacaccttatncaaaaattagttcaagatggattaaagacttaaatagtagacctaaaaccataaaaaccctagaagaaaacctaggcagtaccattcaggacataggcatgggctatgacttcatgactaaaacaccaaaagcaatggtaagaaaagccaaaattgacaaatgggatctaattaaagagcttctgcacagcaaaagaaactaccatcaaagtgaacaggcaacctacacaatgggagaaaatttttgcaatctacccatctgacaatgggctaatatccagcatctacaaagaactcaaacagatttacgagaaaaaatcaaacaaccccatcaacaagtgggcgaaggataggaacagacacttctcaaaagaagacatttatgcaaccaacagacacatgaaaaaatgctcatcatcactggccatcagagaaacgcaaatcaaaaccacaatgagataccatctcacaccagttagaatggcagtcattaaaaagtcaggaaacaacaggtgctggagaggatgtggagaaataggaacacttttacactgttgttgtgactgtaaactagttcaaccattgtggaagtcaatgtggcgattcctcagggatctagaactagaaataccatttgacccagccatcccattactgggtatatacccaaaggattataagtcatgctgctataaagacacatgcacacgtatgtttattgtggcactattcacaatagcaaagacttggaaccaacccaaatgtccatcaatgatagactggattaagaaattgtggcacatatacactgtagaatactatgcagccaaaaaaaggatgagttcatgtcctttgtagggacatggatgaaactggaagccatcattctcagcaaactatcacaaggacaaaaaaccaaacaccgcatgttctcactcatagatgggaattgaacaatgagaacacatggacacagggtggggaacatcacacactgggacctgtcgtgggttggagggggggggagggataacattaggagaaatcctaatgtaaatgacaagttaatgggtgcagcacaccaacatggcacatgtatacatatgtaacaaatctgcacgttgtgcacatgtaccctagaacttaaagtataataattaaaataaaaaaaaaaaggaaatgctgacacatggtatagcgtggatgaaccttgaagatattttgctaagtgaaataagccagtcaccaaaggacaaattttataaaattccacttatatgaggttcctagaagtgtcaaattcatagagaatgcaagtagaatggtagttgctaggggttggcgggaagggagaatgggaaattattgtgtagtgggtacagtttcaggtttcagtttgtgcagatgagaagcttctcgagatggatggcagtgatggttgtgcaacactgtgactctacttaatgccactaaactgtacacttaaaaattgttaaaatggcagattttatgtttatgttaccacagtaaaaaaatgttgcaagtggttgcckctggagaatgagagggatggggaagaggaggctgctatttttcatgatatgcttatagaatatttaatttttaaaactacatagatgtataattttagtttaaaaagtaattcttaatttattcaaatatgtacgtgaaaagaatgttcattgtcggaaagaacagcagcctaaatggctaccagtaagtattaggtcagaaaattaacagtggaatgcaacacagcctttaataagatattgaaaatcaaggcccagtgcagtggctaatttaacaccggtaatcccagcactttgggaggccgaagcaggtggatcccctgagctcaggagttcaagaccagcctgggcaacatggcaaatacttgtctctaaaacattagctgggtgcagtggcgtgcgcctgtagtcccagctacttgggaggctaaggtaggaggatcgcttgagctcaggaggtggagattgcggtgaggcaagattgcaccactgcactccacacactgcagcctgggtgacaagagcgagaccctgtgtcaaaaaaaaaaaaaaaatcaaggaagtatgttcacagtatattatgttggagagagaagggatataaagttctcagcaaagctgtttgaagcttaggatttagtcttttttgtgtttatatggttaaactgaatggtttttgttttctgaaatatttttatggatgattatttagtcacgtatgtgtgtaacagccttcttataaaaatactctgattttaattcttaaaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggtcctcaaangattagagatgtgtccatgggaagaggcaagtattatgtttcatgacaacaaaaagaaacttggctgttccttaaagtctttatagggataataagagaatagtcttgactattgttgatatctaatcttggctgcagcattgtagggatcaaccagtagttatgcctgtgacagggagtggtgcttaatctttctaagttttagtgtagaatttgaatgaatagacctcattcgattgctgatatgtttattgagtctttagcaagtaccatttcctcttctaggctctggagaagattgtgagcaaaacttaagtccctgcccctcatgaagcttccatcctagttcaagctggaaggatggggagacagagacatatactaaaataatacaatttcagatgataagcgttatttaaaaaaaacccaaaacaatagaacaacagaataaagggggatggggtaaagctggctgctttagctaaggtggtcagagagcctctcaggtttgaaccgacagctgagtaacaaataggaagaagtcaaatggttacgtggtgattggaggaatggcattacaggcagagggaagagcaaatgcagaaagcctctacttgagccagcagtcagcctggaggactgttagactgggagactgtcagaagaaactcttaaacttcgtgaagtgctggcctactggacaaaggggagagtgggaggtagtaatgagatcagtgtagcgcctttgcagaacatggtagtgactttgtagtgagctctgcatcatccatacttttacatcccaagaagaggataagcagccattttaaatgaataagatcgaagaaccaggtgctgtggtgtgggcctgtagtcccagctacttaggagactaagtcaggaggatcatttaagcccaggagtttaaggccaacataactagatcctggcttaaaaaaaaaaaaaattgggaggccgaggcgggtggatcacgaggtcaggagatcgagaccacggtgaaaccccgtctctactaaaaatacaaaaaattagccaggcgcagtggcgggtgcctgtagttccagctactcaggaggctgaggcaggagactggtgtgaacccgggaggcggagcttgcagtgagccgagatcatgccattgcactccagcctgggcgacagagcgagactccgtctccaaacaaacaaacaaacaaacaaacaaaaaaatatatatgtatatatatatatatatatatatataactttttaaaatattttaaattgtatgtaattataatgttttaagattatgctgttctaaactgtaatcatcagaagattaagcttattatgaaaggttctatttattattaaggggaaaatcactatgaaaaggaagtctttttgattcattaaaacccagctactgcctttatgtcgcatggtgacccttgttcctagtggtagcagtgtggtgagctataagttgctgactaggtattagatgaaggatgggtgaatggaaaggcccagtagctagcactttagcaggaagaagcaaggggaagagagctaaaatactctgaggcagtgcttctccagtttttcagctttctgcaagaatgaaatttctttgaattcactttatgcatattttatgttttactttctagaatgcatttcatggttaatggccctccagaaagatgagccatactcttactttggctttaggaactctggagtgccatactgctgcatatccccaagcccaggtggctgcctgtatctttgagatgcaggaccatgggggaggtggtggtatactgtattccatcagtcgaacagggctacctgagggtggatggtaagtaagttctgcatttataccttcaggacatcttgagctctaaactgaatggaaaattcaacaaacatctccaaccatcctccacagtacctgaatggagagcgaaagataatgatctacgattactgctgacaaatggaagaataattaagtatgtaaagtaaatcagagtatcaaatagattaattttcattgggttccctttgttcatttaacccagtggtcctcaacctttctggcaccagggaccggttttgtggaagacagttttttctcagccagggaatggttttgggattaaactgttgcacctcatatcatcaggcattagattctcataaggagtgtgtaactcttggacatgtgtagttcacaatatggttcacgctcctatgacaatctaatgctgccactgatctgacaggagacagagctcaggtggtaatgctcactcacccactacttacctcctgctgtgtggcctggttcctaacaggccacggactggtaccagtctatggcccaggggttggggacccccgtttaatctgtaatgagctcagtggctcacacctgtaatcccaagttgatttgggagtctgaggtgggaggatctcttgagaccaggagtttaaaactagcttgggcaacttagcaagactccatctctacaaaaaaataaaaataaattagctgggtgtggtggccatgcctgtagtcctggctacttgagaaactgaggtgagaggatcgcttgagcccaggagttcaaacttacagtgagctatgattgtgccactgcactccagccagggcaacagagcaagaccctgtctcaaaaaacaaaaacaaaaaacgaacctcagatccctagcgcatactattgcacagttgaatgaaatatggggacagtgtctcaattctctactctttgtaaattaagggagaggggaataaatactgtttggctacagagtcttgcactatattctgattacttttccttcttaatacagagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatggtatgtttttttaatggttattttaaagatcttttgattactaatgtgataatatgtaaagtaacttgctaattttgaagttcttaagtttaaaatagcagaaaacttttgtgtccctaaaactgtcttgaaaaatctgaagtatgagagaagtgctgaacgtgaatgcccagtgaggtatacgcccagtggccaggggcggtgttctcagtgaggggatgtttgtgggttagagctgcactcatctagtcagtttttaaagagtcacttgaaagctcatgcatgttataggcctctactccccaaaataaaagtttcaagtttcgtttaattttatatgtaagttcagctaccatgtgtatggttttcagaattaggaagtatatatgattagctaatctgaagctgttagtaatccatgcattgtggttttaattgattacctgttgacaagaaggcctctactgggttattaattggttatcatcagtatggcaaaatagtaacacctccttctccttaaggtctttcttctttgaattaagccttagtttctcaatatatttcaggatctctgtattcctttctattttaaaaagtagttcaaatatatactttggtacttgacaaataaatgtttcagataactaacattatttaatccatgttgaacaccccagttcctgctaatctgagtgaaattggcactgctgtagttggtgactctgtctttgcacacaccaggtgctaatcaacaggaatccatcaaaccattgctatatgttagtgactcatgaaagaacccagtttataagcgtgttgaattcactatctacgtgaatgcgttttacgtttgggaaggttatctttttgttttctaatgatacaactaatgcaaaaggagaagtgtgaaaagcatctgatagctaattttagtttcagcatttttcttctggaaagaaatacaaaacagtcaatccatccaagtaaggaatatataattatggaaataccacacttaatatttgagaatatacttcagtctgtgtcttggccaattagggagaaagaccttaaggggagaaagaaatgaagaaaataaaagtgaaaaaggagggtagagcaagagagattgagagacatcacaagctgggtggactttagataccatcttgtcaccttgttcatcgtagtcaaatgactttctctntttctcatcctttcattctttttcagggttttttacamgtgtgaaatcagaactcaggagtagatcatcaggatattctgatatttctgagtcagaagactccggacccgagtgcactgcactggtacgcctgagaccccatggcttgtacgttatttgatggaaagatgagcaccacgtaacttctcctggaagcaaggcaaatgacagcttttctcaaagcttgtctgtctgacttacattagcacagggtcttctgtggtggtcagtgtacacacatgccatcatgtgaccattcacatttgagacatagagcttttgtctgattttggaaagggtagagggagagactcctttgcttatactattcttgtttcatatttctcatggattatattttattttaccttaaagaaagcctatactgtgtatttttttaatcaaggtagtatgttcwtgtagttaatagagattatcatttttttcatgtgaattacagaaataattccctgataattaagattctgactttctctagatgtataaaatcttttcggattcatttgtacagacttggtcaatttcttatgtagctttgtttccatgtaattatcatctcagaaaagtatctttaccactgaagagtctgaaagttcaggtgatgaaaagaaacaagaaataacatccaactttaaggaggaatctaatgtgatgaggaacttccttcaaaagagccagaagccatctagaagtgaaattccaattaaaaggtaggcttgctgatagtagtaagtcttattatattgtaaggtaaatactatgaacactttttttagttttaaattttaccaaaaatgtcatcagaaaaaatagactcttgtgtttttggatcatctcttctttagggaatgtcctacctcgacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtggtaagaaacataaattatcrgtctctaaaaagtaacatatgttgcccaacttaatggctcaataatcctcatttaggttagagattatgaataagcatctttaattggaaatgtgttaagaaggttgaccaaaaaaagcacaatgctgacatatcacgtaagatggaagcagaagaactcaaaatgtaaattacctgggattgacaaytgtgttcactagcatcattctaccattgttattgcaagccagttagtattatttcccttttacagacaggttgatcagagtggaaggagtgttttggtgccttaaatggccaactaagcttgaacaatcagccctttttccttttatgagaggaaaaataagttttaaactgtttctttctgattgaggctattccttctcctacttgaaaagaaagtattaggaaaagagggtagactcagtggcagtgttaggcatgccacatagtgttttcttccttgtgcctttagagaaaatgtttgtatcccaaaaagcctgaggaggaccggggagaagatagtactatattaaaattgaatgcctatataataaatatgtttgatcctacataattatcaattgtataccaggagcttgacatccatttcactgaaataattttttttattatttatttatttatttattttgagactgtctcactctgctgcccaggctggaatgtagtggcacaaatatggctcactgtaacctcaacctccaggcctcaagcaatcttcctgtctcagcctcccaagtagctggaactatagatgcatgtcaccacacctggctaatttttttattttttgtagagacgaggtctcacctatgttgcccagactggtctccaactcctgagctcaagtgatcctcctgcctctgcttcccaaagtgctgagattacaggtgtgagccaccatgcctggttatttcacttaattcttaaaacaatacttgtaggtaaaatcactcccattttacaggtaaaggaaataagacttagtaaaactaatttaacttgtctgtacttcatgtaactattattcagtggtattggaatttgaagccaggaccatctgatctcaaagtctttgcttattgtataagaggaaattgaagtttggagaggataaataagttgcctaaagttgcgttggtaatggaagaactcaaattcaaatctgggtttgtctctttttgtactgcaccattttgtcttcctttagtcccttgaaagagaacacttctatggaaatactgcaaaattcaggcaaatacctgcctttattctatgtggaaaaatataccatttttatagagaattattgcattggttttacatatacaataggcggccatggaatttgattctagatcactgggcgcagtggttcacgccagtaatcccagcactttgggaggccgaggtgggcggatcacctgaggttggaagttcaagaccagcctgaccaacatggagaaaccccatctctagtaaaaatacaaaaattagccgggcgtggtggcgcatgcctgtaatcctagctacttgggaggctgaggcaggagaatcgcttgaacctgggaggcggaggttgcggtgagctgagattgcgacattgcactccagcctgggcaacaagagggaaattccatctcaaaagaaaaagaatttgattgtagatcttccagcatctagcccaaaacccatcatataaagacagtctttgaggctggtctgagtatggtgtttataactatttgatcacaaacaattacagatttctttgtttcttctccatctcactgcttcacttgactagagaatgaatgaataaatgaagacagtctttgagagaatcaaaagaattagcataataggttatgaattggtgactttttgtttttgagggaaaggcatatagtgaaggtaaaggtatgcaaatgagtatctaaagagttaaygtgtttttaaatacaatgtcaacataaatttgcttgcttttttttttttyccccaagatggagtctcactctgttgcctaggctggaatgcagtggcatgatctcaactcactgcaacctccacctctcgggttcaagtgattctcgtgcctcggcctcccaagtagctgagattacaggcgtccgccaccatacccaactaatttttgtatttttaatagagacggggtttcaccatgttggccaggctggtctcgaactcctgacttcaagtgattgacctgccttggcctcccaaagtgttgggattacaggcgtgagccatcacgcccaacctgctttcatttttaagcattaggctaattttgtcatttcaaatcaagtttgtgcaaagttaattaaactaaaacttctctttaggataccatgtcaagactgaagatccagacttgaggacttcctcctggattaaacagtttgatacttccagatttcatcctcaggtatattcaaagtttgaaacgttaaaaggagatttaaaatgatcattaacgttgtttttgctttcttttttaaaactgtaacaaccagttatcractgctagatctaggcagccagaaaattacagttaaatgcacatttgaacaactgtccattttgagagatgccgaaatgataactaacataaggctcatggatagaatgtgatctggaaaagaataatttattcaaggaagcagttaaaccactggctgccaacccatgtaggttatatctggttagaatgaaatattcaaggaaaagatgaatatcatatctttttaatctctgatgctgtttcttgaacggttttggatactgaatttctttgagcatttgatgaaagttacagattgtctttctagaaaatacattcatgataaacacaacttttgcttacattatcaaatgaacccaaaatagcagttttgaaaaaactaaaactttatcagcagcaccaaacaagagaagtgatacaacctttttttgcaaaccttggaaaatggcagccaaagaaagaatcaaagttctcatgtggcactgtggggccccaaacctctctaccccaagcacacataagaaagaaagtaaatcagcaaaggcagaaatattgcctctagttctcctctgagtgaagaaacatttgtgggggagaagggaaggagggaagaggagacagaggggaacatgagtcgactgtttaagaagtgaagggaaaaatctcttatgaataaagctttcacatggcaccgaaagacctcagcagaagtgaaaaaggcctcctgggttttgccatcttccagagccctgaggtgactggaggaatggattaaaatccctggaggaggagacacccgtgtatatagacagaaaagactctacccctaaatatggaacatcattaatctctgagtagtagaattatgggtggtttttattaattttttaaatttggcttgtctatattttctaaatatttaagcaattacttgcataagaaaaagaagcaagttttttttttaaaggaaggctttgtgagtatacgttctttgactagaaggatacattccagagtcaaaggtcataagaaatctcattataatttacttttcggtgtatgattttatagtgcctcactgtagctggtcataaagtttatcacttactagcactataggattcattatgtaatttgagctattatttaaatctggctgttctttttataattgtttttgaaaataaatgaagacatagaggatggatgattagcataatgaaaactggtttcatgaaacattcacactatagtgtactctgttcacatctagtctgttcctttctctttttagtgctggttataaccctctcagttaatttcaagactcatcaatcagtagcgttttttttgccccctgaaagtttactcgatagtcttaagagactgaaagagtagttgtagtgaaaggaaaacaccaagcttggcactctggatctaaggatttcctagcaaaaaaatacagtggagatgaacctgatagaagatagactctagaaaagaacatgacacatgagaggtccaagggagctgtgacttgccagggaagtgggagatcgatccattcccccagctcagggtccctgcgttggcatgtgctcactgagctgagtagcaagtagggcgtggtgcctgtttacgttgttttctctcactctctctttcgccttcttaacttaacgatgcaacttaaagacccgagtccttcagagctactgagacgacatcatgcaggagtggtcatccgtggctaatagatgttaagaaaatcagaattcagtagtttgtttcttctctcacttgactttgccaatgcatagagagcttaaatacctcatttaaaccctaaaaattcagcctcatgtccttcctcctccttcaggatctaagtagaagccagaaatgcatcagaaaggaaggttcatcagaaattagtcagagggtacaaagtaggaattatgtggacagcagcggctcaagccttcagaatggaaagtatatgcagaattcaaacctgacttcgggggcgtgccagataagtaatggcagtctaagcccagaaaggccagttggtgaaacttccttctcggtgccccttcaccccaccaagagaccggcatcaaatccaccacctatcagcaaccaggcaacaaaaggtaactttcacacatgtatagagaaagtatatttctgactgtatgtgatggtcatcatggcagttgaggtgtagtctctgcactcaagttgttcaacatctcatgcatagtagacagcatagtgatggcagtatacacaggctactacaggaacaaagaaaaaggatacccaagtcagctctgaggagcgagagacagatcctaaaatcagatgttcaggggttagccaggctgaattggggaaagtgacagaatagacagctttgaaggcagaggattgagcctgaggcagggcacaaaggggagaagcaggatatggggtatttgtgaaatggtagtcagttttgttgcctaagcatagtgtaatgcaggatagggaagagcccaggctgaagagcaggcagaccagactgtgggaagccttgtgagtcttgtgagggcctagtgtgatgaggtggaagggttttaaacagcggaagttcagaagtatgactytgtccatgcagaacacctaagggcttacttcccataaagaaagctctcccygtagtcttccaggtgctctcttamgtgtacttttcatcattacttacactcccttttggtgttttataggtaaacgtccaaaaaaaggaatggcaacagccaaacaacgtcttgggaagatccttaagttgaacagaaatggccatgcacgtttctttgtgtgacagagctgctgttgcagccattcttccctttggagaccagtctaggggtgcaggagcctggagcttccgctgtccccctgcctggagcagtttgtgtgtatagtaagaacactgcccgaagaacagaatgaacctgatgctgcattttcactgtgccacacccactcagcaataaccattttggacctggtgggggagaggaagaaggagggtagaaccttaaaaagagaccttgaactggaaagggtctcttgtcagggcttgaattttattttgttgttggtagtgtcttgatgtattttcagtggtagggtaaagaattatcaataatttatttaacagatttttttttaaagttaacagcttttaaattctttttttaaagctatttatttggaagatttctggagaaatatctcactaatttagatgtaagaatgtgaaggtttttaaattatttttgatagtgtgtgtgttacatgtggggaagggccacagtaacagtaactagtctggactcttaaatttgatattcaggttaaagtcttaaacagggatttgatgcattaattattttaaattaagatgtatatgaaaatcattttattttatatatttcatgtgttttttataagctattagcttcgcttttgctaacatccaaggtgcatactgttatccaggttgattaccttatatcccaccttccctctgcactccccatcattttgtgatgacccagtaagactcttctctttgcagggaaacactttcgtagccaatgtgtaagaactccatgaaagatccctcatttctcatttcgtttgacattgtgattttcttctcaacattaaaaaaaataggcttttgcattttcatttctgctgatgatatctgggtcccaaagagagcagctttaatatatttttcctacttgtgggaaaagtattataagtttggttaaattgtcatgtttatagtttttccaagtacatttgtaactacagcaggccttcttcgtactgctgctgttggacaacaggactggcacctgctgcagaggttataccttatgatacttttatgctccatacctgatttgttgggaaatgttatttaggatattcaaatctgcatcataagccgtaatataataggattaatactacattaagttgtatagaagcaagcatgttggaatagatcttttgtgtgtatttactttttttatttcttaattttctaaagaattacttaagatatggatttggagtaaaatgggtgcttttggcagtttcttccatctatcctaacctgaccagtacatattgaggttaagtatctggttaaactttaaggtattcatttatctcctttatgtatgatttttactaaatgccagttttcatttgcttatagtagcttctattttcccttttttccatccatggcataaaaataagtgatttctgggggtggggcagaaatgttcccaagtctgacaatagagcattttacaaattcctacaaagaaaatataggcaaatagataaaatttatttttatggagaagaaatatggccatattatggatttgtcttttttttactcagcaagatagcaggacttacccttctctattaagtatcacttgaattgctaagaagaaaaaagtctgtaccatcatctttcatggttgcattcaaatgtatattttcaaagagaaatacttcttgtgtccccattccaaaatgtcatgggataaatatgaaatagtttatgaagtagcctttctggttcagagtgactggaccaaagtctgaatcttatctgggtatcaggaaaaagaatttttatggaaatccttagtgtctataaacaacccgtgtaaaccctgtctacactatgccaaaaccagtggaaagatgggtagagtcatcttatctcaggatgtcaaaaatctgggtttgactgattcccctaccttcccacacagtatattcttgtgatttttgcttttctgtagatcctgagtcggtgttacaatagtcatgtttttattttgggttaagaaatacgaggtgtaagagctataatttccttttcgtgttatatcatgatctgggttttcttttttcctttacgtttttcacagctcttgagtattttctatttttttctttagtcacaaaaattaaaattaaactttatttttatgaattaaaatgaaatttaatttatttttatgaattaaaattgtggccagtatccactgtgtccttaggctgagaagtactaatttggagtagcccgtgtgtggaattctaaagtgaaggtactgtggattcatttttagtagttttagccccttaataagtggctaagttagaaaactttcagcgaggtaatagaaccacttgaatagaatccatgtgtctttttctgaattggtgaaaattcggccactgatccagtgactcctggtcaaacgtcttataacattactggccataatgcatccctttatctcatggaaatggctgaactttgtggtagctgctgcgagtacctgggcttaacagtaatagagaacctcatttataccatacagacacagcaacttaggaagacagcactgatagcatttagctagttgtaaccaaatacaaatatgtaaaattgagaattatgattaacatatgcaactttagtaataggaatagatgataattttcctgtattgtttcaaataagtgactgttcagctgggatccattggattataatttacaatgtcacataatattatgcttttcaatattgatgagtgatgtaaacaatataaagttggcagtttgtagtagttcagtatcctagaaatacattgaacttcataagtatcagttcatttttaagcatacagaattgaagattctgactgaaatcataaactcagaggaaacaagcccatctttatcactaattacttagcttgaatacttttctatttttaaataatcctaattattgccttttcaatatagtctactgtatttatttatatgggatcaacaggtatttatcaaacatctactgtgtgcccagcactacctagtactgttggggaacatcaatttgcagttgtggtctctgcccttgaaggtatcttctccaggaaattagcagtattattttcacttctaagcaaacatgagcaaaagaggacctgttcattaaaaaacatgctgacttttttagtttcaactgagatatgccactgtagaagtgaaagtaatttcacaattaaagaaatgcttcaacttggtaattaatatggtcatacagggacttggtgtagcatgcaaggaagcagaagacctgggcttttgtcgaagttctgccatttaggtatcagctgtgtaaccttgaataagtcacttaactctttctcttagttttctcatttgtaaatttggattaaagtgtttattatgataatcaattaagaaaatctcttaacacttcatacatacagagaacttatcattaagttaaaactggcaattaatgcacctttatatatatttttaaatgaaaactaatactattcatgatgtttattttatatcaaatatatgcccagggcatgctactttaaaaatccgaggaatctccaacaaggtgctggattaaaatcagatttygtgcttgaagtggaagaaaaatgaagttgtttatggataagagagtgagaatgtgtatcctcaagtacgttaagatgatttaactgaaagatggctttaggtttttcttgaagaattaggaaagtaccatccccacagattcagcatactcttcaggtactagataaaggtgaaggaagtcatggaattaaaatgacttagcaactccccagggaacttgtggggagaatgaggtggttagaaaggtgagaatgcacaaagacagctctgggttgggtaccaacagtttgcttggtagaaagaaaccagtgtaggaaaggagacgccaccagacatcttcaacagacaagattctttctgcctttttcaaaagatgctctctgcagcagtaagactatagatagagttgattggaatatcatgtgacccagtatgctactgctaggcataattatcaaaaattcatttttctcattaaatattgttaattgctcgccacataaagagaagctagagctcaccagtcttggtggtgtcctagaccttcctctaaagcagtcttgggaagctggatcatcagatctttagcctagacagagtgtcgctggtaaataaaggagacacaggtaacccagagtggacagtgatttgcgtggggagacacagtggatctggggcctctgatactttgcttcctaaaacagcccccagttttcggcttgccctatgagatgatgttcatgtgcttccttgaaaccaggtggaaagaaaggggaagaattaattttctcattctgttgctgttgaacgtaatgtaatcttaatactgtagccttcctagaagcccttccctctttttcatgctgtaaagtcaaatatttgatatccttaacataaattttaaaaattaaggtcattaggaagcaaatgtctatttccaaagcaatgagcttgttgtgactgtgattttattcttctatagtatttttttcctcattttaactgagaggagaaaataatactcttttgcaatatccttaggttctccccttccccctggtgccccttctagtgtcttaagactttgtcttaacaagtataacattacattttgttgttaaaacctttcgaaactgtattcagtgattcttccaagtttatctgctctgcactatttcactaataaaccctggctaccacgtagcccttgatctccaagtagtttacctatgcaagacctgtgacactctgaattcacttctctttctttcagaaagtagtcataaatggagcttaattataaaggtaaaacttgtctccaaccagtttcattttggccatttctttttcaaaatgtcagctgttttcctccaagatttttcaccaaaacaatgatcataagtgctggaatatataatactttgcaggcataaaataacccagacatactctcatatttctttggtgtattttggttggtaaaacttaccagcattaaatgtaaaatataatgaggagttaattccttacctagaactatttcttccttttaagattcataagtaaccttttatttttacagagctacgtataacttccacattacagtcagggacctgaggtgtaacttactaagtgaaccccaaggttattttatcttgcaaaagaaacctaaaccaaactaagggccttacagtttatggttagactgaatcaaaagctataacctcaatttttccaaaaacagcttctgactgcaaaagcaagtcatacagttgttaggtatgaaatagcactgatcaggaaatgcatcttcgcagatggtatttccttcagaaaagacttttctacttttaatataaattaagccataacagtttcatgctgtggaaagagggtgaaaaggttcattttaagagattatataatatgaactttcacatttactgtgaaatgtctaactttgccagtgcttcagcaagtttttttggggggtgatggggaggggtagtattggttttagaggtttcaaatctgtgaactttggagaggggacagttgttggctctggtatttactagttttgtagtaacgttttgctagcctgactgacttttcttactggtttttatgcccacggtccgaggggactgttcttcttgttgggggtgtctgcggaatagcgtctcgtcttgtttgtataggcagtcaatgtgtgtgacatgtgtgtcctttcagtccggaagcccactgtgtgacaatggcgtggggtgtggctgggaggtggggtgctgaagcttgaagagcatttctttgctgattcataacagtatttcccatcttttgcctgcaggcagggaaagtgtacagtatttattttgtttctgttttactttaaatttgtaagtctttaagtagcttacattgattattataggggaggacaagtgacttgtttaaagttgtatttagtattctttccaatttctgtattttaaaatattgaaattaaaattgtattacttctgttttgatttttttagcactcagtgtattttttgctcattttgtttgaaagtataaatgttgaaaattgtataaaatgcgtccttgaaagaaaaagaatctgaattctatatccaattctgactttgttccctttttctgctgattgaatcatgggaaattatttaaaagtatgaaaaactgggttcagcgtctgctccttactacttctgaagacttcaatgtgaaaagtaattgtcttattttattagcagtattgctggggatgagtgattgctcaaagagagggaagaatacaaaagtgtaattggcaacatgaggctgaaacgtagaaacggatgtgggtacttggctaatgaacatttcagcacactcacagcccctgcccaggcatcccacaaatatttcctaacacctgcagtacagtaggcactgttttagcactagtgctgcaggagtgagcaaaaccaagtcccaggcctcaaggagcttgtgtgagacacaaaaggcaagtgagagccaggggtgtggtggcctggctggctggtgaaggtgagagtgttaagtgcacactccgtgaggaagatgagctcagttttggactcagggtctgagagacagggatgatacggaccaggaaaaagatctgtccttagaggagatgagagaggaactctggaccaggaaggaaggagccctgcaggcatcacttccagggcagaagagaagcctaggaaggagacaagtgggcaggaagtctgttcccgaggagaaactgagctcagagtcccagaaaccaagtgaccagaaggaccaaagaccataccctccctccccctaatatctgcaaaagaacagggacgccaaagcatgcacacttaaacacaccttgagagctgcttccgcccctagaacggaatccacaaaagcagtttgcatctcctgtgtctgctttcatgaaattggttgaaatctaaatctgaacaaatctgcttgttttgtgaaaatccatatactatttgtaaatttgtgggttgtctgcccttcccaaagctcatacgttaatgaaacaatgatcaggacctactcttcttagacttttcagctgatttttgtggtttcacaacagtgagacagcatgagacacatcactgtgggatgttgatgataaatgccaattattttacagtaggaaggatcaaatgctatgttacagacaggatttgaaacaggagcccttactatcttttatttcattccatttgagtacttactgtgtgcaaggatatttttatttctttctcaaaataacccagcgaggtaggtactacattcctcatcctacagatgcatccaaggctcagagagggccaatgacacttccaggttcacatgaatacagacattttcagtctgtctgactctaaagactattctaagctgtttctctaagtatttttaactatatacttttaattaaggaaggaatagatggtccttaggaatggttggtgttgtaaaaatttctttgcaggcgcaacccactgtggattgaaactgtagtttcttgtggaggttttttgtcaccagaacctctcttgagtccacttttccaggagctgggcacactgaagaaacatcttctagaattgagctcaccttctagtgaataacataggctgtaaataaatgacatgtgagaagtgctgttaggatacaggaaccaaatgtggatttccagaggctcagagctggcatatgagtagaggccatgcccagtgcaccccttccgccctttctgctggacctaaccatggccccgtggggcagcgcagcagcctccttcacagccttgcccacccgggctgctccctcctctcctgccctggacaccgaagccacatcctgccctatcttctgccccagctctgtaggtggtcaacccagataaggaggagaggaaaaggtcctgctctgcccaccatcgctgatcctggggtgctgcctacccgtgcct

SEQ ID NO: 10562 - DNA, 64337 bp, Homo sapiens
  misc_feature (1)...(64337): n = A,T,C or G, or insertion/deletion polymorphism (see Tables 1-2)
attatgttttttctcacatcttttggagtaaaatggctcctaggaatttttactagctcccttttttagttcctatccagcaaactgggctgatgcgtggataggaagaagaaattatattctaagaaactgcttaaatatattaataactgaagtaaggggtactttatttttccatggttcttttatgcatagccatctcatttgaccagcaaaacaacccataagtattagaacagaaattattaaaccaagttgtggagattaagcacaggatgagaacattcacctatagactctggtgattgtctctgaagtcctttaacccgttgctgcccaaggcttctactctgtccttgggccacgcagaacctagttattatattagagctcactctcaacatgccccatgtgagtgtccagagcgcgaaagccctccccaacccacactacactcaccccccattgccagagcagcaggttgactgggctgtcaattccaactggggcttgaacctcaactttcctgggactcttacatcctatctagccctagactgaactcatttggcttgggtttcccagctctgacccctaccctacttatgccacacacacacatacacacacacacacagacacgcacacatgcacacatcaccatcactaccaccactgcctccattaagacgctggattgtttgcaagctgagtccttacaggtcgtcacgggtcccaaacccatgtagttgtcaaagctgtaacagaagcagtgtatgtctccagattcttccagccttgtttcctcctttcttccttccttctccctcattcccttctttccttgctttcttccttctccctctttctgtccctcactttctccctccctccctttctcctttctgtcctttcttccttctccttccctcttttccttcgccctccctcccttcctcccttccttctttctttccttctctctccctcccttttctcccatctttccctctctccctccttcccttaccctcctttcctccttcctttcttttcagttgttactttgttgtccttggacttcaggtgctgtcagttaaagtcctcagctgttatcaccactttatcacagtatcatcatctgtccatgcaaggcctctccattgtcctatttattaattgattcactcttttttcccaaagccactccctttgtcttccctcacaaggcaattgtaatgtgttcaatgtgtatctctgtgcttataagtggtataaaagatgcaaattgttgatttgcatgcatatatttttaattgacataaacagtttggcattctcattttgtttcctacttttttcattcaacattttgttttatgatccattcatgtagtaactaggtgttcatcacatccagtgcttctaattgctgcctccatggacctgaatatccacgacatttctccatcccctttcacactgactgctattcagttgccaagaaaagcagatgtgggaggaacctgctccgcctttaatcactgctgaattgcatcattcattctgcctcgtgtgtacagctataaagcattaactctcctagaaaaagtacacactaagttatgccaaggttcaatcctaaactggccaccaatctacgtggccctaagtttctcctgcccaccaatccctactaagaaatgtttagttttggatgtgttcagatgacatattgaacccatccttgctctatgtgagctcataacaggactcattaaacttgtttttgtttttatttttctgtttttgagacggagtctcactctgtcgcccaggctggagtgcagtggcgcgatctcggctcactgcaagctccgcctgccgggttcacgccattctcctgcctcagcctcccgagtaactgggacgacaggtgcccgccaccatgcccagctaattttttgtattttcagtagagacggggtttcaccatgttagccaggatggtctagatctcctgaccttctgatccgcccgcttcggcctcccaaagtgctgggattacaggcgtgagcccccgcgcccagccaggactcagtaacctttttccattggtggctgggggataaatatcttaggctttgagagccatactgttgtggtttcaactattcaactctgccattttagtgtgaatgcaaccatagacaatatgtaagcaaatgtacgtggctgcagtccaataaaattttattcataaaaggatgcagtgaactagattgaccatgagctgggtttgtttgtgagtcagatttggccacaggaagtagtttgaccatccctagtttataacaactggtctcacagaaaagaaatgagggtgattacttctgggactcctccttgtcttactgccatattgcttgtctactggtgagaagctgaggttataaaactctctcctccctgatatgcttttcttcctattctcctccaaacactgataaatcaaagcccatgatacttggcttacagtacacagccactaagtttgttgaatgaaaaaatttcatatatgcagacatttaagtttggtcttaaagatcaccagagaccaatccctgcaaatcaacagcatttcaagcttaaagtaagaggatttctgcctgggtgttttctgcctgctctgagaggcagcccactccttggtgaggcagcctcctgtgctaaaccaccagggatcagctacagaaaagcatttctgaggctgtacaggatgttttccggtacctgttcgggaaaccctcacttctgtctccttgttgtctattactgcacacttctgcagttgctgagtaatgctcctggagacatcatcccagcacagcaggctcccaatcacagctactgctgacagccagggaaacacagtcaaaatcctagaaanacacacttgacctggattgagggcagcagcttctggattcattcctttgctaatttcttttcttttcgtttggagacagggtcttgctctgtcscccaggctagagtgccatggcacaatcatggctcactgcagcctcgacctcctaggctcaagcaatcctcccacctcagcctcccaagtagctgggactacaggtatgtaataccatacctggctaatttttgtattttctgtagagacaggatgtttccatgttgcctaagctggtcttctctgctaatttctaatttcttaaagtgaaagtagattctctggattttctgttctgtgaagaaggctccttgggaagtagggggcacttcctcacactttggtggctatggctaaggtggccagaggactggtttcatcatcactgttcttaggtcttgacagccagttccaggtcagaatcctggaaaaacccctggacagattttgttccagagccagggggccatggtccagtccagataaaggatggagtgtattatgtttcttaaattgcaatatttgcagtaagccattgtaatccctcactgggcacaaaatgttaaaaggaaaaaggaagacagaaatagaagagagaaaattaggtgcaggggaaaggaccagaaaatctaaatataaaccaaaaagataagtctgttctatgaattttcatatccagtatactcattcaacaaatatttattttaattaacatttttaaaatggaaatgtaatacattcacatggtcaaaatttcaaataaaggtaaataatgaaagagaagccttcctctcatctgagcccctagggaaacactgtgtattcttccagagatattcccagaattgacaaacctattaaaataatttttttttgacagagtttcactcttgtcacccaggctagagtgcaatagtgcaacctcagctcactgcaacctctgcctcctgggttcaatctattctccagcctcagcctcccaagtagctgggattacaggtgctgcaaccatgcctggctaatttttgtatttttagtagagacggggtttccccatgttggtcaggctggtctggaactcctgacctcaggtgatctgcccacctcagcctccaaaaatgctgggattacaggcatgagccaccacgaccggcctaaaataatttcttaaatgatgtagagttcagcctcttgctttattcatttcattccatgtcttgggttgaaatctaccattttgctaatttttctacctttctattttgtcctacctgttttctgtttctttttctgttctcttttgccctctttaggattaatcaaagtttttgtttgtttgttaccattccactggcctccctcattagtttgttagttatgtaatatgttattttttatttttttgaagaattccctaaatgtgcaacattaattccaagagtgattgtgattacctcaggcccacacagatgattcaggataatctcctcatctcaaaggccttaattgcatctgtagaatccctttgccatgtaaggtaacatgtttacaggttctagggattacagcatggacatctttgaggagtgggggacatttttctgtctaccacaactagaaattcaaggattctagacttgaattactagatgtggaaatattctgtaaggaaaaactatctcttctctcctatttattcaattatttatttatatcagtatggactcatggatgtttatttcagtctatagattataacccaattgtactattatttttttattgctcaaattgttcagatttgaccattggttgctccttcagatgggttcctgtgtcgttttgacatatccctatccttttgaaacacttccttcttttctggtaccatatgatgttccaagttcattttgtattttctgtgcccaaaccctggaatctaccatttttcctgtggaactctggttctttttattggagaaaccaaggtctagaaatcaggcatgttcattgttattaagttccactcagtggacagttagaattaaaccacagacacaattgcttctcggccttttggctaagatcaagcgtaaaccacaaacagaaacacacacacacattctatacttgtgtatccattaaaaaaaaacataagttcacactgatacatctgattccagtccaacaacacaaagcttatttgtgtttctcctttccttatttgtggcttctttcactaacagtgagaaacccagttctcattatctatacttatttgttcctagtatataaacataaagtagttacagaactgctcacctatgccccatgtgcagattcttgtgtctttcgtcatataagatctagtcaaagtaactgtttttcaaaatgacgtaagtcagttctttccttccccatcctcttcaatatttttcattttttaaaaaattcgcagccaggcacagtggcttatgcctgcaatcctagcactttgggaggccaaggcgggtggatcaactgaggtcaggagttcaagaccagcctgaccaatgtgatgaaatctactaaaaatacaaaaattagctgggtgtggtggcacgtgcctgtagtcccagctacttgggaggctgaggcaggggaatcacttgagatggagattgcggtgagccgagatcacgccattgcactccagcctgggcaacaaaagcagtgaaactctgtcaaaaaaaaaaaaagaaagaaagaaaaaagaaagaaaaaaaattcgcttgttctggtttttatttcattttgattattcttacatcctgtttgctttgaagtgtttgtttatatttgggggtatgtgtaagatgctgattctaagagtcaaggctatacaaaatggtgtactcaacaatatatctagacgttcttcactgggagtcgccgaggtttcctgcttcaacagtgtttgcatgtaacacagtgctggtcctctacccccaccccccaccccacccctgcggctcacagtcagccctctgcctcctcctcaccaagccctcagacagctccaaggccccggctgctccaktgccacacagccgctgccacctctccttagcctccatgttgactacatcccccttgcaggtgagccaccactaccatactattggagggtcttgactgggagtcatccagattcttggcattttgaacaaagaattggacaaaatgcacaagcaaagcaactaaaggatgaagcaaggaaaggacagatttactgaaacaaaagtacactccacagagagcaggagcaggctgagcaagcagttcaagancactggttacagaattttctggggtttaaatactctctagaggtttcccattggttacttggttacaccctttgtaaaagaagatttggcccacgaccagtctgattggttgtgggaggggaccagcagctgaagtgaagttacagatgtactttctatttttcatctgcaaggcagcacaaagagagtagcctctgatcttttcgttacttgggcacggggaggtggggtttccttttgattcggttctaggacatcagtgcaaattggccttaggttcccagcctccacaccctattctcctgcctcaccaccagaacacagaggctgccatcaactgccagctcaacctggagctcacgctacacctcctaactcttcctgtccatatcttactactttgactgcgatgatgtggctttgaagaacttttccaagtactttcttcaccaatctcatgagaagaggaaacatgccgagacactgaagatgstgcagaaccagcaaggtggctgaatcttccttcaggataycaagaaaccatactgtaatgactgggagagcaggctgaatgcaatggagggtgyattacacttgataaaaaacatgaatcagtcactactggaactgcacaaactggccactgacaaaaatgaccaccactgtgttgacttcattgagacacattacctgaatgagcaagtgaaatccatcaaagaattgggtgaccatgtgaccaagtcacacaaggtgggagcccctgaatctggcttggcagactatctctttgrcaagctcaccctgggacagagcaataatgagagctaagctttaggctaattttcccataaccatgggtgacttccctggtcaccaaggcagtgcatgcatgttggggtttcctttaccttttctataagttgtaccaaaacattcacttaagttctttgatttgtactattccttcaaataaagacatttggtacacctccaccccccccaaaaaaagtcactcctcttcatcactatcagcacagccccattcccattacttcctacccatccctaagataatctcatttatacttcctgaatttttttgtgaaaacaagcagctatgtgtgttttatcctttttttcttatataaggaatggcatactatagatattcttttgttctttccttttcttctcttaacagtatattctggaaatcattccaaattggttcttatagattgtctttattcttctatacagctatacaatgctccattttgtagatgtcatatagtttattcaaccagttctctatgtatgggcatttaggttgtttccaatactttgcaattctaaacaatgctgcaacaaataaaagtgtacatatgcattgtgttagtttatttgcattgctaaaaaggaatactgtagactgggtaatttatgaagaaaaaagatttatttggctcatggttccgcaggctgaacgtgaaatgtagtgccacatctgctgctggtgagggcctaaggaagcttacaatcatgttggaaggtgaggggaagccaatgtgtcacatggtgagagagagagtgagagaggaagaaggtgccagrctcttttaaacaaccatatcttacatgaactcatagagtgagaactaactcattactgtgaggactgcaccaagccattcatgagtgatccatctccatgacacaaaaaccttccactaggcccacctccaacacgggagggcacatgaaatttggaaggtacaaaacatccaacatatataataaatgtttgtgctcttggagatatgtcttcaaggtgtttcctagaagtaggattgctgaatcaaaagtaagtgaatatgttgttttgatggtattgccaaatttttctccaaaagagttagtatatttttaaatattctgtgtgacaaaatacgaagtatacataaagcacttttgctgcattccaaagtacaatggctgccttgaagaaaagcatttgtgcaaataattgagttgtgagctaaactatcaattttttaaaatgacacggcagtttttaattgaaaaaacaaactgacatcagcaatagttattcagacttaggaatctggcagatattttctcaaacattaacaaagtaagcctgggraaaaaaaagacagtatttgttgccaattatgaaatctgagctttcacatgaaaattagaatttttgaaaactggtcccaccactatgagttttccaaaacttaaagaatcttcagatgagatggtggcaattttaactgttgggattttttttatattgcataataaaatatgtcaacattcagaagacatgtataactcatgagccaacatattcaaaatgaccgatgcataatgttataaaatcatacttaagtaaaagatccactcaaagagcaagatagacaaaactatatggtttcagattccacattcaaaaaattcttaagaaactactatttatcaaattctggcataatatcaaagaagaatgcccacaattacctgcaaaacctattaaactactcctcccttttccaactgcataattgcgtgaaactagatttccttcagatacttcaaccaaaccaaagtattacaacacatcaatgcaaaatcccatgtaaattcaactgtcttctcttaaaccacacgttgaagacagtaaaacaatgccactcttctaattaatttctcattttggaaactacagttatttttcatgaaaatatgtaacttgttgtaagactaagacggttcagattgcttctataacaaaataccataagttaggtagcatataaaaacagaaacatttgtctgatttctggagtttgagaagtccaagatcaaggcgctgggagattcagtgtctggtgaagagttgctttctggttcgcagatggtgtcttctccctgagtcctcacatgggggaagaggcaaaggagtccccttaagcccttttataagggcattaatctgattcatgagggctctgccctcatgacctagtcatcttccaaacacctcatctaataccatcaccttgaggattaggattctaacatgtgaattttggggcagggggacaaacattcagaccatagcactaatgttacagtaatggttttattatcattatttttgttcttgtttgttttattatgctaaaatatatatagcagaaaaattgtcattttaagaatttttttgttttgttttcttttttattataattatactttaagttctagggtacgtgtgcacaacgtgcaggtttgttacataggtatacatgtgcaatgttggtttgctgcacccatcaactcatgatttacattaagtatttctcctaatgctagctctcgcccagctccccaccccagaccggccctggtgtgtgatgttccccaccctatgtccatgtgttctcattgttcaactcccacctatgagtgagaacatgcagtgtttggttttctgtcctgtgatagtttgcttagaatgatggtttccaagttcatctatgtccctgcgaaggatggacatgaacttatcctttttatggctgcatagtattccatggtgtatatgtgccacattttcttaatccagtctatcattgatggacatttgggttggttccaagtctttgctgttgtgaatagtgccgcagtaaacatacatgtgcatgtgtctttatcgtagaatgatttataatcctttgagtatatgcccagtaatgggattgctgggtcaaatggtaattctagttctaggtccttgaggagtcgccacactgtattccacaatggttgaactaatttacactcccaccaacagtctaatagtgttcctatttctccacatcctctccagcatctgttgtttcctggcattttaatgatcaccattctaactggcatgagatggtatcttattgtggttttgatttgcatttctctgataagcagtgataatgagcatttttgcatatgtctgttggctgcataaatgtcttcttttgagaagtgtctgttcatatcctttgcccactttttgatggggttgtttttttcttgtaaatttgcttaagttctttgtagattctggatattagccctttgtcagatgagtagattgcaaaaattttctcccattctgtaggttgcctgtccactctgatgatagtttcttttgctgtgcaggagctctttagtttaattagatcccatttgtcwrttttggcttttgttgccattgcttttggtgttttagtcatgaagtctttgcccatgcctatgtcctgaatggtattgcctaggttttcttctagggtttttatggttttaggtcttacatttaagtttttaatccatcttgagttaatttttgtatatggtgtaaggaagggatccagtttcagctttctacatatggctagtcagttttcccagcaccatttattaaatagggaatcctttccccattgcttgtttttgtcaggtttgtcaaagatcagatagttgtagatgtgtggtgttatttctgaggcctctgttctgttccattggtctatatatctgttttggtaccaataccatgctgttttggttactttagccttgtagtatagtttgaagtcaggtagcgtgatgcctccagctgtgttctttttgcttaggattgtcttggctatgcgggctcttttttggttccatatgaactttaaagtagttttttccagttatgtgaagaaagtcaatggtagtttgatggggatagcattgaatctataaattactttgggcagtgtggccattttcacaatattgattcttcctatccatgagcatggaatgttcttccatttgtttgtgtcctattttatttagttgagcagtggtttgtagttctccttgaagaggtccttcacatcccttgtaagttggattcctcggtattttattctttttgtagtaattgtgaatgggagttcactcatgttgtggctctctgtttgtctattattggtgtataggaatgcttgtgatttttgcatattgattttgtatcctgagactgttgaagatgtctatcagcttaaggagattttgggctgagacaatggggttttctaaatatacaatcatgtcatatgaaaacagggacaatttgacttcctcttttcctaattgaataycctttatttttttctcttgcctgaatgaccaagccagaacttccaacactatgttgaataggagttgtgagagggcatccttgtcttgcaccagttttcaaagggaatgcttccaatttttgcccagccagtataatattggctgtgggtttgtcataaatagctcwtattattttgaaatacatttcatcaatacctagtttattgagaatttttagcatgaagggctgtttaattttgttgaaggccctttctgcatctattgaaataatcatgtggtttttgtcattggttctgtttatgtgatggattatgtttattgatttgtgtatgttgagccaaccttgcatcccagggatgaaactgacttgattatggtggataagctttttgatgtgctgctggatttggtttgccagtcttttattgaggatttttgcattggtgttcatcagggatattggcctaaaattccctctttttgttgtgtctctaccaggctttagtatcaggatgatgctagcctcataaaacgagttagggaggattctttttttttttttttttttaggcggagtcttgctctgtcgcccaggctggagtgcagtggtgcgatctcggctcactgcaagctctgcctcccgggttcacaccattctcctgcctcagcctcctgagtagctgggactacaggtgcccaccaccacacccagctaattttttgtatttttagtagagatggggtttcaccgtgttagccaggatggtcttgatctcctgacctcgtgatccacctgcctcggcctcccaaagtgctgggattacaagcatgagccaccatgcctggctgattccctctttttctattgattgaaatagtttcagaaggaatggtaccagctcctctttgtacctctggtagaattcggctgtgaatccatctggtcctggactttttttggttggtaggctattaattattacctcaatttcagaacctgttattggtctattcagagattcaacttcttcctgatttagtcttgggagggtatgtgagtccaggaatttatccatttcttctagattttctagtttatttgcatagaggtgtttatagtattctctgatggtagtttgtatttctgtgggatcagtggttatatcccctttatcattttttattgcatctatttgattcttctctcttttcttctttattactagcagtctatcaattttgttgatcttttcaaaaaaccagctcctggattcactgatttttttgaagggttttttgtgtctctatctccttcagttctgctctgatcttagttatttcttgccttctgctagcttttgaatttgtttgctcttgcttcctagttcttttaattgtgatgttagggtatcaattttagatctttcttgctttctcttgtgggcatttagtgctataaatttccctctacacactgctttaaatgtgtcccagagattctggtactttgtgtctttgttgtcactggtttcaaagaacatctttatttctgccttcatttcgttatttacccagtagtcatttaggagcaggttgttcagtttccatgtagttgtgcagttttgagtgagtttcttaatcctgagttctaatttgattgcactgtggtctgagagacagtacgttgtgatttctgttcttttacatttgatgaggagcattttactaccaattatgtggtcaattttagaataagtgcaatgtagtgctgagaagaatgtatagtctgttgatttggggtatagagttctgtagatgtctattaggtccgcctggtccagagctgagttcaagtcctggatatccttgttaaccttctgtctcgatctaatattgacagagaggtgttaaagtgtcccattattattgtgtggaagtctaagtctcttttaggtctttaagaacttgctttatgaatctgggtgctcctgtattgggtgcatatatatttaggatagttagctgttcttattgaattgatccctttaccattatggaatggacttctttgtctcttttgatctttgttggtttaaagtctgttttatcagagactacgattgcaacccttgcttttttgctttccatttgcttgatagatcttcctccattcctttattttcagcctrtgtgtgtctttgcacgtgaaatgggtctcctgaacacagcacaccaatgggtcttgactctttatccaacttgccagtctgtgtcttttaattggggcatttagcccatttacatttaaggttaatattgttatgtgtgaatttaattctatcattatgatgctagctggttattttgcccgttaattgatgcagtttcttcatagcattgatggtctttaccatttggcatgtttttgcagtggctggtactggttattcctttccatgtttagtgcttccttcagcagctcttgtaaggcaggcctggtggtgacaaaatctctcagcatttgattatctgtaaaggattttatttctccttcacttatgaagcttagtttggctggatatgagattctgggttgaaaattctttcctttaaaaatgttgaatattggtccccactctcttctggcttgtagggtttctgccaagagatccacagttagtctaatgggcttccctttgtgggtaacccgacctttctctctggctgcccttaacattttttccttatttcaaccttggtgaatctgacagttatgggtcttggggttgctcttctcgaggagtatctttgtggtcttctctgtatttcctgaatttgaatgttgccctgccttgctaggttagggaaattctcctggatagtatcctgaagagtgttttctaacttggttccattctccctgtcactttctggtacgccaatcaaacttagattaggtgttttcacatagtcccacatttcttggaggctttgtttgtttcttttcactcttttttctctaaccatgtcttctcactttatttcattaattwgatcttcaatcattgatatcctttcttccacttgattgaatcagctattgaagcttgtgcatscatcacgaagttctcatgccatagttttcagctccatcaggtcatttaaggtcctctccacactgtttattctagttagccactcatctaaccttttttcaagatttttagcttccttacgatgggttagaacatgctcctttagcttggagatgtttgttattactgaccttctgaagcctacttctgtcaactcatcaaactcattctccaatccagttttgttcccttactggcgaggagctgtgatcctttggagaagaggccttctgtttttttggaattttcagcttttctgctctggtttctccccatctttgtggttttatctacctttggtctttgacgttggtgacctagagatggggttttggtgtggatgtcctttttgttgatgttgatgctattcctttctgtttgttcattttccttctaacagtcatgtccctcagctgcaggtctgttggagtttgctggaggtccactccacaccctgtttgcctgggtatcaccagcggaggctgcagaacggcaaatattgctgcctgatccttcctctggaagctttgtcccataggggcacccacctgtttgaggtgtctgtcagcccctactgcgagctgtttcccaatcaggctacacgggggtcagggacccacttgaggaggcagtctatccattctcagagctcaaacaccttgctgagaaaaccactgctctcttcagagctgtcagacagggatgtttaagtctacagaagctgtctgctgccttttgtcctactatgccctgcccrcagaggtggaatctatggaggcagtaggcctygctaagctgcggtgggctccacccagttcatgcttccaggcctctttgtttacactgtgagatactcaagcctcggcaatggcggatgcccctccccatatccagctgcagcatcgcaggttgatctgactgctgtgcttgcagtgagcaagggtccgtgggcgtgggacctgccaagccaggcatgggagggaatctcctggtctgccagttgctaaaaccatgggcaaagtgcagtacttggtcaggagtgtaccatttctccaggtacagtctgtcacggcttcccttggctaggaaagggaaatcccctgaccccttgcaccccgccctgcttcagctcaccctccatgggctgcacccactgtcccagtcacartgagatgaaccaggtacctcatttggaaatgcagaaatcacctgtcttctgcattgatctygctgggagatacagaacagagctgctcctattcagccaccctggaaatgactccttatcttttattttttttgagatggagagtcactctgtcacccaggctggagtgtagtggcttgatcttggctcactgcaacctccacctcctgggttcaagygattctcctgcctcagcctcccgagtagctgggactacaggcacgtgccaccatgcccagctaatattttttgtatttttagtagagatggggttttaccatgttagccaggatggtctcaatcccattttaagaatttttaagtgtgcaattctaattatattaccacaaacaaaagcactatgttcttaaagcaataactcccattccttccctcccctaagccctggaaacatttaatctactttctgtctctatgaatttgcctattctagacatttcatataatgtaattatacaatatttgtccttttgtatctggtttatttcacccctagcatactgtttttcagattcatccatgttgtagcagaacttcattctcgtttatggctgaataatattccattatatgtatataccacattttgatggtatttagcattgcattgatggacatttgggttgtacactcctttaggctattgtggaaaatgctgcaataaacactggtacacaagcatgtgtttgtgttcccactttctagaagtggaattgctggattatacagcaattctagatttaccatatatccaatacttttttgaagtattaatattatttctaatgaatcaagaaatatttttagattttcattttaatttctaatgcactaaatactgataggtataacctatataaacaaacggtatttgggcttcccaataatgtttaacagtgtaaaggggttctgagagcaaaaagttttgagaacactgctatatagcaatgaaacttagcaaattagttttgccagcaacatgaatgaatctcacaaatacagtgttgagtgaaggaagcaacttataataaagttcagaacagccataactgcaaaattttcagatgaatatataggtggtaaaaccctgacgaaaaggctagatgaaattagcacagtatcaagatagtgattgtctctggaaataagaaaggggccacaatcaggtaaagagatgtggatggactggaggatgctcacaatttcttagtctattccctgcatgatagttacatggatgatcattttattaaaagctgttcttttcttttcattttatatgcttttcattatgtgtatgtgttttcacaatttcacaattaattttaaatgaattaatttataattaagttcacaattaaacaggttaacagaaagaaaattatttggagaatggtaacactaaagagagataatagtgccagaaacagagtaatttcggcagtaatggagagaaagacacagagaatagaattaccgtgatgggctttgaccatagcctggaaccagggaaagggcctaccttccctgcacactttgagcccctctttactagaaaaaaattaagggtctgatctcaaaaaagtggtgaaacatagtaagtcagcaaccaacaatatcttctataccaccttatttagtcagttacatttcctctgcaccatcctcttttactgaacttaatttttctgattacatatcagtacctaatttaaaaaaacttttttctttgtttttgtacaccatgatgaaatgggatataagtcccatgaaggcttggcccaaatctcccctcttctcagtgatcacccaatcgcttaacacagtgctatcacctactaaacagcaacgggacctttacagattctaggcactttcacttttttttttaatattccactccacgtcaaatcaaagatagtaaaatgtacctatggcccacatttaatataactgttttgctgtaaactttgtgtgatttttataatttttatacttttgagccttgtctgtgaaagactttgaaatggaccaaaacaaacaaacaaaaagacgagagtatatcttcaatggaaatctctatgttgtctaaagcacacccctttaggttttctgctctatggggttttcatctttcatagtctttgagctattttacaactctgtaaattgtagatagctggtggcaatgcaaatcattctggtctataaacatgaaaacacattttgttaggtggggagacaattgatttcccttccccctctcactatggaaaaagcagattttacatttatttgtaaattcatgtaagtgtaacttacatgtaactccaagttcaggacacatcgccccaaaatatgccacccaccttggcatactgartatttgcagctgaaggaatttgagaaatacatagtgcagaaaggtctctctgactttcccctgcccttctcccatgaaggagatcataaacctctcatgtgagaggtgccctccctacatccggaggaaagaagcatccttacctctgaagatggagggacacagagaggaatgtgagtgaacaggccttgctaygttcccccgatttactcattccctttgtcctaacacactcttctacaactttcccctcttcatcaaacctggcatcaaaacacaggtttaactgtttctttcgggttttctttccttaggaagtccccagtgttacaaaaaacttttattaaataaatatgttagcatttctgttgttcctgtctttcattacaagggccccagcctacaactctaagaccagtacaaggaaaagacatttttcctcccctgcatgcctgcatgtgtctctgctctttgaaatctcttttgtgacatctattgtgacatcatactatttctcttattaagttaaataaaattattgacatgttcattttatatttgtatgttatgtttaccttttttwaaaaaaattattttttagcagctttagacatcttccagcgatgtgcagagtggactcacctgacagaccaagagaaactgcactcccggagaagagaaatgcatccccaggaagctgaaggcccagtatgtaaattcttggctcctggagaggaacctgaggtagtgtgatggttaatattgagtgtcagcttgattggattgaaagatgcaaagtattgttcctgggtgtgtcactgaggctgttgccaaaggagattaacacttgagtcagtagactgggaggcacccactctcaatctgggtgggcaccatctaatcagcagccagcaaagctaggataaaagcaggcagaggaacgtggaagggctagactggctgagtctactgggctttatctttcttccatgctagatgcttcttgccctcaagcatgggactccaagttcctcagcttttggactcttggacttagaccactggtttgccaggggctctcagtgtttggtcacagactgaaagctcttaaggctgcactgtcggtttctctacttttttttttttttttttttttgagagggagtctctctctctctctctctctctctctctctcactaggctggagtgcagtggcacgacctcggctcactgcaacctccgcctcccaggttcaagcgattctcctgccccagcctcccgagtagctgggactacaggcacgtgccatggggtttcaccatggtggccaggatggtcttgactgcttgacctcgtgatccacccacctcagcctcccaaagtgttgggattacaggcatgagccactgcgccctgctggctttcctacttttgaggtttggggactcggacaggcttccttgctcctcagcttgcacatggcctactgtggcacttcaccttgtgatcatgcgagtcaattctccttaataaactcccttacacatatagatctatcctattagtcctgccctctagagaacactgactagtatgggcagcaatagaacattgttgactgtttctctcattttttttcccccatctccaccaattctgtgtcttgttttgttttatttcatttcatttgtttcttttgcatatggctgagaagtcatcccccagtggtggcaacaatgagcgggaatttggttttaaagtctgatcatttaacggtttctataaatggattaatatgttatataaatctgttttctgttaaataaaaagatgacagagaatctggttggttagtnttaatttgtttatcaatttgtctatttttagctcaaagacgttagtgcccatcgggaaggagagtagccctttgatatctgtaccagtgagtttttgtgtttctgtgccttctatctcttaacctraggctaaaactgtagaattgaagctctaagctcctttgtggctagacatctatttctgtaattcaagcctttacctcttgtgtgagtacaaaatcttttcctacctcgagagagtattaatcaattaaattttggtttcttaaagaagttctattctgattgacttaaagacataaataagtgcttttataaattgactattcctaaaattttaataaactgaggagattggatttctaatactttaaatgtactacactaaaatatgcttgcagaaacaaattcagaaaccctttaagaatccaagtaattttttttttttgaaacagggtcttgctctgtccctcaggctggagtgcagtggcacaaccatggttcactccagcctcacccctgggttcaagtgatcttcccatctcagcctcctgagtacctgggactacagatgcatgccaactacactcagattttttttgttgttttttaaatttttagcaaaaacaggtctctctatgttgcttagactggtctcgaactcttgacctcaagtcagcctcctgcctcaacttcccaaagtgctaggattataggcaggagccacccttcccaccttccacctttttttttttttctttgagaaacagggtcctgttctgtcatccaggttggagttcagtgacacagtcatagctcactgcagccttgaacacctgagctcaagccatcctttcgttttggcctcccaaagcactgagattataggtgtgagtcactgcaccctgcccaagctcacataattacagcaaatctttggcaaataagactgcagaaagttcccgatttaccatcgtttgatttagggtttttcaactttacaatggtgcaaaagtgatattcattcagtacactcctcagtttcaacrgggttacatccagataaactcatctcaaattgaaaatactggctgggtgctgtggctcacacctctaattccagcactttgggaggccgaggtgggcagattgtttgagccctggagttcaaagctagcctgggcaacatggccaaaccccgtatctacaaaaaatacgaaaattagccaggcatggtggcatgcgcctatagtcccagctactcaagaggctaaggtgggaggatccactgagcccaggaggccaaggctgcagtgagatgattgcaccactgcactccccctgggcaacagagcaagaccctgtctcaaaaaaaaaaaaaaaaaaaaagaaagaaaaagaaaatatcataaatcgaaagtgtttttggcttacaatactttcaatttacaatgggtttattaagacataactccatcgtaagtcaaggagcatttgtagtttaatatgtttggtttaataaaacagttacgtcttctctgatttatctgtgctgagtataatagaagcatacattttattctacttggctttgctttgtcctatagttatcaggttactgatcaaacacactaatattatttgtacataatgtaaatttgtgtccaacaaaattgaatcatgatttccaaaactttatttcaagaataattatgtttcatagcctgccaacttgaagataatttccaagatccttaggtagttgaaaaaccttgaactggtattaaattaattattagatatatggagaatatctacataatttctaagtaagatagactactgtaccatataattaattaattaaaagctctagaggggctatatctatgagtaatgttagtgaacatgttcacttttgccactttaagaacatgtaaaagagatgtgcatggctgtagaaaattgtttcaagcttttctagtttgctgtaaygctcatgtattgcaggaagttctcaattacccatcccacactgacttttctctgtaaatgagaagttagttactttgtttaaaagttataattaatgagtggttgccactaaggagcgatagtgacagggagatccaactgcatgtgtgttttgatatttcatggaaaaagagcggctgtcctcaaatttttggtctccaaaccattttacacccttggggcttgttgcagatctcaaaggttatctgtgtatgtagattataactatcaatatcatattagaaattagagctgagaattttaaaaatattggtttattgcctaatttgagaatagcagcgatgaacaaattgcatgtttacgtaagtaatatgttagaaatactttaaaaatttgttttgatcttttggacctgagatctgtccttatgtcgtgtgtcagtttgtcccagaatacctaagagcataaggaaagaccacacttggaatgtggattcagcttggcctttgtggatgatagctcagtctgaaaagaagtgatgaaatgtgttaaaatcttaggaaagttcattctattttgatgggtttgcttccctggtttattgatgcatgcctttgtttacaatatgaatggtaattcttcactgtctgtaatgaatactatgcttactttacaaaattaaagtgaagaattctttctgtctagagagaaaatattctgtgtcttaccagaataattttctgtgttatatgatgaccttataatgtctttgattatttaaggagaaaaaaattcctcatttatgaaagacataagggttttttctaactgcattgctgttagtatatatttttaaatgttttattgtcactttaattaaataggtaaccaaatattgcttcttaggtatccatggcctctcgtaagcaagtgtccaaactgttctgataactkttaaaaatttaccttccccaaataggatcctaaatgtagaaaaaaaatgaaataaaagtttcaagattttttttacacctaaaactttcatctttgagatttcccagaaagctccggggaaaaaaaatgacaaggttttctcttttactttataaaaaaagaagtattagaaataagtgggtttgtttgatatgtgactagtgtaagagtttcatgggaagagatatcagaagagacattcatcctgccccaggtgaaatctgtgtaagttaagtgaatacttcagaaattgtatgatttgtgggatgtccctggggatttgtcaatgttctcacttttttagcctatgttttcacctcagggaaaacactgatcaaaactcttaagaaatggtttctttcaagtttttctgtatttgttagtatcctggcaatgttttgtctgatattagacaacagcagtatagcatatagcattattaattgtaaactcagttattatttgaaatgctaacttaaccaaaaccttacttctttaatttgaatctagaggattctagatcattaattctcaactggggatatacatcagtcttacccatggagtatttttaaaaatataaaatagaagaatataagcaagaggaccaactagaccaatgagtcaatgaagaaaatttaaaactttcgtgaatcatgaaaatagaaacacaacataccaaagcctatgggatataccaaagcagtgttaagagggcagtttacagcaataaatgccatagatttcaaataaacaacctaatgtacatctcaaggaagcagaaaagcaagaacaaagcaaacccaaagttagtagaagaaaagaaataataaaaatcagaggagaagtgaacaaaattgagacaaaaaatacacaagatcaataaaatgaaaagttaatgtcttgaaaaataaagaaaatcaacaatacattagctagactatccaagaaaaaaagagaaaagacccaaataaataaaatcaggaatgaaagaggagacatcacaactgataccacagaaataacaaaggataacttgagactatatgaacaactgtatgtcaacaaattggaaaacctagcagaaatggataaattctgggtcacaaatgacctayccaagattgaaccaagaagaaatagaaaacttgaacagatcaattaaaagtaatgagattgaatcagtaataaaaagtcttccatgaaagcaagcccaggacctgatggcttcactgctgaattctactaaacatttaaagaactaatactaattctcctcaaactcttccagaaaattgaagaggagggaattatttcaaactcaatgtatgaggccagcattattgtgataccagaaccagacaaatatacaataagaaaagaaaactataggccaatatccctgatgaacatagatgtagaaatcctaaaaataaaaaataaaaaataaaaaataaactagcaaaccaaaactaccagcacattaaaaagaccattcaccctgatcaagtgggatttaacccagggacccatggatggttcaacatacacaaatcaataaatgtgatacatcacatgaacagaatgaaggacaaaaactgatcatctcaattagatgtaaaaaacacacttgatgacattcaacatcccttcatgataaaaaaaattctcaacaaactagttatagaaggatcatacctcaacacaataagggtcatatatgacaaatccacagctgtactgaatggggaaaagctgaaagcttttcctctaagacctagaacaagacaaggatgcccacttcatcctagtaatgaaagtcctatggcaattaggcaagagaaaaaaaatattcatcatagtagtgaaagtccagggcaattcggcaagagaaaaaaataacagacactttaattgaaaagaaagaagtcaaatgaccctgtttgcagacaacataattttatatatagaaaaccctaaaagtttcaccaagaaaacctcttagaactgataaacaaattcaggaaagtttcaggatacaaaatcaacatacaaaatcagttgcatttctatacaccaacaacaaaccagctgagaaagaaattaagcacacagtcacatttaaaatagctattaaaaaattaaaatatctagaaataaatttaaccaaggaggtgaactatcactataaggaaaagcataaaatgccagtggaagatattaaagagaatacaaacaaattgaaaaatgtaccatgttcttggactggaaggattaatattgtgaaaatgaccatgcaaccaaaagtgttctagagattcaatgcaatctccatcaaaattccaatggcattatttacagaaatataaaaggcaattttaaaatgtatatggaacyacaaaagaccccaaatagccacagaaatcctgagcaaaaagaacaaaactggaggcaacatacttgacttcaaaatatactgcaaagctatagtaaccaaaagggcatggtgtggcataaaaagacacatatggaacaaaacagagatccctgaaataaatctgggtatttacaatcaactgattttcaacaaaggtgctgagaacattcagtgggtaaaggatagcctcttcaataaatggtgctgggaaaactgaatatctatatgcagaaaaatgaaactagactcctatcactcaccatctacaataaatcaactcaaaattgattaaagatgtacatgtaagatgcaaaactgtgaaaccactagaagaaaacatgaggaaaatgtttcaagacatcgatgtgtacaaagattttatggaaaatacatcaaaagcacaggcaacaaaagtaaaaacagacaaatggaattatatcaaactaaaaagcttctgcmtagcaaagaaaacaacagagtgaaaagagaacctgcagaatgggagaaaatatttgcaaactattcacctgacaagggattaatattcagaatatacaaggaactcagacaacttagcaaaaaaaatcagatttaaaaatagacagattttaaaatgtgctgaatagacatctctcaaaataagacatacaaatagccagtaggtgtatgaaaaaatgctcaacatcactaatcatcagagaaatgcaaattaaaaccacaataatatatcatctcatcccagttagaatggctgttatcaaaaagacaaaaaataacaaatgctggagatgatatgaagaaaggggaactcacatatacatacacactgttgctgggaatgtaaactagcatagccattatggaaaacagtatggagattgctcaaaaaaactaaaaataaaactaccatatgatccattaattccactgctgggtatatgttcacaagaaaggaaatcagtatatcaaagagatatctgcagtactgtgtttactgcagcactattcacaataaccaaggtttggaagcaacctaagtgccctcaacagatgaatggataaagaaaatgtggtacatatactcaatgggatattagtcagccataagaaataataaaattctgtcatttgaagcaacatggatggaaatggaagacattatgttaagcaaaataactcaggcacagaaagacaaatattccatgttctcactcttatatgagagcttaaaaagtggatctcatagcagtagacagtagaatgatggttaccagaggccaagaagagtgggaaggggacataaaaagaggttggttaatgggtacaaaaatacagttagataaaaggaataagttctggcatttgatagcagagtagggtgactataattaagaataattgattagagtgtacccaaaacaaagctctagccaatcaagtctctgtgtgcctggagagactgggcagtttgacctttaagcctgaatattcaactgtcctactctttgaagcagacacaactgctctgcatcagaccatcaccacatttgtgtctctcaaaaccattcaaattcctgagcacttgatggatcatgctagttcatcaaatattgggcctttcctgaagaaaagaggctatatcccaatgcaagagcagaatccagcatcacaactgttcctctcagcaaatggctccttggaaacaaatctgccagtgattgtctggactgactcacccaaaagcagaccttggagaatagtcagacttctgcaagagcctgcaatttcttcagtagtgtctgggaaaacctaaagggcttagaaaactggctcctcaagagtcagtgacaggaagttcctgaaaaaccaagttatcaaaagtgtaacagccattccactaccagttctttctccattgaaactgaagatcaagagtttcctgaacaagatgagacagatctatcagattggttggtgactccctaggaaccccagaagctggagaagcctgagaatggcagtcgtgaaaccagtgagaagtttaagcacttgtgctagtcctacaatgtgaacgattggcttgtcaagaccaactcccgcaccaactgtcagggcaacaagcccaagggggtggagattgaaaacctggcaatctgaactgcctgaatgaccacttggaggccaaaacaccattgtccacccccagcgtggttactgggattggcctgtccagaagcatcatgacccaygtaaggtagaggagatgtgcaaagccaatgagccctgcacaagctttgcaaagtgtgtgtgtgatgagaattgtgagaaggaagctctgtgcaagtggcttctgaagaaagaaggaaaggataaaaatgggatgcctgaggaacccaaacctgagcctgagaagcataaagattccctgaacatgtggttctgtccttctagaaaagaagtaagagaacacaggcactaaaggtaatggttccttctggaacttctgattccttccaagtcataaagaacagctgtcagagtggctcatctggccgccatacaaaaaaggaagtcccaaggaagacagagctggcaaaccaaagcctaaaagccccatgaccacttcctggtgtccctttaacacagctgactgggtcctgccaggacagaagatgggcaacctcagccagttatcctctgtcaaagacaagtggctgcttggaaagaaggcccaggaagtattakttaattcacctctacaggaggaatataatttcctcctagaccttttcggcctccctgcagtttgtgacctttttgcctgtatgcagcttaagttgataaagagaagtggttacaccaaactcctctgcagatgtgaaggaatggacagcaagagttgagcagttttctgccgatmatcacacatcatgagctgagtgactacaggttgccaaatcattgtttctgagtctgaccagtgagcttagttcttctcctgcctaattttgtactagtgaagtgaggtgagtcatgagattgagttactgtttaaaagaaaaaccctgtttagcaatgctgaggtgactcagttccttccttcttacagaagtattaatccaccctacactagaaatgcagcaccttggtggacccatctttttcacaagcctccaagtctccttagattgggttgttactaaaagtacattaaagcactctagtcttaaaaatgaaatatttatataatcgaagtgtattgatgtattctaaagctagtaaacttccgtaacttttaattgccctatagatgcttctcttgctgtgggttttcttctgttagtggtcaaaataatgatttttctgttctgttaatatattgtatattttacaaaaaaaattaacctggccaatagtgattaccaaaaatatacattaacaatcttggcaatttttgacattaactaccaaacattttagcctacatgctagttctacattatttttcatcttcacttgaaagaaactcagctattgtctatttctttctgtaaatgttattaaagtatccagtgagctcttttagaagggctccgtattatttcaagactattttcagggtagttctggcctttcaaaatattctacagacctacagggtttaaaagaacctcagtgctgactaagcaaataggcaagacgttggaaatgtggtctagtacttgaaccattcactatcgtagggattttgggtgcatcctgtgtaaatggaagctgagcttgacacatctggtgcttttaactagggataaagttgtcctctcactgcaagcacagtatatctgtacctccaaaagtacaacgcagtgacattttgtgaacagaccattttcaacacttgtgccttggggtattcattgaagctttatgaaaactactgatgttttttcaatatccttaaagttatgtccatgctttaaaatgtctctgtaggagagaagagaggtttataatgtttttaaattctctaagatatttttgctgctttccagactttgaaactattaagcttcttaactgcctatattattagaaatacttctggggaaatttcatggtcccacaatgtcattgccatacagcttcactagagttctttgaaccacagctgaaaagagctttgtattattttttaatcccctccccagatatcatttagaactattataataaaggtggtgggtaataacaacctaaggagcctttctagttaccttaagttkcagctaactctgtggtttcttttttgaggcctaacaaacatactgtattttacattatcaaaatgtagtttacattactcactatgttaatgagtatataaaagattcttttgcattgatgcattttgtatctgccttcattaaaagcaaaacagccctaaaaaaaaaggaaaaaagaaagaaattaaccacagccatatgtctttgttacctacaaatggtttttgttttactctaatacatccctgaggtgatgctataaagtgaaggcgagagtttatgtcttaaataaagcttcccggaaaaggactatactaggtacttcaaactattgacatttcaaagaatagactcttgggtacagtcttctgatgtaacgtaacttagacaacactcagactgcacctgtgggctaaggcaagatttctaaactctttttagttgagaagcagacagcttcatgagattgctaacccaagatccagaggaacaagaattaattataggactgaatatactgataagggaaattttattggggttagctggaatattgtttttgttttaatgttctgttttctgaatctataagaaagccacttccctctcttcttatacttctttaacccatgacaatttagtaaactctgcttttgtaaactgaaatgacactgattttagaccactcctgcttacagagcacagagaaktcacacagacctgtgcccaccggcatcccaccccaagccaaaaccaccaccaatgtgactgctcacacatttgccagcagggtcctcaacagctgcattgcctccgccactgtggtgaacgcctgcagggaggcatgcaccccagcacctgtgagcaccctgccgcagctgccactactgacgctgctggcatgtatgaatgaggaagggtcccactgtcactgcactaagaaatgctttggctgacaccacccatcggagtgtagtgaccagcagtgtcggagcacctcactccccaccctcaaccagcaaagtagattcctaacctcaaggagccagagaacaaatttggggcccaatacaagtcccccagagttagagtgcgccgtctcaaagttaggatctgagtgttggccacctaaaatcttccagaaacaaagccagttggccgaatccaccttacaccaaaatcaaaccctcaaagtcatcaaataggataaaagaaaaaaaaatcccaaggtcagcaccctcaaagatagaaggaacataagtccacaaagataagaaagaatcaacacaagaaccatgacaactaaaaaagccagagtgtcttctttcctctaaacaaccatatcaacactctagtaagggttctgaaccaggctgagatgactgaaataacagaaatagaattcagaatatggacaggaatgaagatcattgagctacaggagtacattgaaacctaatccaaggaagctaagaatcatgataaaacaatgcagtagctgacagataaaatagccagtatagaaaagaatgtaattacttgacagagctgaaaaacacactacaataatttcataatgcaatcacaagtattagtagcagaatagatcaagtggagaaaagaatctcagagcttgaagactggctttctgataatagacaatcagacaaaaatagagaaaaaagaatgaaaaggaacaaacaaaacctccaagaaacatgaaattatgtaaagagacmaaatctatcactcatttttgtcccttaaagaaatagggagagtgtaagcaacttgaaaaacatatttcaggatatcattcatgagaactttcccaacctagctagagaggccaatgttcaaattcaggtaatgcagaaaaccccctaagatacttcacaaaaagatcatccccaagacacataatcatcagattctccaaggttgaaataaaagaaaaattgttaaaggcagctagagagaaaggtcaggtcacctacaaaaggaagcctatcagactaatggtggacctttcaatagaaacctacaaaccagaagaaattggaggccaatattcaacattcttaaagaaaagaattccaacccagaatttcacatccagccaaataaagcttcataagcaaaggagaaataagattctttaacaacttcagtcaagtttttaaacaacttcagtcaagtttttaaacaacttcagtcaagtttttaaacaacttcagtaaagtctcaggataccaaattaatgtacaaaaatcactagcattcttatacaagcaaatgctgagagaatttattaccacaagacttgccttacaaaagctcctgaaggaagcactgaaaatggaaagaccgttaccagctgctacaaaaacacactgaagtacacagactagtgatactataaagtaaccacataaacaagtctgcaaagtaaccagctaacatcatgatgacaggatcaaacacacacatatcaataataactttgaatgtaaatgggctaaatgccccaattaaaaggcacaagtggcaagctggataaagaaccaagacccattggtatgctgtcttttagagacccatctcacatgcaatgacaacacaggctaaaaataaagggatggagacaaatctaccaagcaaatggaaaacagaaaaagacaggggttgcaatcctagtttcagacaaagcagattttaagccaacaaagatcagaaaagacaaagaagggcattacataatggtaaagggttcaattcaacaagaatacctaactatcctaaatatatatgcacctaacacgggagcagccagattcataaagcaagctcttaggggccttcaaagagacttagactcccacacaataacagtgggagactttaacacaacactgacaatattagacatattattgagacagaaaattaacattgatattcaggacctgaactcagcactggatgaaatggacctgatagacatcaacagaactctccaaaacaacagaatatacattcttcacatcaccacatggcacatactctaaaatagattacatagttggaagtaaaacactcctcagcaaatgcaaaagaactgaaatcataacaaacaacctctcagaccacaatacaatcaaattagaaatcaagactaggaaattcactcaaaaccatacaattacatggaaattgaataactgcccctgaatgacttttgggtaaataatgaaattaaggcagaaatcaagaagttctttgaaactaatgagaacaaagatgcaacataccagaatctctgggacacagctaaggcagtgttaagagggaactttgtagcacttaaagcccacctcaaagagttagaaagatctctatatgacaacctaacatcacaacgaaaagaactagagaacaaagagcaaaccaatccaaaatctagcagaagacaagcaataaccaaaatcagagctaaactgaagaagactgagacacagaaaatcatctaaagatgaatgaatccaggagctgttttccttgaaaaaaattaatagaatagatagaccactcgctagactaatgaaggagaaaagagagaagatccaaataaaaacaatcagaaatgagaagggggatattaccactgactccacagaaatacaataatcatcagagaatattatgaacacttctatgtacataaactagaaaatctagaagaaatggacacattcctggacacatacatcctcccaagactgagccagaaagatattaaatccctgaacagaccaataatgagctctgagattgagtcagtaataaatagcccaccaaccaaaaaagcccaggaccagatgaattcacaactgaattctaccagatgtacaaagaaaagctggtaccattcctactaaaactatttcaaacaactgtggaggagagactcctccctaacttattctatgagtccagcatcaccctgattccaaaacccgacagagacacaacaaaaaaagaaaacttcaggccaatatccttgatgaacattgatacaaaaatcctcaacaaaatatggcaaaccaaatctagcagcacatcaaaaagcttatccaccacaatcaagtaagctttattcctgggatgcaaggttggttcaacatatacaaaataataaatgtgattcaccacataaacagaacccaaaccaaaaaccacacgattatctcaatagatacagaaaaggctttcaataaaattcaaccccgcttcatgttaaaaactctcaataaataggtattgaagaaaccatgtgtggtgcacatatatactagaacttaaagtataattttaaaaaaaattttgggggggaggtgccaggcgcagtggcttacacctgtaatcccagcactttgggagactaaggcaggtggatcatgaggtcaggagttcaagacaagcctggccaagatggtgaaacctcatctccactaaaaatacaaaaattagctgggcgtggtggcaggtgctggaatcccagctactcaggaggctgaggcagagaactgcttgaacccaggaggcagaggttgcagtgagccaagattctgccactatactccagcctgggtgacagagtaaaattctgtctcaaaaaaataaaaaaaaaatttaaagaaacagattttaaatatctgattctcactgagttcccagaattcagaaactcttaaagaacctccttacttttcatggcaatatagttatttgcataattttggtaggaattggtcctgcttttcaccataatataattaaataattgatagtacaatcaaggccttatccgaagtgtcatatctgagaatggtgctcatttaatcagatatgaacaccagtttgttttaacaaacgsaagttggtcatacttagagaatcagtgcctacaaagccctcccaggaaaactggcctggttcctggctgacagagtccccaccttttgaggtgttggaaaggtcattttctagtacaccagtaacgttaggatattcagggaccgtaagaaaagaggatttcacccaaattcataggtactgcaggtgaaatttggtagagagagtttcttggaattgatttcctagcctcaagatagtaaatagnagaggcttttaaacccatctgatatttttatgaaaactcccagacataagttaatttggtagcattagttgttgctcagtactatatagctcaagatttgcaaagactggcaaacttaagaaaaacgatatgctaattaacatccttgctgcatctatgtaaacaatcaggctaaacctaattgaaatcagccttattttgtgatcaagaattctttctttgagattatgtaatcacaaggggaagaaggagattgttagaaaaaaattgtgaaagactttgaaatgtactaaaaactaccaaagagattactggatgtttttattggaaaactatgcgttgtctagagcataccactttggcttatctaattctatgtggtttagacctatcctatctttgagctattttaccactctgtaagttataaaaataaaatgatagcaatgtaaacaatttttttctataaacatgcaaattaattctgtctggtggaggaacaattgaatcccaccccaccccaacaattatggaaaaagccaattttgcatttatttgtaaattcatttcatgacctacatatagctctactctttgaattctcctttgaactacttgtaacatcttactgatttcctcatgaattaataagttaaataaaatatttgacatatgttcactttgtatatttatttgacagtcatggctttatcttaaaaaagtatccattaacaagttaaatttattttgtttttgtggtgtaaactctattatttatatataattataaaagcattgcattgtcaacagttaactggttgacataattttagtttaatagacactcaattaagcatttattaaattttgctttctatcttggagttaataatttaattttaggtttctaacattcttgcaggtacttgaaaagttcttaagccctaagcactgtaactgtggggcaaaaatcaatataataactgtgtagtcactcaataaatacttgttgaataaatgattgaattacaaataatatctatcattttggtggcatttcccaagtgccatacattcatatacacaccagaaataaaaaatacaagatgaaaaataaactaggtagtaagatttgttggaaattattattgttattattattgttgccataatggcaataaggcaataataatgggctaaaacaggctgaatatcttgcckgcaattgcacagttctaagtgccagaagtaatatttgaacccagttttctgaccacagagttcataccttttcactacccaggatatggtcctgagtcttgtgcctctttgaggaagtcccatcatggtgattcatattttcttttcttttttttttttttttgtccttctactctcaagccccattatccttgttcttggctatggagacatctcactggaaagcacagcactcacaggccttggatttctagttctgtgagcaggagtaaaatcctggccctttctgaagctatgtattcttgagcaagttatttaatatatctattaaaataagaatattaataacatcttaccataagggtattgagaaggaaaatgagataatgaagtaacaagcttggcactgttcctggcacagagtaagtgctcagtaagcagtggtcgaggtcatagttgcttacagattcctgctcctctctggccactctaaagcctctgaactgcagtcaagggcggcagggattgggttaggatggaagaaatggtagcgagaggacacgatttgcataagcctttacattttatgaaaactctttctattccacaatggaacaagtcttttgaagcaaggcagtacaacctagagacaatttaaacaaattccaactggagagttacaagagagattgcaaaaagaaactggagtcatgccttaatgggtccaaatcccagtggctctgagccaagcaggctccaaatctgcctcagctcctgattgcactgagcccaaatccttctccaggccccagaaataaaagggaagtgaggagaggagaccacagggcatttgggggcccaacttaggccaagccaaaaactcaagtctgggtctcagtctttgttcttgaggaagttatttgtcagcaaatggaggaaaacctgggaggggattgtgttgttggaaaaaaatgttagtttctaatgcacacaaagtcccgaaataaagctcagcaaagcagccactgtgtctcccattgcttttgtagatccccgtggccttagccactgtgttctacacatagggggctctaggtaagtgccgatttcctaaggaagatatgccaggctgaagcaagaaaagcaggttaggtaggggtcttaactcatttctgaatgagtgtgactgtgatctgcactgtcatagcacgggtcttgctctattcaataaccacctccaaaaagagtgtggggttgtgcaggaggggctgtggagaggtgggagaagtcatcattacaggtatagaacaggactctgactttcatcacaacctccagtgaggtcttccagacccgccaaatctcacaacttcagttgagacttggacttcaaaatgcgctccctgtcagctacagtgtggcatagagaaggagcctgggctttgtttgcctttaacaaaacactgggttgaaaccagccacttacccacagagtgacttcatttacttaacacctctaagcctcagtttcttcgtttctaaattaaggttaataacatagatcccatacggttgtcgtaaggattaaatgagataagtgggaattaaaaacacttgccttgcaaggtgttttaagmttaaataagatgatgtatgaaaatccaagcctggcactaacaggcccttaattgtgactggcttggtttgagggagggctataaatcaccccctctccttttcatgatctgagcaagtgagatatagaaaaaaaaaatggagtctaaaagattagctttggagccagtagagatggataagagacagaggcattggcctgcagacaagggggcttcctaacattttaccttggaatcagcagtgtctctccagtgctgtttcctcgtaaggagtagagctaacatttcttcatggaagcatcaggaccggggagttaaattcttcctggcagtaatgtatataactacccctcaaacagacagcacatattattaaaaacatcccactgttataaacaggtatgaacttgccttcttaattcaagtcctgacccttcaacttgtggtcttgaaacatgtacatcactcatccatgtgttaacatcttaacaaggaattcttcacagatcagcttttcagagaagcacaggatccctgggtgatcaatttctcttccccacacttaagccacatccacagactttctattttcatcacaacactataaatatcacagtaacattttaagtacctccttaggttttctctcctcatctgctgtccctaaggagcaggtggggtgcaggagaaaagatggaaaccatgctcaaggagccccagcctcctctgctctcttcaataaatgctgatgtcctgcccataagcctggcactggattgggactggctcctggtcctatcaatttgaactttctacctaatactactatattatgtcaaatcttctaggcttcttttaaaactctggatgagcataggagctcagacacacatgtacgcagttgtgcatgcacacgtatgctcacatccactcackatcacccctcactctcagcaggtgatgcctagatgacgtctcctgcttcgtacagacaataggaaccaccatctggaaagtccttcagagtcacacattcagagctacaatccacccacatccacrtgcattctcttttcctttccctctcctgtaagaaagttcaatcaaagcaatctgaggcaagttctcttacctatttttggatgccatcaacccctccttctcaggaatctttactttcaatgatcctttttctcttttgtacatgcaagctctatatttccattgaattttcatgaagaatgtgctcccattaaaaaaaaaccaaaaaaacaaaaaaaaaacctctctcaccccatcctcattggtcaactggcaccctgcctcctccctgtcgtaaccaagtgtctcaaaagtgttgtccagccccactgacaacatctgctcatgtctcactcagtcctcagaccaccccaatctgactctttactccaccaaaaaaaaccaaggctaccaatgatctccaagttgctaaatccagcagtttccagtccttgcctcagttgtgctcccagcagtgtttcagaatttgaagactcccttggatacctcaaggcaaccaacgtcacagccttgccgctgaactgatcctgacttggttctccaagttcaagagggtttccatcatctaaccagctgccagaattcacctggagccacccacaacacctctttccctcttaccctctacatccaaytcaccaacargtacactgttctgctttcgaaatatttaagttgatctgtttccctccatttcactgcyatccctctccaagccaccattttctttcacttggtcaacaaaactgacctcttaagaagtcttcctcacagagctttctgtcctgaatgaacagaagctgagtgttatgttttttaatgcaaatttggtttcctctctctctctctctccctctctccctccctctctccctccctacccttcttaaaacmcttcagtggttttatattgcttttagaatccaggtccaaatccttaacatggcttataagatccaacaaggtctggcccctgcagggcctccatttgtctcatagtttgtgtggagctctgcttgaagttgtgcagtgcacaggttgcacagctgtatacctaggtcctgggccctgacctatctttccagtctcatctctaccactctggcccttctattctaaactcagccacattctcatttctcaaatgtgtcctgctcactccagccaacagtgttctttgctacgagtacactctattcctcgctcccaaattcttctcttcgataattttcaatcaaaagtcacttcctcagggtagctgttagtattgatcacagtcccagcaagaaacagacagcatactccaagagggcgagtgaaaggagtttaatgaaggggcatgttacagcatccggacggggtcaagggaaaccagcaagggctggagaagcaccctgagctggaccctgttgccacccctgggtctgaaggagcaagaggaggacaatgcagctgtaggagaggggcctcctgacagcagctgtgatccccaraagaggagcacaccaccactaaactgtagcccaagggggaggaggccaggctagaaacacttctacccctcccctttcactctcttatctctcgctggtgtctcccattggccaaacccacccaaaagtcagagggcaagagccacagtgttgtggctctctagggatcagaacaactagaagaggttgctctgacctggagagcaagtggagcatgttgcgcctaccttctctcttcaccctcattcagctctctttgatatacgctgctttaacacagcactctcttccttcatagttattctccccatttgtatgtttcctatgttaataatttgattaacatcaaattattatcaagtaattattaattatttgatacggataatttttcatatcaaatgatggacacgatgtgttcataagctcatgaggataagcaccacttggattgccagtgcctggcacagtgcccagtgtggagctctgcaaacatctgttgaatgaataaacatcctcatcaactgctgattatagggtgtttatatactttggcccatgtttgtgaagactaaggaaggcctggcgttaatgggaagggcaaggccctgggtgagacagacagtacagatgaggatccncatcagagtgtcagggaggtccagaaccttcactccanattcagtcgaaagtcttaatgaagcctctggaccaaagctccagcttttctcctgccccatagacagaaatagtgagagggttccaactggacaatgggccagatggggcaataaatggaaatacaaaacaaaggaaatacatcagaatttagagttaaggaatccatgtcctcccctgctctgacacttactttcctctgacacttacttggctgtgtaactttgagtaatcatgcaactccctggctctcagtttcctcgactgtcaagcaggaataacgactaaactttccattacagttgctgggaggaccacatgaggacatgtgttacgtgaaatgtagtttataaattcttaagcactgaacaattcatcccttggtttcagagtcacacaagatggttctaataaagctcatttcctaatttttgtatggggagggcactcattctggaagcaaaatattcaccacagatactcctgagcctcatgggacctcattcaccagggcggttcctcagagtggccctacctagtggcaatgggaataattattgtaagcacctaaacccctccctccaaaatcaggaaagtctctcgctacttctcaccccrcttcctcagcctgagagaagctcccagtggccaatcagaatcatcacccctagttttctataagcacacacatgagaaagatacacagtggctcatgcctgtaatcccagcactctgggaggccaaggaaggcagatcatgaggtcaggagtttgaaaccagcctggccaacatggtgaaaccccatctctattaaagatacaaaaaattagctgggcgtggtggcacgtgcctgtttcccaactactcgggaggctgaggcaggagaatcgcttgaatccaggaagcagaggttgcagtgagccgagatggcgccattgcactccaacctgtgcaacagggtgagactctgtctccaaaaaaaaaaaaaaaaaaaaaaaaaagttgcctcagtttccccatggatcacttgctacatatttatgaatgtgtaattaggaacgtgtgatgtcatcatttccaattatgcggttttagcttgcagcaatgacacattaccctaatgtgtgcttccttctaattgataattatccttgatccctgtaatcatgatataatatctctaaggcagaagtgctcttattttccttttcttcttcctttttcctcctnagrttcatccttccggtggattcctgatatctcctaaactcattgtggatttccttacctctccaaacagatggctcagtgccattaactttgtaatttcatctttgaaaaatctaatctttgtactcccttctctgctttccttaactttttaataacacagacttgtcagaacagaaattgcttctggcctggaacaggctgtgctatcaatggcatgtatattgctgaggctggggtggcttcactttgacttgacacaaacccaatcaggatatgagacctccgaagattttcatctttatctgaggtctcacagttgttaagcaagtgggaatgatattgatgtctgtatacctccttgtaattcacaccaaaaagagagagagaaagagagaggttcctgacatttatctcttaaacaagacatgtgagcagccagatgctgtctgacaggacaaatatttactgtgcctgcaaacagccctgaatgccagtccagccacggcaaagactctgacccaagctgatcgacattcagtggagacaccgggtcccaagggctgaggattaaggacattatttaacactgaaccatgcacaagatttgtcttgttggccttatatcaaaactgggcattttattttcatttcctggattctccatgggctcacattctttagggcaagtagctgtgagaccttttcattcctgcgaaatctgtctccaggcccatatttcacccagcagtcagaaggattatagaactgcagagttcttctgaagatttgctagctctcctccaaaaggaaaattagactcctgaagatccacatcnccactaaaagtaagcaaggagatgagagacccgtctggggactgtggctagaaaaagcacttgaggcattttttgcagcagagtcttgaacaaaccaccgaggaaaaggaggggcaagaatttccactaacaagcttgacagttattctgtagctcatagagaagtcgtgcttacttcagcagcattatttttttctacagaaatgtctgattagcaacctcctagaatgatagtgcttaattgacactggccacaaaggcgtttgagaagttttatcccctgcctttcatataaaatacttaaagttctgctgttgcaggcaatagttgggaataagtctttatctctctgctccgctagcttcccaggcgaccttcctttccagggaagccatgtgctgcttgcttctgacgctctctggtttgattccattgagtaagctgtttaacctctcatgcctcagtctcctcaactacctgagatgttgaggaggaattaaatgagaacgtgtatctaaagctcttctagggcctgagattttgaagcagacactcactacatgttaactctcataggtattatcattttgacaaatgtcaggcttgtctcagctgaggtgagttgaggctttctccctgccttggtcaggataatgagggctgggtgtggcagatacggtaatagcccccaaatgatgttcatgtcctaatccccagaacctgtgaatattaccttatatagcaaaagggtctttgcagatgtgatttagatggggagatgatcctgtattacccaggtgtgtctagtgtcatcacagggtcctctcaagaggtgggagcaagagtcaaagtcggaaaacaggatgacgaagcagagctcagagaggagagatgatcctacactggagagatgatcctacactactggctttgaagacagagcaggaggacacaagccaaggaatgcaggaagcctctaggaactggaagaggtgaggaaacaaaatstcctctacagcttccagaaggaacacagccctgccaacaccttgattttagaccagtaagacatctgacctccagaactgtaagataataaatttgcattattttaagccactaagtttatggcaatttgttccagcagcccaaggaaaccaaggtactgggtaacagtagagacctgtgggtcccatcaggagcagaggcaagaacgcaaaggaaactctagagggatggcctcggggacatggactccatcccaccagagggctccttgcagaggcctcagccctgcaaggaagagaagctgctgtccctcctggaaagccttggcatcaatgaggcttgcctcaaggccttgaggggtgaatggaggggctggaggacatgctgtccatagggaaattccaaggtggaagatgggaagtgagaactgaaaggctattggagcattatttttttagacagaaatgtctgattagacggggctgctggctgctgtctcctcagagaactgcagaggaaggggcgtgatgggaaggtgtggccacagcggcaggctcagtttccacaatctgcttaggtactcctgcaataaggaggytattttcacacagggcttatgagactcagtctcatctctccatagactctgtgcttttctcatttcccctacaggccagcactcaaaaatacataatggatgaataaatgaatgaatgaatgaatgaaccaacaagtaaaaagagcccagatgttatcacaaaatatcaccatttctcttggcttggaggtgggggtagggggctgggaatgggaaggagattgggaaaagatcctttttttccttttaatcttcccaggaaggacctgactgagcaaatcccttccctacagtcagacacactggcaggtgtccttgggcccagattagaaaggtggctccaggccctaggtgctgctgctgtggttggtatgcaggcaaacgctcccagtgcattcgaaatctgagggggtggatgctaataacccataatcaatgttgcatttgccaacagccaaaagaaaaatgaacctttaattgagcaagatttggcatcaatcaatgatgtgactttagtcaggcaaaagcgacagattactgagccggacacccaactgtgagaattgctctctactggggtgaagaatgcaaaatgtggataaacagcctatcttgccaggcccaggatcacaactcactggggaaaaacacctctttatatctgtttgtaaatctttttcattattctcttttttatgttctaagagcttaagttactttgtacctctgagccccttcgcagaagtattgtattcttatacgctgatgataatttctaagaagccattggacacaatggaatcagcagattcccagcacccagccagagagctgatagaagaggagcttgaagaagcaacagtcggaggccagagaattctggcaagatggtggggatgatggccacacaggttttggatcttcctaaatccccacctaaaaacagagatactaagtagcaacaccnaaaaacctggccatgaacaacatttatcacaaactagctgatggggtatccccatgaaccccaaatacaagcaggtcaggataaaccaccaactaagccctgagcgccctcactatctgtgagggagtagagggaagtcttgggcagctacagacccagcacaggagaactccaaacaccaacagatgggaagcgctgcaggcctgagaccagcagctgctactgggaggagcgtgtaacggatctgtggtcggctctgaactatgaacttttgaaactgaccagccagggttcccctccagcacagggccccagagcaagaaaactaccaggagggaaatcaaaactgagccggcttgggctgcagactgatgaaaatcagcgtgtgtgtgtgtgtgtgtgtgtgtctgtgtgtgtgtgtgtgtgtgtgtgtgtgcgcgcgcgcgcgcgcgcacgcacgccagtggcctccctcccacctgcctagatgcttggaaggctctttccttcctgtccatggccaggattttggtgttgctacttagtatctctgtttttaggtggggatttaggaagatccaaaacctgtgtggccatcatccccaccatcttgccagaattctctggcctccgactgttgcttcttcaagctcctcttctatcagctctctggctgggtgctgggaatctgctgattccattgtgtccaatggcttcttagaaattatcatcatcgtataagaacacaaaacttctgtgaagggactcagaggtacaaagtcagttaagctcttagaacataaaaaagagaggccctcctgttgctctcagccattgctttgatgacgtgtatggacatagttctgcagctccaacacttctcactcctttcagacatggttttgcattcaccctctggcttcatgcataattccaatcgattagtcctaattctgccctcaggagttacaaagaaatctcctccctcttccatatgacaggtttcaaatatttgacaacagctatcgggggccctctaaagaacctctttttcaggccaagcatctccagtttcttcaaaagctccctccaggatgtggcttcctgaagcctcagccctggccacctgcctctgagctttttgcggtgcagagaagcagcatggtagagtggaaaaaacaccagtcctggtgccagagagcttgtgtttaagttctagaacttccacctcctggcctcagttttttatcctctctgagcctcagtttttttcatctgcaatatggggataatatgaaatcctgggtttattgtgaggctcagggagttaataaatgtatccgctttgagagccctagagcatggtaaaaacatatatatatacatacatacatgtttgggtattatttctccaagttgtaacatcagtggcacttcaagagcctggaagagaccactccagaagtgatctgtttagaggagggcacaatgggactattctgtccttattctagtcccagggttttcttattgtagtttaagttacacaaacttggcagatccttattgagccagcagtcaactgagcaagagccactccatttactttaggctcttaattgtctcagacaaggttatacatagtatcacacatcaccttaataaagagagctgctttcagccccatacaaaggacctcctatgttgaattagataggcccatcattctttttccaacttggtcccaaggaatattttatctgggaggagagtgcagagattatcctttctcattaaaaaacactgtagtctgctcaggggtcaggggtcagggacccacttgaggaggcagtctgcccattctcagatctccagctgcatgttgggagaaccactgctctcttcaaagctcagatggaaatgcagaaatcacccgtcttctgcatcgctcacactgggagctgtagaccggagctgttcctattcggccatcttggaggcaccccccagtaggagcagactgacacttcacacggccgggtactcctctgagacaaaacttccagaggaatgatcagacagcagcattcgcagttcacgaaaaaccgctgttctgcaaacaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagarcagaaaaactggaaactctaaaaagcagagcacctctcctcctccaaaggaacacagttcctcaccagcaatggaacaaagctggatggagaatgactttgacragttgagagaagaaggcttcagatgatcaaactacgagctacaggaggaaattcaaaccaaaggcaaagaagttaaaaactttgaaaaaaatttagacgaatgtataactagaataaccaatacagagaagtgcttaaaggagctgatggagctgaaagccaagactcgagaactacgtgaagaatgcagaagcctcaggagccaatgcaatccactggaagaaagggtatctgtgatggaagatgaaatgaatgaaatgaagygagaagggaagtttagagaaaaaagaataaaaagaaatgaacaaagcttccaagaaatatgggactatgtgaaaagaccaaatctgcatctgattggtgtacctgaaagtgacggggagagtggaaccaagttggaaaacactctgcaggatattatccaggagaacttccccaatctagcaaggcaggccaacattcagattcaggaaatacagagaacaccacaaagatactcctcgagaagagcaactccaagacacataattgtcagactcaccaaagttgaaaggaaggaaaaaatgttaagggcagccagagagaaaggtcgggttacccacaaagggaagcccatcggactaacagcggatctctcggcagaaactctacaagctagaagagagtgggggccaatattcaacattcttaaagaaaagaattttcaacccagaatttcatatccagccaaaataagcttcataagtgaaggagaaataaaatcctttacagacaagcaaatgctgagagattttgtcaccaccaggcctgccctaaaagagctcctgaaggaagcactaaacatggaaaggaacaaccgataccagctgctgcaaaatcatgacaaaatgtaaagaccattgagactaggaagaaactgcatcaactaacgagcaaaataacaagctaacatcataatgacaggatcaaattcacacataacaatattaactttaaatgtaaatgggctaaatgctccaattaaaagacacagactggcaaattggatgaagagtcaagaaccatcagtgtgctgtattcaggaaacccatctcatgtgcagagacacacataggctcaaaataaaaggatggaggaagatctaccaagcaaatggaaaacaaaaaaaggcaggggttgcaatcctagtctctgatgaaacagactttaaaccaacaaagttcaaaagagacaaagaaggccattacataatggtaaagggatcaatacaacaagaagagctaactatcctaaatatatatgcacccaatacagtagcacccagattcataaagcaagtcctgagtgacctacaaagagacttagactcccacacattaataatgggagactttaacaccccactgtcaacattagacagatcaacgagacagaaagttaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactggaactcaggattaagaaactcactcaaaaccactcaactacatggaaactgaacaaactgctcctgaatgactactgggtacataacaaaatgaaggcagaaataaagatgttctttgaaaccaacgagaacaaagacacaacatactagaatctctgggacacattcaaagcagtgtgtagagggaaatttatagcactaaatgcccacaagagaaagcaggaaagatctaaaattgacaccctaacatcacaattaaaagcactagaaaagcaagagcaaacacattcaaaagctagcagaaggcaagaaataactaaaatcagagcagaactgaaggaaatagggacacaaaaaacccttcaaaaaattaatgaatccaggagctggttttttgaaacaatcaacacaattgatagaccactagcaagactaatcaagaaaaagagaagaatcaaatagacgcaataaaaaatgataaaggggataccaccaccgatcccacagaaatacaaactaccatcagagattactacaaacacctctatacaaataaactagaaaatctagaagaaatggataaattcctggacacatacactctcccaagactaaaccaggaagaagttgaatctctgaatagaccgataacaggagctgaaattgtggcaataatcaatagcttaccaaccaaaaagagtccaggaccagatggattcacagtcgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatgtccttgatgaacattgatgcaaaaatcctcaataaaatactggaaaactgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagaactatctatgacaaacccacagccaatatcatactgaatgggcaaatactggaagcattccctttgaaaactggcacaagacagggatgccctctctaaccacacctattcaacatagtgttggaagttctggccagggcaattaggcaggagaaggaaataaagggtattcaattaggaaaagaggaggtcaaattgtccctgtttgcagacgacatgattgtatatctagaaaaccccaatgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaaatgcttcaaagagaataaaatacctaggaatccaccttacaagggacgtgaaggacctcttcaaggagaactacaaaccactgctcaatgaaacaaaagaggatacaaacaaatggaagaacattccatgctcatgggtaggaagaatcaatatcgtgaaaatggccatactgcccaaggtaatttatagattcaatgccatacccatcaagctaccaatgactttcttcacacaattggtaaaaactactttgaagttcatatggaaccaaaaaagagctcacatcgccaagtcaatcctaagccaaaagaacaaagctggaggcatcacactacctgacttcaaactatactacaaggctacagtaaccaaaacagcatagtactggtgccaaaacagagatatagatcaatggaacagaacagagccctgagaaataatgccgcatatctacaactatctgatctttgacaaacctgagaaaaacaagcaatgggaaaaggattccctatttaataaatggtgctgggaaaactggctagccatatgtaaaaagctgaaactggatcccttccttacaccttatacaaaaatcaattcaagatagattaaagacttaaacgttagacctaaaaccataaaaaccctagaagaaaacctaggcattaccattcaggacataggcatgggcaaggwcttcatgtctcaaacaccaaaagcaatggcaacaaaagacaaaattgacaaatgggatctaattaaactaaagagcttctgcacagcaaaagaaactaccatcagagtgaacaggcaacccacaaaatgggaggacattttcgcaacctactcatctgacaaagggctaatatccagaatctacaatgaactcaaacaaatttacaagaaaaaaacaaacaaccccatcaaaaagtgggtgaaagacatgaacagacacttctcaaaagaagacatttatgcagccaaaaaacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatgtgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactaggcagccataaaaaatgatgagttcatgtcctttgtagggacatggatgaaattggaaatcatccttctcagtaaactatcgcaagaacaaaaaaccaaacaccgcatattctcactcataggtgggaattgaacaatgagaacatatggacacaggaaggggaacatcacactccagggactgttgtggggtggggggagggatagcattgggagatatacctaatgctagatgacgagttagtgggtgcagyrcaccagcatggcacaggtatacatatgtaactaacctgcatattgtgcacatgtaccctaaaacttaaagtataataataaaaanaaacattgtagtcatacacatctaaaattcattttcctcaatatcctttcattgatcttcaacccaaaaaccaatctaaaactttaagttattcccatctttggtataatctgcctcttctggataataaatgccatatacccactgtaggatatagcacatccttttactcgacccagatttatgtctttcaagtttcccagggtgtctttaccaatacgtcaagatttgttcaacagcttcaccacatggcccatggattcttgattattaccttaaatactgccctaaaacccagccatcttttaaagtcggcagtaaagttttagaaaacgcatgtgattcgctgttttaatgaaagggtactttaaaaaataagaggcaaagcacgttattcgccttggttaagtaagcagaaactcctgggagcctggcagcttggcttgtgaggcctgagtcaataagcccatgtccacgtggtgtcagttaccttggattgccagccaagaacataggaagaaataaacagcctcatggggactaatgttggaaatcaaaacattcacactttattgggatcatttgtcctctcacatgctgtgaatgcacataagctttcaaatatatgctcttttccatgcacttgcttccagatataggattgcccttacatcaaacaagaatataacttcacatacattattggtgaaagggtgatgacaatataaaggtgtgtaacgatattatccaatgacagcaaggcaaggaataaattctcacctcataagatttcaaagggaaaagaagctggtgactaaccagcaccaggctctggttaatagtcccactggtgagaattcccaagtgatgttgatcagcgaaaccgccataggcatttgagtagctaagcacatcaaagacccctatgatatctacatccatgtggctagatctgggacttagctggatgtatattaacacaaaatgtgtttgtcaaatatcccagacaagatgggtggattttcactgtttcagtccctcccctccctgctgccccttatggccatttgtatttcgtagtttatgatttccaagaactacctctaagttgttcgacctcaggatacctcccagtgagatcgcaaaccctgtgaatacaagaaccacgtcttcagatccctttgtctcctcactcaggtcttaatcccaagccttttataaaccaaacacccagtaggtattgcctaaccaaagggcctcatgtggactcagagatatcgacatgacgtcagccttgaattgcattgcgctgcatgacaagaactgtaaagagggaggaactgaggcttggaaactgtcctgcaaaaccatctctccccactcctactgcagatccactcatttattggtcctttgatgtatttttgccttggttgtattttttttaatcatgctattagggttttgtttttctttcaggtggtgagttgaagagataaccctttctaaattgccagcattccaaagagtcacaggtttgaggccaaaggcactcctaaacaagaaaggtcaagtgtggtcactcacccaagaagcagagcagggcaagccacttgcccccaattagagacagtcccttcatgtgaaatgccaagaagcctgcttttgatttgtggcagcctataacctggccattgctcgaggtctgagtcttaatatattttctccactttccaagtgtatacttatttaaattttagaatcatctggttataaagtcctaggggttttgaagaataaaacaacaggtcagcttgaagttaaagaagataaatgaacacagaccatgggaacaagggctgatgcctgctggaaactcagctaacctggtgtggcagaggtactggctgattgcttgaagcagctgagtctgcattaaaactggacacacctggaaatgatcattttgcagtttgcttggcctcttccctatgggtagacctcacagccttgtcttatgtaaacaacaaactcacacatttctggccaaagaggttgaacaaactggcctagcacattcatgacaaggacttcacggtcaggaacagatcaccaagtacagaaggaacatgctagacagggagacaagttcatcacccacagtcagtctctcctagtgtgcctctggccaaatacactatgacaatagacatgctgcttcacccgagtccctcttaaggcagaccagcagctccccagtgccccaatggcccatacaggactatctccaagcagctagcagacagtggtcactggttgagcagacaagagcttggtctcaggggtcctaagtctagagcctggaatgagggcgaggagtcatgttcctgatctcctttgccatcctatgtagggaatgttgaaggtcactttcatcagacccacagagataaccatcccttttataaagactgagtccaatggcctcctggcacacaccctggcaggcaggtttgtttgaaatttttgagaaaataaataagcaaaagcaagcaaaccaaagaaataaaaccaaaacgactgacttctccagctgacagggcatttcctatacttgcctccaggagctctgcgcctgagcccagctgcctcctcactggacgactatccatgtcccaagctacctctgtcatgagaagccctgcttctctctactctaaaccaccttacggtaaaggcaagacaatcaagcagtacaatcagtagccaaccctactggtatgatgaccccaacatcgctgagtaagcccaagacacagaaggtcagccccttcagcatggtccctttggcaactagaggaaagaacacggatgtcatggttttaagactcaagcaacgtgatctacgctagtgggtagagcacaggtgagggacattcagatacggtcccactccattcatgactgaacctgactgtggcgctggctcaggaatgttttgcctggcacagtggtgggcatctgacatttcaggatttggggactagttacagtcaaggcagtgacatggtttctgtgactgtcctttgatgaagaaagtagggtaagggttgcacaagcgaggaatcattttacttacagaaaccacttgtgcgaatttaaataaagggatatttattctaaaggtttggattaagaggatccaaggagaaggtgaccaagcagaccctggagctgggcccatttggagacccctgcagcaagcgtgcctggaccatcactctagcgcctgcgcattgatcccagtcagcagcctgattacttcgtcttcattttccaagagaggaaatctgattggcttctggccagtcagaattggtccctttttggtcaatgagattgggatagagaggggacatgatgaaaggactccccttgtctgattagagtaaatgtaagtcctctgggaagagagtgcagggacaggaggagactggtgggcagttctgccgcagaagtcccctcctatttcaccccttagcgacggggcaggattcttctttgcatcccagcattatgactcagaagagtagacctggagcagagaaaacccttccaacctggccatcaaggctgattgaagggaaacaaggtaccttcaggtcagtacatacatcatttgggaaagttgggatgcgggtgggagggaaagggcaagacgatgtgcacawtgcagattaattaagtgtctgcatagagtggactcccctgcttccctcagaccctgtctcctctgtgctcccacccagaggaatggctaattggcagaaggtcagtgcatttacctagagtcattccaatccgtccgagaggcaggaagggcaaggaaggagtggctggatgacacacttttatgcaatcatctggaaatctaatttgtggaacaagtagccatctgttccatgggtgatgtgccaaagtacctgccaacaacagaacaagctttctgctgttcgggtaactaattgcatctatgggaccaacacagcatgagactcaacccgtggaatatgatctcccactaaattaccacttttgcttcggcttttcttggggagccagtatgcatactacagagtctctgaaacagcagcagagaaacagagaggctgggcaaccccgcaccccccaaaacgggataggacagcaggtgtcaagggtagcacgttcctggagctgtgcaggagactgcggctttgctctagtttctttttcccttctgagaaacacggaagtctgactcagtatgaagctggggagggtagtcagggcctagaagtgctaagttgctatcagtgattccttttatgcctttttcttttctaagatacctcatttagaaactagagggagtagaatgtactggaggtaagaaatctgtgtcttcacccctatcaccactgatggcatggtggccaacagttgccttgtttaaagtttcaatggtaggttcatccagttacataaactcctcatagaaaatgacctctcgttgtttggtatcacccacgacaagcattaccctacaggaagcaagccaatagcaggtggattctccttcactttctgcacccgctatccccagagccccgtccataggcaagagaatctcaaagagcctaagcagactttttcctaggttttcgtactgcttgattagttatctaggaatggatggctggatccatatctattctgcctcaagaaacttaaccccaaactcttagtgacagtacattttttcatctctgtttttctttttttaaagaatatatcagcaacttcaaaaatgtaccaagaataccagttgtcataggggccttagtatcagctgctttggccttccagtggactggggacaggtctctcatcatatacctggctgtctgctgggctctttccagtctctcattaaatccctatcatgctggattggctctgagcattagtgaaaaaaacacttcctgttttcctgacaaagcagaacctagcacactgcccttgtgtgatgaatacttagcgattatcttagtgcaaccaagaggaaaaaaacaagggatttaaccagcaggaggggagtatgcttagcactcaagatgctaagctgctaataatcagtgtgaaccaaaggtacttctggctgtctggtcctccaggggtcggtgaaaggtgttgcatcaaaactgctgcagaaggcagctccctaacaggcagaacagttattaggctgggcccactatgaaaaataaataagaagtattggaaaggattaaatcagccttatagagatgtctccattagccacgggaataaaggtttcaggtggaaacctcagcataatcccacaaaacaaagtatgatacttaacagtcacttatgaaatggattttatgaggtttttggtgttccatttttttaatttaagaagcgactatagagtaccttctttctgactgtattttgcttagaactgggaacacatgagccagatggtggaaggaatgttggccaggattcacaattcagtgtcacctcagaggtgacatgagccccaagagcgtgttggtaaatgtctaacaactagctctaccataaaagccctgatttgtagtgtttgccacttttagtagtgtaaatgttcccgcyacagctggtttcatggtatcaacataatgttactgaacacagtgttggaagagatgaacacagatagtagtatttccagacagattcaccaggcataacaaagaaaacccaagagcatagacaatagtaaaatacagccaaatcattaggaagtcatgagttttgagtacctattagccttgttttaaatgtaatttattgaagtgtgaggttttttttgtttgtttgtttgtttttgagacggagtctcgctctgtcgcccaggccggactgcagactgcagtggcgcaatctcggctcactgcaagctccgcttcccgggttcacgccattctcctgcctcagcctcccgagtagctgggactacaggcacccgccaccacgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgaagtgtgagtttatatcatttaattttgaatactgattctggttcacaaaatgcctgaatattgaacaaacctttgcaggcttgtatgagccagaccccacataccactgtatccaccagaacagaggctgaattcaggtgacagaaaccaggagacccaccaactttggtgggacctggactcttacgactacattcaaataaattaatcacttttcataaaaattgatatatcaaaaaaaaaaaaaaatgtcaaggaacacctaaaatgcacttggatggcttagtctaccatttgaaacaaaacatttgtcaagcctgtaatcccagcactttgggaggccaaagtgggtggatcacaaggtcaggaattcaagaccagcctggccaacatagtgaaaccctgtctctactaaaaacacaaaaattagccaggcatggtggtatgcacctatagccccacctactcgggaggctgagcctggagaatcacttgtacccaggaggcagaggttgcagtgagctgagaccgtgccattgcacctgggtgacacagtgagactccatctcaaaaaaaaaaaaaaaaaaattatcagtaaatttctcgtattggcacaacattgatatctaaaggctttccatgaaattcaatatgtaatagaaattacagtactggaaaattgtgctcaagtgaccaattattaatagaactctaattaatcttaattcaactaaacttaaaaccttacgagattttaagaataataaaaaatttttttaggatctcttaacttacatctcattctyaatattattgactaggtttttttttttaaactatgccttttcgatgtctctgagagtatctgattgttgtttttgtacaaaggggaaaggtaggaggcagtttcctctccaggagatgttgggcacagatatgtaataactaaaccacaaggcagaattgtctgttgctttagattctacgtatttgaactgtaaagtgtctttcaactctgaactctgggaatctacatttctatcggaagggccaagaaatgcctttctgtcatgtgtgagctggaagagtttgctttggaaactctttccatcagtgatgaattgtgcctcctctgtgtggttctactgggtgctggagatgcacatacacaagtccatggcaaggtctacaaaattctcatacaccaggagaaattcacccaaagagttcatttcagcagtgttcataatagttaaaaaacgaaaacaaatgcatggtaaggtactgataagctcaaaacaagcactgccctgggcctgcttcccacaatagcctcaaggtctttcctcttccgctcagtcatcctcagaggtggtaagacttggtgagagatctagaaagaaaccatcaggtgaaggccgtgttttctatgtcaggaaacacgtgatgcacagtctcttggagacaaagtagaagtagaaatgtctctggggacaaagtagaagctggtgatatgaagcaagtctccaggaattatgtgcaaatgatgaatttcccaaccctgtacctgtaagaacttcaaaatttcctgggccaggtgtggctagggaattattcaattccataattcccatgtgggttctgttgtctccccgcccacactttccttgagtctgtcttttgcctcttcactcaccactgtccacccccattcctgagaaaaattaggtgtccaagtccctaaatctggtgccacttccatttccacacatccacctttgttaagttctggcgaaggaaattactttagatctttgttcaaaagtcatatatttcaaatatagttttacgtggtgaaattctaccttaagctggcatttatttgactcatttttctaacagagcaaggtctggttcaaaacagcagagtgagctgattctcagctagtaatggttgctaggaaaccattctgtggcaaatcagaatcacataagctctgacttccccatcttgtgaactcctatagaattaatgcaggctctactcattcagtgatgaatcagtactgcccaaggatatctcttctctcttactgttaaattgttatttaataattaacttttatctatagtttatgtcttagctttccagttagtttttaaacttcagaggatgagtcttttagcctgtgtattttgagacctccacttgcaaatgcctagttggcagggcttaaccaatatgcactgattgtatttgaaggcaggtggtcatgtggaagaaacacttccagattggaaaaagaacagtctggtactttctaccaataattaaatgagttttcaaagctattttctttctttggcttgtatgtctgttttctgctcttaaatttgaggccacagaaaacttggtggaatattcaagaaatggttatatgaattgatgcaatttctttagagaacaatttggtaatatttgttaaagctggacatacatgtaggcaagtctattgctaggtgcataaaattctcatacaccagaagaaattcaccgaaagggctcatttcagcagtgttcataatagttttataaaaatgaaaacaaatgttaataaagaagaatagattaaaaatggtgggctgggtgtggtggctcacgcctgtaatcccagcactgtgggaggccgaggcaagagaatcacttgaggtcaggagttcgagacggcttggccaacatggtgaacctcgtttttactaaaaatacaaaaattagccaggcatggtggcatgtgcctgtaatcctagctacgtgggaggctgaggtgggagaattgcttgaacctggtagatggaggttgcagtgagccaagattgcaccactgcactccaggctggacaacagagcaatactctgtcttgggaaaaaaaaattggtgccagattcctacaacagcacactacactaatatcattctatgctacacaacgctatatcactctaggccatactaataacagttaaaatgagctggagttacatatgtcaacatggtacatcactgggcaaaacaaacctatttgcagagaaatgcatatcatatgatattatttagataaagtttaagatgtgttataccaaattgtgtgtatgaatataatacatagtaaaaatttacaaatactatgttatggtaataaaatcactaaattcagtaaagtggttgcctttgggaaagggggaaagaggatgtgttgggggactacacaatttttcctataatgttttatgaaaaaatatatttgaagaaaacataagctgggtgtataatggctatattattcaccacgggttttttatgttttatatattcattttctttctggaaatttgttttagggtgacaaaaggcccatgattctttcacttgggcagatcactgcacaaagctggcacaggagaagatagttaatttcggttcaggtatttgattcctgccaagttagatggattcttctgaagttctgtctacacactagaaagctcacatgaattaggtcttttaaatatcagttataaaacaaagggaggtcagacaatgaggcatgattttttaaatatagtaaataataatctttgttttgccttgtctgaataaagttaattataaaagcaatatatcactttggcaactaacaatgcctagagcaatggcgccaaagctttaaaaagcgtaaaaatcacctgggatgcttgttaaaatgcagattcccaagtcccactccctcccccaccatgatgctgagacagtatagcagggttgaggccctgtcatttccatctttagcaaccaccccagctagttctggtgggtgaacagggtaaccatcgagtaaactgggactctctcagacagatagccctacccatgaaccagagaacgttagtgattctgattacgagaacacactgcgagcattgcggatgtaatataaatattagccagtaattatctgcttgaaatttcaaatctacaaaattatcacacacagcatccattcattcaccaaatatttactgaatgtctattatgtgcacagtattcttttggtcttccttcattctactctgtgactctctttacacatatacatatgtatattttcacataaatgtgatcaaaaaattcatcatcttggctttcgcttttttttgccctcaaagtcacactgatgtgccagggatacattttttccatgaggtcggcgggtaagtgtagtagttttgtgcttaaccaccctttcctactctcctccttcttccatctatattagccacccctcacccagataatctatgttaacaccttaatacgtacccttcaatatatttctttatgctcataagatcttataaacataaaagcacagcatatttatgtgtacggatgactcagtgtaataacaggtatggtctctcttctgggagctgaccatctttggaaggagacaatgcacatttacaagacaaagcggggaagcttgcacacatggcacagtgccatagcaatacagtgaaaaaatagatggaaaagacctatcagcatgagggttgcagcttatgagaggcagaaaatagaaaatgtaaggggtcatcaagaaaatcctcactgtcatggtctccacatggaccgcttgaatcaaaattaactcaaaacccagatgctatgtgtactagagacacatctgccaagtcaagaaggaaatgtctctccctcagaggacagagctgaggggagcatccctccctaaggtggggttcctggaccccaggagcatcgtgggcctggagccaggggaaggtcaggagagcagaggcaccatatt

SEQ ID NO: 10563 - DNA, 13578 bp, Homo sapiens
ggaagagaataagtgcagcatatggttccatgtggtgagtatagaacgcaggggaatgtgagagtgtaaaaacttccaaccagctcaatgcctggtgacagggcagcacaaaggagtattggaatagcctgggaaaactgagactcacagactggagaggaataatcctgggtgttaagtggctttccttacttctcctaccttgtgctgcttcttccacctgcaataaatctcttccatttctttttctttttctttttttctgttttgttttgttttgttttgttttttgagatggagtcttgcgctggcgtcatgctggagtgtagtggcgccatcttggctcactgcaacctccgccccctgggttcaagcgattctcctgcctcaacctcccaagtagctgggactacaggcacatgcgaccacgcccagataatttttgtatttttagtagagacggggtttcaccatgttagccaggatagtctcgatctcttgaccttgtgatccacccgcctcagcctcccaaagtgctgggattacaggcatgagccaccgtgcccggcagtctcttccatttctgcatatcaaatttgcggccctctttcaagtctcaactctctgaagccatccatgaggtattttcagatcaaccccagttgaaaataactcccctgccacttatcactttttcctttgcatctggagcattggctaatctgacttttcactctcattagattactggtggggattctccgtatttgtctccatatttcactggcaaattctgggtattcaataagggctactgaatgaataagaaaaaaattctacttcatccatttagagggcaagcatcatatgctctgtgtgcaggaacaagatgaaacaaccactagctggcaaactacctcaagccagctcctgaacctctccttgggttctgcctcaggttaactctttttttttttttttttttttttttttaaaagacagggtctcactctgttgcccaggctggggtacagtggtgtgatcctagctcactgcagtctcaactcctgggctcaagtaatccttccgccttagcctcctgaatagctaggactacaggtgcaccaccctgcctagctaatttttattttgtagaggcagggtctctatgttgcccaggcttcaggttaggtcttgaatgaaggcaaacaatgcccttctgggatagaacaaggagaataacagagtatggccagtttctctgagccatcttagaaggggaggacccagaaaaaaggaaggagggaagtgactccaggtaagatgtaaatatatttgcaggtaaatccccagaaacttgtcaaatatggtttccctcagtccaattttcttcacttaaaggagtggagaattgttccaaaatggagttaacattctgcaatcatagagagcagaattattgccctcctcccaagttcttgcattctcctagatgtctctttgacctttttttttttttttgagacggagtttcacactattgcccaggttggagtgcaatggtgtgatcctggctcactgcaacctctgcctcccaggttcaagcgattctcctgcctcagcctcccaagtagctgggattacaggcgcccgctaccacacctggctaatttttatattttattagtagagatggggttttacaatgttgaccaggctggtctcgaactcctgacctcatgtgatctgcccgccttggcctcccaaagtgctgggattacaggcgtgagccactgcacctggccctctttgaccttcttaacccagagtctcacttttcgagaggtttctgtgtagcaagacggggtaagtatgtcccatttgcattcacacgatttctggaggtattggtgatgttggtccctgcaacaccaaaggaagagagggagcagaggacaatttgtagtgacaagaagagactggatccagtcccttggggaagaagattccttttcatctcttcctctcatgcctgctcatcttccatttcattctcaaatctttaggggaaagggagaggagagagacattgctgtttccccactttccagtccaagcatctatcccaacagataagcaaatttcacttgtcatcctctttatgtatctttctcaaatgtcttgttctctagccaggcttaaggatataatcttcctggtttgtggctctctttcgtcttgattccttgatgactgcctccaaagagctgagctctggcacaattagacttgagggagatagtgtgagtcagtcaacaagcatgtagtatctacactttgggggagagcctatactctttcttatttctttttttacaaattattattttgagacagaatttctcaaattcctttctacctcaggaaaggaaaggaaattggataaggcgactttgtcgccaggctgaagtgcagtggtgtgatctcggctcactgcaacctctgcctcccgggttcaagcgattctcctgcctcagcctcctaagtagctgagactacaggcacacacctccacaccagcctaatttttgtatttttagtaaagacggggtttcaccatgttggcccgactggtctcaaactcctgacctcgagtgatccacccaccttggcctcccaaagtgctgggatgacaggcatgagccactgcgcctggccactctttcctatttctgaatcttcacaggttgttggtcccttcctagtcctgtgtttctcaagttaagactagggggaatctacaggtccatggctatcttctctggggaactcttctaaaactttaagtttgtgcttacctcttgatgggccatatttttaaaaagagaaatattttcatacatgatgatttggattaggttttttttaggggtttcaatgcctatatttgtatttgtgtttatttatttatttattttttgagacagtcttgctgtgtcgcccaggctggagtgcaatggtgtgatcttggctcactgcaacctccgcctcctgggttcaagcgattcttctgtctcagcctcccaagtagctgggactataggcgtgtgccaccacgccaggctaatttttgaatttttaatagagacggagtttcaccatattgaccttgtgatccgctcgcctcggcctccgtgcagtggcgcgatctcagctcactgcaacctccgcctcccaggttcaagcgattctcctgcctcagtctcctgagtagctgggactacaggcatgcgccacaccagctaatttttgtatttttagtagagacggggtttcaccatgttggccaggctggtctcaaactcctgacctaaagtgatccgcctgccttggcgccgtggctcacgcctgtaatcccaacactttgggaagccgaggtgggcagatcacttctggtcgggagtttgagaccagcctggctgacatggtgaaaccccatcttcactaaaaatacaaaaattagccaggcatggtggcaggtgcctgtcatccccgctacttgggaggctgaggcaggataatcgcttgaacctgggaggcagaggttgtaatgagccgagatctcgccagtgcactccagcctgcgtgacagagtgatactccgtctcaaaaaaaacaaaaaacaaaaaaacaaaaacaaacaaacaaaaccagggagagaattgttttgacacaagtctttggctaatgatgaaaccgtctcccttcctggctgtcctggcatggtttttatagtctgaggcacaatggtgagagcaaacttaagagggagccaaagtgaggtactcaagagagggatccttctttcctggagaactgtggtagcccaggctgtgtaggtagctggacaagcaagactgaatcacaataggtctctacatcttctattaggaggagaacctgcaacatccagtggagcaggtcacaccagttatacatgtaaaatgtaggataaactaaaggggcacagagccaggggagaagacaatgggatgagactgttctagaatctcatcccattggttcattgctgggtgtggtggctcacacctataatcccagcactttgggaggctgagatgggatgatggcttgaggccaggagtttgagaccagcctggtaaacacagcagaccccatctctctaaaaaaaaaaaaaaaaaaagaaaaacatacggtttatgaaccagcagcatctgcattaaccagcttattgaaatgcagaatcacaggccccacaacagacttcctaaatcataatctgcaacttaacaagttccctaggtgatatgtatgcacacttatgtttgaaaagcactaagatttcttgatgaaggaggacttgaaaggcaatgatggatgtgaaaggaaaggtaaagagaagcctcaggtagtcacccaagggacagggccggttggagagagagtcccgaggttttatcctggagaacaccctgtactgaatgagctctgaacataaagatagttagcataggagggcctgaagtctccagataaaaggctgctgccactatcatttaccacgacctctgccattctccactctattgtcatccgcccccagtctccattccaggacttctctacactttgactttttgtttgtttgtttgtttgtttgagacggagtcttgcgctgtcgcccaggctggagcgcagtggcacgatcttggctcaccgcaagctccgccttccgggttcatgccattctcctgcctcagcctcccgggtagctgggactataggtgcccgccaccacgcccagctaattttttgtatttttagtagagacggggtttcaccatgttgtccaggctggtctcgaacccctgacctcaagtgatccccccgccgccccgccccctcccccccgccccgcccccccccgccgcctcggcctcccaaattgctgggattacaggcgtgcgcgatgcccggctttttatttatttatttatttatttttgaggcgggaatcttgctctgtcgccaggctggattgcagtggcaccatctcggctcactgcaacctccgactccctggttcaagcgattctcccacctcagcctcccaagtagctgggattacaggcacacgccaccatgcccagctaactttttgtatttttagtagagacgagatttcaccatgttgccaggatggtctcgatcacctgacctcgtgatccgcccacctcagcctcccagagtctcagttgccaaagctggagtgcaatggcgcgatctcggctcactgcaacctccgcttcccaggtaagccattctcctgcctcagcctcctgggtagctgggatataggcgcccgccatcacgccgagctatttttgcatttttagtagagacggggtttcaccatgttggccaggctggtcttgaactcctgacctcaacctcccaaagtgctgggattacaggcgtgagccaccgcgcccggcccaccttttttttttttttttttttttttttttgtttgagacggagtctctagtctcgctctgtcgcccaggctggagtgcaatggtgtgatctcggctcactgcaacgtctgtctcccgggttcaagcgattctcctgtttcagccttccgagtagttgggattacaggcgcgcgccaccatgacctactaatttttgtatttttagtagagacagggtctcaccatgttggcccactttgactcttgagcagcctggccagcccgaccgcgccaaattctgttcgattctgcctagttcggttgctctggcctagttcagttgctaaggcctggagcttcatggttgcggaggaaatgatgtcacgttcaataggcgggctaaccagattcctcccttctcccgattggctgccaggaatttgactagattcggagtctcgcgggctccagggttagttgtcagtatctttcccagttgttccgccccctacccccgcctcccgcaccgcycccctctccggctgccctctccgygtggggcaaggctccgagggcagcattcagtagccatttagctttggaaggagaggtgattcgaatggcccggctcctcctgtcaccatgcyaggcactttggccgygcaggtacttattgacccgaccgggtgtccgtagttggcgcggctaccttaaccgcagggaattgtggaatttatagttctaaattatatgtgggtggaacggggaagctggagcagatttttggaggaaagcaaaactggggactttcaggactaggggcctgggtctcagaagaatgggaaaggacgagaaaggagtctaaataagaaccctgctattagcattgtttggttttcttttcaggtgctgacctgaacctggttyatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaasgcttgagctggaagtaagcccagatccagccagccaaattctagagcatactcaaggagctgaaaaactggttgctgaacttgaaggagactctcataagtctcatggatcaaccagtcagatgccagagrcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaacccygaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagagacaggaacttgtgaattgtggtctgtgctgtgagatttgggggtggggggccagagggaaggtttcagcccatatcccattctcagcttttggcttcctaggggaggtagcagtggtcacagtgcgccccttttgaggggcttatctatctccgaggacacatagaagctgtctaaactaaacttagtagtggctgggggagatggtggaccttaatactgggtactacatctcccaggcgctttatcactggagcctgtttggcgcatgcgcttggcggtatggcactgtctggaagttacttcctgctgctgtgctcccattgggcccgcctacacagtcatccgcatctgttgattcacgtgctcagcacccaggtctcttactggtcggtagagcttccgggacgcccccttttttgaaagagtcaactgattagttggtgatggggagaggcgggccttgggaaccgtctcctggttggggggtgggggggaaagatggcggagctgatgctgctyagcgagattgctgacccgacgcgtttcttcaccgacaacctgcttagcccggaggactggggtctgcagagtgaggcaccggggaggggagagggctgtggcaaactgtccctgaggcacgcgggaaagaagcgggggcctaaagaggaagtctgggcaaatacggaatccgccatctgaaggagagcggagcagggggctcgttgtgcattaagggggatacaaaagtcagggaagaactctgctccctgctggaacgtcgagttgttccggggtcggggaaggaggggctgaagcgccctggttgtatcacttttcaagtgggcgggcggtgggtctggccgagcggagccaatgagggatggggcgggggcttgtgtgcgatctgtaggctggggccaccgaacgaccccccgacgctcagcatttcttgcagacagcaccttgtattctggcctagatgaagtggccgaggagcagacgcagctcttccgttgcccggagcaggatgtcccggtattgtgtccccagcctttctctaacccttggtgggtggaaagtgagcccagaacctggacccattcacaggccataactcatctggagtcacccctactttctcatcctttctcacactcctgccctcttgtatcctcccttatttagtttgacggcagctccctggacgtggggatggatgtcagcccctctgagcccccatgggaactcctgccgatcttcccaggtaaggtagtctttgtcgttccctcagatttccagaaaccctcatcttcccactgtttcccagaaactacgtagcttcctatatcctcacgcttctacataagtgcctatcctctctccttcaatcccctatttttgtttcttctcccttgctgcggtacaggaatccccaccgacatgtccttgggtactttttggactcttcttaagctctgcttcctgataatttctaactccctttcctccagatcttcaggtgaagtctgagccatcttccccctgctcttcctcctccctcagctccgagtcatcgcgtctctccacagagccatccagcgaggtgagagagccatatccctcttactctctgtgacggggactctgcttcattcccttcacccgtgggtgacaaagaaatgatttaaatgatttgtgtgctatgagtcatgaggtgtgtgaggtgtggggggccttctccactacctttgccgtttccttaatatcttcattttccacatcccctttggttatctagcagtgaagatttttttgtttgtttgttttttgttttttgcttttttttgagatagggcctccctctgtcacccaaactacagtgtagtgacggggtcacagctcactgtagccttgacctcctgagctcaggtgatcctcctgcctcagcctcctgagtagttgggaccacagacacatgccaccatgtctggctaattttttttattgtttgtaaaaatggggtcttcctatgttgcccagagtggacttaaactcctgggctcaagtgatcctcccaccttggcatcccaaagtgcttggattacaggtataagccaccacgcctgatcttgggtctttttaatataaagagttatgtggggctgggaagaagagagttattgactgctgagaattctggaactgttcttgcccaagttgtccactctgaggccatatttgaagtcatgagacttcatcaattctcccagaaataaagtagaaagaatgaacaggttagaaagatggtcagtaccattcagaccagaatgtcaaataattgatggcttgtaagccctaaacttctaaagcttttgttctcgctcttactgtcaacatctcccttgttttttgcccttctttctgccccctgccccacaccaactctcacccaggctcttggggtaggggaggtgctccatgtgaagacagagtccttggcacccccactgtgtctcctgggagatgacccaacatcctcatttgaaaccgtccagatcaaygttatccccacctctgatgattcctcaggtaataaaacagcctgcccccaatccttggctctactacgggagaatgtgttatgtgtgtgtgtgtatgtgtgtagatggaggggaagtgcaggcagcaggacagggagaaaaaggtggggaggggaaatggcagaaaaccaggagggaaggcaggaaggagaggaaacatttcagggaaccacagcaagggcagtgctgaggagatggatattatttttctctctttttcttgttcctagtattctgtcatgccattcaacttactttttaaaaacttgtgagcagtttagggcatatgtatctgtgtgattcccctccacccaacattttattataaacatttttgttgttgttgagacagagtctcacactgtcgctcgggctgaagtgcagtggtgtggtctcagctcactgcaacctccacctcccaggttcaagtgattctcctgtctcagcctcccaagtagctgggattacaggcacccaccaccacgcccagctaattttttgtatttttagtagagatggggtttcaccatgttggccaggctggtcttgaactcctgacctcatgagtcgcctacctccgcctcccaaagtgctgagattacaggcgtgagccatcgcgcccagcccataaacatttttaaacatacagaaaggctagaacaccatatactaaactagattctacaattaacattatttgttctatttttaaagtgttcccaagtttatttactcgtagctgtgtatttagtaaatgtttattgatgtgatcatatctgaggtataataattataaaaaagaaatatttattaagcacctactccatgccagatactgagcagcatgctgggaatgcaaagatgaacaagacctgaccaccatgctgactttcaaaccctgtgatttggtaatgggagaaagacaagtaccagtcaatacaggtgtggtcattctaggatagaaatcactagaggtggggctgggtgtggtggctcatgcttgtaatcccagcactttgggaggccgaggtgggcggatcacgaggtcaggagattgagaccatcctggctaagatggtgaaaccccgtgtctactaaaaatacaaaaaattagcctgtagtcccagctacttgggaggctgaggcaggagaatggcatgaacccgggaggcggagcttgcagtgagccgagatcacgccactgcactccatcctgggcaaaagagcaagactccgtctggaaaaaaaaaaaaaatcactagagggtaccatgaaagctcataagaggggacatttcatccacattggcgctgaatctgggatgtgcccctggaagaagggtttcctgagagttttaaaggacacgtagaaattagccaggaggacagtgtgggggttgacttgtgtctgaggaccctgcatttcttcagagtggatgtaagaaggatttggggagtgatgtggaactgcaggggctacagggccaggtggggcccctgctaaggggctcttagcttttatcctgtggataggtgggggcctttggagaattaagcagggaagtaatatgattaggaagatgattctagtggcaaagtagagaatgggttgcagaggggcagggccagaggcaagagaaccaaggaagaagcttatgcagttgatcaagtaagatattcggatgtcatgaagaaagcagacttgagaaagaatgaagtggaatagatgagttgtgacctcctggacattggagagaggtaggagtcaaagaggtttgtggctaggatggctgtgggtgggtgatgttactgttcactggatggagactgcaaaagcaggggctttctggtcagggaagatgatgaattcagcgttggacatgttgattctgttgttgttgttgttatggagcttcactcttgttgcccaggctggagtgcaatagtggtgtgatcttggctcactgtaatctctgcctcctgggttcaagcgattctcctgcctcagcctcctgagtagctgggattacaggcatgctccaccacgcctggctaattttgtatttttagtagagacagggcttctttcatgttaggctggtcttgaattcccgacctcaggtgatccacccactttggctcccaaagtgctgggattacaggcgtaagccaccatgcccagttgacatgttgattgttgatttcaaagtaccttctggatctcctggcaccatctctcactggctgaactccaaccagggagcccgctgatgcagtccattcagattctccctggatctcagggagcacagcagggagggatggaaagtggatttggagggacaaacagattatatctagcagattaatacatgttataaaaaagatacacaaaataaggattgaaataccattagcaggccaggcacagtggttcacacctgtaatcccagcactttgggaggccaaggcgggcagatcacgaggtcaggagatcaagaccattcgggctaacacagtgaagcgccatctctactaaaaatacaaaaaattagccaggcatggtggcaggcacctgtagtctcagctactcgggaggctgaggcaggagaatggggtgaacccgggaggcggagcttgcagtgagccgagatcgcccactgctattagcagcaaaaggattgtaaggattgttggtggctttgcattgcatagtgttattagagtcagattctcctccatacttaggtattttttgagggcctgtactttaccctcaatggacatgagacatagttcttgcttttggagagttttgtgagggttataatacatcatggttaaatagttcccttttttttttttttttttttttttgagacagagttttgccctgtcacccaggctagagtgcattggcgtgatctccactcactgcaacctccgtttcctgggtttaagctattgtcctgcctcagcccccctaatagctaggactacaggcacgtgccaccatgtccggctatttttttgtatttttggtagagacagggttttgccatgttgttcaggctggtgtcaaactcctggcttcaagcaatccacctgcgttgggtgtcggcctcccaaagtgctgggattacaggcgtgagccaccatgcccagccatggttaaatagttctgatagtggttatctctgtgtagggaatctgagtgactggaggaccgggaagggaagttttttttttttttttttttgagacagagtctcgctctacccaggctggagtgcagtggcgcaatctcggctcactgcaagctccgccccctgggttcatgccattctcctccctcagtctcccaagttgctgggactacaggcgtccgccaccacgcctggctaa

SEQ ID NO: 10564 - DNA, 23242 bp, Homo sapiens
  misc_feature (1)...(23242): n = A,T,C or G, or insertion/deletion polymorphism (see Tables 1-2)
aaaaacaaaacaaaaacgaaatttacatgattttcagttggattcctagtatatcacatgacaaatggtcccaagtaggccatgcgcagtggctcacgcctgtaatcccagcactctgggaggccgaggcgggtggatcacctgaggtcaggagcctggccaacatggtgaaactccatctatactaaaaatacaaaaattagctgggcatggtggcaggtgcctgtaataccagctacctgggaggctgaggcaggaaaattgcttgaacccgggaggtggaggttgcatgagccaagatcacgccactgcactccagcctaggcaacagagcaagactctgtctcaaaaaaaaaaaaaaaaaaaatggtcccaagtaaaataactgttgcaatagccttcaggaaatcataacaagcagcagttgaacctgaactttaaatttttattatagactacaaccctgttgagtatgtgccatacaaaaatggactctgtttaaaaagaagatgagaggaagtcctatgatgctatgccatcgggtggaatttccttgggcaaatactttactgttatgatgaactgtcagtgattcgtttaacaaatataccacctgcctacatcatcccatttaggccttatatcaagtccatttcctctacttgggaactagactccatccctctccaagacttacacaaggacatagctcagcagctttctcttctctcttccatatcacttattttctatttattctggataattttgatcaacatacaaacatggtgtttcttcacaccccatttctctattcaactttatagtaaaatccctaaaatcattttcagtgctctgttttaatttctgtcttttcatttgtatttgaatctactccagtaaggtttaaatgcccatttctccattgaaaatgttctcattaagaacatcacacccaggaactgattcagagcaagaggacagcttcaactccctatgatttcatctcctacctagccaatcagcactcctggcccactggcttccccccacccagcaagttgtccttaaaaactctgatccccaaatgcttggggagactgatttgagtaataataaaacttcagtctcctgcacaacaaaaacaaacaaacaaaacatcagacgctgcgggcggtggctcatacctgtaatcccagcactttgggaggctgaggcgggaagatcacttgaagccaggagttggagaccagcctgggcaacatggtgagacccatctctacaaaaaatttatttatttattttttagaaagaacatcagtgacctctatatttctttttttccaaataaattttattgtgtatatttgaagtttacaacatgatgttataggatgcatatagacagtgaaatggttactacagtgaagcaaatcaacatacctaccatctcacagttacttttttatgacaagagcagctaaaatctgcttagttaacaaaagtccctaatacaatacaattttactaactgcagtgtttgttgtacattagatctctagttcatcctacatatctgcttgtttgtatctgtttttttttttccttttttttttttttgagtctctttctctgtcgcccaggttggagtgcagtggtgcgatctcggctcactgcaacctccacctcctgggttcaagccattctcctgcctcagcctcccaaataactgggactacaggcatgtgccaccatgcctggctaattttttgtatttttagtcaagatggggtttcaccagttggccaggctggtctcgaactcctcacttcaagtgatccacccgcctcagcttcccaaagttctgggattacaggcattagccattccctgcccccggcctgcttgtttgtatcttttgacctacatcgccccatttcctccccaccccaatctctacatttcttgcatcaatttctctatagcacttatcactactgacatactacatattttacttggatttgtttattgaatttctctcttcactataggttaggctctataaaaggaaggatttttttgtttttttttgtcaccattgtattcccagaatctacagcattgccaatagtaataaatttgtcactgttgttgagacagggtttcgccctgttgcccaggctgaagcgtagttccatgatcttgtcttactgcaacctccaccttcctggctcaggtgattttcctgcatcagcttcccgagtagctgggaccagaagcatgcaccatcatgctgggctaatttttgtagttttggtagagacgaggtttcatcaccatgttgcccaggccagtctcaaacacctgggctcaggtgatctacccaatgtggcttcccaaagtgcctgggttacaggcatgagccaccacgcttgcctgataaatgagtaatagttgtccaatatatagttaaatgaattaatttatgcttatattctacttgaggaaagacaaactaaagagcttctgcacagcaaaagaaacaaccatcagagtgaacaggcaacctacagaatgggagaaaatttttgcaatctactcatctgacaaagggctaatatccagaatctacaatgaactcaaacaaatttacaagaaaaaaacaaacaacctcatcaaaaaatgggcgaaggatatgaacatacacttctcaaaagaagacatttatgcagccaaaagacacatgaaaaaatgctcataatcactggccatcagagaaatgcaaatcaaaaccacaatgagataccatctcacaccagttagaatggtgatcatttaaaaagtcaggaaacaacaggtgttggagaggatgtggagaaataggaacacttttacactgttggtaggactgtaaactagttcaaccactgtggaagtcagtgtggcaattcctcagggatctagaactagaaataccatttgacccagcaatcccattactgggtatatacccaaaggattataaatcatgctgctataaagacacatgcacacgtatgtttattgaggcactattcacaatagcaaagacttggaaccaacccaaatgtccaacaatgatggattggattaagaaaatgtggcacatatacaccatggaatactatgcagccataaaaatgatgagttcatgtcctttgtagggacatggatgaagctggaaaccatcattctcagcaaactattgcaaggacaaaaaaccaaacactgcatgttctcactcataggtgggaattgaacaatgagaacacatggacacaggaaggggaacatcacacaccagggcctgttgtggggtggggggargggggagggatagcaataggagatatgcctaaggttaaatgacgggttaatgagtgcagcacaccaacatggcacatgtatacatatgtaactaacctgcacattgtgcacatgtaccctaaaacttaaagtataataataataataataataatatatatatatatatatatagaatgtcatagtaacacattctatggaaaaagagcagttaggagaatggagaatatcatgccatgcttagaggtaaaagggttgctattttatagggtgatcagaaaatgcttctctaataaggcaacatttgaacagaagcctgaaggaagaaagggagtaagccatataggagagtacacgtccaggaagggaatacagtaagcgctaatatcctgaggtggaaattttcttggatgtttgagaaatagaaaggagattagtatagcaaaagccaagtagttgaggcagagagtgccaggaaatgtgctagaaaggatgtaggaagcatgttcacatttggttttgcaagcgtttagcttttaagcctgggtaacatgacaagaccccatctctacaaaaaattcaaaaattagctgagtgtggtggtgcacatctgtagttccagctacttgggaggctgaggtgggagaattgcatgagcccaggagctggaggctgcagtgagctaagattgcaccactgcactccagcctggatgacagagggaaacgctgtctcaaaaaaaaaaaatatatatatatatatagaatttatcttttactcaagtatgaaagaagcccctggaagatataaaaaagaagtgtagcatgatcacaacactctagccagtgtgctgagactagaatgtaaggagcttggaatagagatgcaaacaagttaagaggttatggcaaaaatataagtaagcagaatgcagcaacatataaaaacgtcacatatcatgaccaattgggattaatcccaggaaggcaaggttggtttaacatctgaaaattaaccaatataattttattaacagaataaaggacaaaaccatatgatcatctcaatgtaagctgaaaatattgacaaaatttcatgataaaaattattaacaaacagaatggaaggaacttcttcaacctggcaaagggcatctacagatcatcccagctaacatacataatggtgaaaggctgaatgcttttcttttaaggtcaggtacaatacaaggagctgcattccaaccacttctattcaacattgtactagaggtgctagccaaggtaattacgcaagaaagtgaaacaaaagcttccagattagaaaagaaaaaataaaactatctttatttgcagatgacatgatcggtccattctcatgctgcttataaagacatacccaagactggataatttataaaggaaagaggtttggctcacagttccccatgggtggagaggcctcacaatcatggcgaaagagcaaggagcatctcacatggcagcaggcaagaaaagaatgagagccacgccagagggaaaccccttataaaatcatcagatctcgagagacttattcactgtcaggagaacagtatggaggaaacgcccttatgattcaattatctcccactgtgttcctcccacaacacatgggaattatgggagctacaattcaagatgagatttgggtggagacacagccaaaccatatcaatcttttttttcttattctttttttttttttttttttttttgagatggagtcccactctgttatctaggctggagtgcagtggtgtgtgatcttggctcactgcaacctcagcctcccaggttcaagcgattctcctgcctcagactcctgaatagctgaaattacaggcacctgccactacgcctggcaaatattttttgtttgtttgtttgtttgtttgtttgttttgagacagagtctctctctgtcgcccaggctggagtgcagtggcgcgatctcagctcactgcaaactctgcctcccgggttcaagccattctcctgcctcagcctcccaagtagctgggactacaggcgcccaccaccaccatgccaggctaattttttgtatttttagtagagacagggtttcaccgtgttagccaggatggtctcaatctcctgacctcgtgatccgcccacctcggcctcccaaagtgctgggattacaggcgtgagccactatgcccaaccgtatcaatcttgtatatagaaaaacctaaggaatctacaaaaaaaccctattataactaatataataataatctgcaaagttgtagactatgagatcaatatacaaaaattaactcaatttctttacatgtacaatgaataaccccaaaacaaaactgggaatataattctatttttaatagtatcacaaagaatgacaatacttagaaacaaatgatgggcgctagcttgcactcccgccctgcctgtgcgctgcccgagtgtggagctgctatgctgcgaaggctcgaggacccgcagacgccaggggatcagcgcgtcctgcagagcttgctccccttggagtagcgctgcgtgcactgcgcctacttccagtgcgtgcaaagggagagcaagccgcacatgcggaagatgctggtttactggatgctggaggtgtgtgaggagcagtgctgtgaggaggagcagtgctgtaaggaggaagtctttcccctggccatgaaccacctgcatgctacctgtcctacgtccccacccacccgaaaggcacagttgcagctcttggttgcggtctccatgcsgctggcctccaagctgcgtaagactgggcccatgaccattgagaaaatgtgcatctacaccgaccacgctgtctctccctgccagttgcgggactgggaggtgatggtcctggggaagctcaaatgggacctggccgctgtgattgctcatgacttcttggccctcattctgcaccgaccgacaggccttggtcaaaaagcatgcccagatctttttggctgtctgtgctacagattacacctttgccatgtacccaccatccagttgtgaaaacaacccaaatgcctgttaactgatgaacagataaccatatgtgakatatatcaatacaatggaatatggcctggcatgctggctyacgcctgtaatcctgcactttgggaggccaaagtgggaggatcacttgagccgaggagttcaaggccagcctgggccacaaagtgagactccttctaaaaaaataaaataaaataaaaaataaaaacaatgtaatattattcagccatagaaaggaataaagtactaaacacactataacatggatgaactttgaaactattatgctaaatgaaagatgctaatcatgaaagaccacatatggtatgattgcaattatatgagatgtccaaaataggcaattccgtagagacagagagtagataagcagttgctcagggctggagggaatggggtcattgtgggtgggtggtaacagctaaaggacacagggtttcttttggagttgttgaaaatgtcttaaaaatgattgtggtggtttttgcacaactctgaatatactaaaaaccactgaatgtagtacacctggggaccctggttctctgccctttctctggccactccttccctgtgtgccatccctccngcagtctgcagcctctgctgctccttagtccactgttcttggccatctcttccacctgtgaccactctctcctcattccctctgggatgagctcactccttcctttggtaccaattactatctatggcagtgggtcttgactttggacagaccctctagagactctgagtgattgatctgggtgcagcctggccatagagcattctgaaagctcctcagggcattctaatgtagaccactggacagtaaagcgttagtttgctcagcagccttgggtcactccaaccctgcacattccaaaaaaaggactggcccttgaccacctctggggagataacttctgagcactttgaatcttctgccttcatttttattttttctgaggtggagtcttgctctattgcccaggctggagtgcagtggcatgatctcagctcactgcaacctccgcctccctggttcaagtgactctcctgcctcagcctcctgagtagctgggagtggcaccggccaccactcccagctaatttttctctattttcagtagagatgggcttttgccatgttggccaggctagtctcaaacacctgacctcagttgatccacccgcctcggcctcccaaagtgctgggattacaggcatgagccrccgcacccygccaaatattctgccttgtaagaatgtttttgtatgcctgaggctttgggctttgctgtatcaatatgacctctctagggactgaaacctgagtagctggggtcaatcacccaggagctgcatgccccaagaaaaaccctgagcactaagggttgcttgggtgggcttccctggtagacaacccttagcatgtgctgccacacatcattgctgggagaattaaccactgcctgtccaactccagattggaggccttcctttarcatttcttgtagcacaggtctggtgttgatgaaatccccgaacttttgttcgtctgggaaactctttatttctcctttaggtatgaagggtatttttgctggatatattattctagggtaaaagatttttttcttcagcacttaaaatatgttatgacactcccttctggcctgtaaggtttccactgaaagtctgctgcaagacgtattagaactccattgtatgttatttgttgctgttctcctgctgctttaggatcctttttttatccttgacctttgggagtttgactattaaatgccttgagttagttttctttaggttaaatctgcttggtgttctataaccttcttgtacttgaatatttatatctttctctaggtttgaaaagttctctgttattatccctttgaataaactttctacctctatttctttactttcgctttaaggccaataactgttagctttgcccttttgaggctattttctagatctcataggcatgcttcattcttttttaatttttttgtctcctctaactgtgtattttcaaatagcttgtcttcaagatcactgattttttcttctgcttgatcaatttaactattaagagactctgatgcattctttattatgtcatttgcatttttcaactacagaatttctgcttgattctaattatttcaatcttgttgttaaatttatctgatagaattttgaatcctttctctgtgttatcttgaatttctttgagtttcctcaaaaccactatttcgaattctctgtctggaaggttacatatctctgtttctctagggctggtccctggtgccttaattagtttgtttgatgaggtcacgttttcctggatgggctcgatgcttgtggatgttctttagtgcctgggcattgaagagttaggtatttattgtagtcttctcagtctgggcttgtttgtactcatccttggaaaggttttccaggtatttgaaaggatgtgggtgttgtgatctaaactgtatctgagtaggggacactccaagcccagtgatgctatggtgcttgcagactcatagaagtactgccttggcagtcttagataagatctggaagaattctctggactaccaggcagagacttttattctttacctgtaatttctcccaaacagtctcagtctctttttttgtttctctctctctctgtgctgagccacttggagctgcaggtgggctgacacaacatccctatggctaccaycacttagactgcactgggtcagacctaaagccagcaaagcactgggtctcactcaaggccccctgtaaacactgcctggctatcaccgatgttcattcaaggccctagggctctgcagtcagcaggtggcaaagccagccaggcttgtgtctttcccttcagggcaatragttccttcaggccctagcgggtctagagatgctgtgtgggagccagggactggagtaaaaaaccttagaaatttacctgatgctttattctaaggcggctgagctgacactgaaaccatgagacaaagtcctttccactctgcctttgccttttcacaggcagaggaaactcaccctgtggccaccaccagaggcccacagggaacactgccagcctacggtcgatgttcacttagggcccaagggctcttaaatcacttgtggtgagtgtttccaggcctgggactcaccctttggggcagtgggctcccctttggcccagggcacgtgcacgtccagaaatgctatctaagagccaaggcctagaatcagtgaccacaagagcccatttggtgctctaccccatggtggccagacaggtacctaagctgcatgacaaagtcccttttacctttccctctgcttttctgaagcagaagaagtccctcaccacagccaccacagctgggaatgtgctgggtctcatctgaagccagcatgtctcagtctcagagtcttactccaggcccataacatactacctgggtatcactgttggctattcaaggcccaaggactcctgagtcagcaggtgatgaatcctgccaggactgggttcttttctttaaggcatcagattcccttctggcccagggtatatctagaaatgacattcaggrgctagatcctggaatgggggtctcttgactctgaccagtgytctatcctgctgtggctgagctggtatccaagatgtaagacaaagtcctctttactctttcctctcctctcctcaagcaaaaggaagaagccacgtttgttgctgcatgctgcactgcttgggttgggagaggggtggtgcaagcactcgcttggctgccctgcctggtgtcttactaggttgtgtgccccctgagtccactggctctaagcctagcatggcattaggacttacctgggaattgaagtctttatggtctagactgcctttcaagtttacttagagccccaggtaacgatagcttgccatggcaaggcttatcaaaactcaagcctcaagccttctaactgctaggatgggtgaacccctctgggtagggctggtttaaatgctccctccacgggcaggtgtcacgggagttccccctggttttgctttctgctgtgacagggcaacactgagttcaatgcaaagtcccacarttgctgcactctcccttccccaagtgcacagattctctctcagcaccacagtggccactgctggsggatgggagaggagtgaccttggmgtttcaagactgtctttcctaccctcctcagtgcctctttcagtgttatgaagttagggccaggtactgtgagtactcacctgatttttggttcttatgaagatgactttttggtgtagagagttgttaaatttgattttcctgcaaggagaatcattgatggaggctgctattcagccatcttgctctgcccatcctacctcacttaattttaattatctcctaacagccctatttcaaaatgcaatcacataagggattagggctgcagcatatgaatttgggggagacacaattcagtctatagcatttggacttggggagaggraggaacagaacattcagaggaaggactcagtgcaagcaacagtttggaggtgggaaagttcagctcatggatagaaaaaattgatccagtttggcagggcccacgggaagatgtggtggagtggtgagaggtgggccacatcagaaagaaccttgaatgccagactgaggttagagacatttcctgttgtgcagaagatgccgtgaggtggtggggagagtaacatgatgaaaaggatatttgggaggatggatctggcatcagtgataggtaggggtaaggagtgaacaaagctggaggccaggaaactggacacacagcccagagttcaggtttaggctgttcaaaggcagtttccacactgagttccaatgtggatcaaagcatgcagggggtggatgatttggaaaagcaaaaccatctctcttcattaccacacaatttcccagctgagatcatcaccagagtcctacaaatcagacagtcagcttgccccaaactctgttcctagaagctgtgacccagagggagcccttgtccagctatagcccagrgacactgcaccctggacaggactgcacctgttccctcccaggagcctcatctctgtctggcctggctttggcttcaaataccctcagctttggagctttggcttcaaaatctgttggatcagattcatgagagctctggccttctttggtttaggaattttaaaatagttttttcagcaggcagtagatgaactcggcttgcttacctctaaggactggctagaactcacagaaagctgttatactcacagttatggtttgattatagggaaaatatatagattaaaatcaggtagtggaagaaaggcatagggctgagtccaggaggtcaccagatatggaatgtccattatcccttccccatgcagtcagagtgcattaccctcctggctttgatatgtgccaatacacatggagtattccagccagtgaggctccctcaagcctcagtgttcaggatttttactggaacttcatcacggaggcatgcttgattgtccatgtggctgctctcagtttccagtctccaatcctttcaggggtgacctaaagccaggactctaaatcacatagtcggttttcctggcctggctagtctccaccctaaatcttattattagactatccatcctgacccaagatccccaggcaaaaatattcctatcaggcgttacgtgttggagataaggagtcaaggacaaaggccagacctatttttggttgttaattattttattttatttttttttactatacaacatgccatcattctgttatccttcctttctgttttatcttcaaaataaccctaattggtgggtaaggatgtttattattataaatgagatctcaaaaggaaaggcacttgggcaaagttgcacagtctatctttgactcgtggtgcaatactctttccactctctgagaatcctgagtcctgagaagaagatagaaggaaggtgtgtatatgtgtgtgtgcacgtgtgtgtgtgtgtaaatgtatatctaataagtgtgtgtagatatatgtatgtctctgtgtgtttgtgtgtacatgtggttgggtgtctgtattcatgtttgtgtgtgtgtgtacacatgctcagggggaaggttaaagagacaatcagcagggtgcagtggtgggaggcagacgggggaggatcacttgagcctgggagtttgagaaagagaaaatttcaataatcttcctcttgcaattagaaggaaaatcctggggctgggcataaagagaaataaagtacagcataaagaggcagaaaaatgtctaatgaaaaacaagtggccaagaatctataaagaaatatagcacattagcagcagaataaaactggaagataatttcctctagaaccctgataatctttgtgagaaaactgttggtcacatatgttaactgccgaaacttgcaggaccctgtgcaacagaactgacaagtaaaaccatgtttcttaaactcactatgctacaactgtcattcaactctttcacaacgaagatttcacaaacctatctccagcttccggatggtgagggaaagtgtgatgagattttgtgataaattgtgcctgtctctgagtccatcttctcctattgaagagaaggaaaatgaggctagcacattacagccctgcctgacaaaagtcacaagataggcaaataattattatttaaaactggagtgtcctataatgtattcatgaatgccacacattctatatcagatcatccatttcaatttacttatgttctttgaagcaaatttataagatttgaattattcagaaaatgctcccaagctaatagaagaaaatactttaaccacatgaagtatcatgctacccaatatggtgtggtggtgaagtgtgcaagctctaaaacaagaaaacacagtttcacgtcctggccctacccccttgggaaagttacgtggtctctctctgcctcaatttccccatctaaagtgtggggatgacaataatactatttcacagagttgttttgaggaaaagaatatatgtaaagcactttgaacagcagttagtgctatgtaagtgtttcctattgttattttaacatttcagattataaatatctaccctgttattcagatggcaagcgtccctaagctgataacatgatgaagagcttttgggttcctcgatttcccatcagctttgtgaggaaaaaaataccacatgaagaagagcaactgaagcaggtgtgagaaggaaacttggcttaagattggggggcttgggtttgttaggcttctatcttctaaaaatttcctgaactccattgataagaagatttttaatatcaatctagctaaaaaggaccaatagaccccacaagacactgagttagacataaaaataaaagggtaataaatagccggttgcaatggctcatgcctgtaatcccagcactttgagaggccgaggtgggtggatcatgaggtcaggagttcggccagcatggtgaaaccctgtctctactaaaaatacaaaaattagctgggcatgctggcacacacctgtaatcccagctactcaggaggctgaggcaggagaatcgcttgaccccaggtggtggaggttgcagtgagccgagatcgtgccgctgcattccagcctgggtgacagagcgagactctgtctcaaaaaaaaaaaaaaaaaaaagaaagaaggataataaatgaaatatggaaaactacacaaccagaaaaataaacaactaccaatacccaaaacatggctaaatctcataggattgtgttgaatgaaagaagtcagccacaaacatgcacatactgtatgaatccatttatattcataattaacccagggtgacagacgtcaggattgtggttaactttgaggaggacagcaactgagaaggggcaagagggagccctctgtggtgatggaagcattctgtatcttgagctgagtggtggtcacatgaatgtgcacatatgtaaatagtatggagttgtaatttaaggtatatgcatctcactgtatgtaagatactgtcttagtccattcgtgctgctataacaaaatatctgagactgggtaatgtgtaaaggacaaaaatttatttctcacagttctggtgggtgggaagtccaagatcaaggtgccagcaaatttgtagtctagtgagggctgctctctgcttccaagatggcactttaaatgctgagtcttccagagatgaggaatgctgtgtcccaacatggtggaaaggacagaaaagcaaaagaaggaaacsgagctaggcagctccctcaagccctttcataaggtcactatcccattcatgagggggctcttccctcacgacttaattatctcctaaagacgctacctgtaatcccaacactttgggaggccaaggcgggcagatcatgaggtcaggagattgagaccatcctggccaacatggtgaaaccccgtctctactaaaatacaaaaaatcagctgggcatggcacacctgtagtcccagctactcgggaggctgaggcaggggaattgcttgaacccgggaggcagaggttgcagtgagtcraaatcatgccactgcactccagcagcctgtaaacagagcaagactccatctcaaaaaaaaaaaaaagactccacttcttaatactatcacactggggtgtgagtttcaacatgaattttggaggacacacaagcattccaaccatagcaaatttactttattaaaaaagaaaaaaaaaaaggaaaatcctgtctccaaacatgatattttaagagttgatatatttacatcccaattttccaattgcttacatacatatttgtgacgatcatttttagctgagaaaagtttcagtaaattaaaaaaatctcatattatctattaatatcttattcagataagatcaaatttctaacctagattttaggttaagacatagycatttgttgtaatgtgagaatgacagagagagagagagatattaactagcagaatccaactataaaaataaatttaagggcacaattctctactaatgactcccccagacaaattattacttggatagcaatgaatcaactaaaaatggaagcgagaatagtttgagtcctttttgcaatggatggatgtttatgagactattaagtgaagagggttcagaaacaaggggataaatggcacgctaattcggggttgaatggagtaatgggatggtcttggaaatataagaatcttgcttaatggggcttgtctacttgcaattcaataaactaatatacgtaaattaaaagagataaaggacatgagcactcagaacaaaattacaggaataaatttagcaaaggggcaccaaagttgagagaagggtcactgttccacgtcagacatctttaattcttgcgtcatggagatggtaagccagcgaacagagtcttctgtctggaagctaaaaccagcctttgggatggcttcagagagactgttcagactcaagatgcaaaagtagatgttgcatggtcgaaaatatcccgaaggtaaaggcttttttctttttttcttttttttgagacggagttttgctctgttgcccaggctggagtgcagtggcgcgatcttggctcactgcaacctttgcctcctgggttcaagcaattccctgcctcagcctcccgagtagctgggattacaggcgcccaccaccatgcccagctaattttttgtatttttagtagagacggggtttcaccgtcttggccaggctggtcttgaactcctgacctcgtgatccacctgcctcggcctcccaaagtgctgggattacaggcgtgacccaccgcgcccggccggcaaaggcattttcaaagacaatggtgctcggggaaaagaatgctgtgtgttttaaaagaaaaaaaaaataaaagaaagaatggaaacaaggaagaagaagtgaccagagggtggggtgaccatatgttctggtttgcaaagtacacgtaaggttatgtctgctgtcccggtgcaattataacagtgccccttgcactctccgaatgtccggatttggatgataaatcatatgatcaccctgccaaagagagcaaattagccagaagacccatgtgtcgatttcaaacggtgtggactgatccgcaggcgcgctcaggccgctgcccagctgaacggtgtgcaccacctctgcctcgccctacctcgccctgcctgggtgagtctccaggaaggctacagcggaaccctcggctcccacgttgctctggtgccacctgcaggttatgtgggggaactgcttctctctaccccactacccaccaccctgcctccccaccctgatcctgggcagccttggagttgaccaaaagacattcagagcacccgaagccctgggtggggaatgggctggaccccgcagtgaagcctgcgttacggaatcagacgggcccagcttaaaccaacaaagccaagctcttcctcttcctacccactcctgtcctgtctcattttgtagagaggaaactgaagcctaattcagaattttcattggtagcattgtgaagcatacagctggaacctcccaggtgccattccccacatctctgtctttcccctaatacattaggatagtgggtaagcaagagaacttaagtttactgagctcctattgtgtactgggcagagtaggcacttttatctccagcctcgcaattgatgggaaataggtgattatacaaccgggatataggatcagagtgggctagtgatgtgctcacagtatctcagctgaaattggaacctaggggtctttgactctaaaggtagtgctctttttgggtctccagtttgagcaatacttgcaaaatgcaaagaacaccatgaaaatcttacattgatccataaaagactgtattgcaaacaaaaacatggagtgtcttcgtgggggagacggtgaggcagggagattatctcaattctgtgcaacctgagaactctctgaggaaaatgaaaaaagcccgactgagtgcaatttgtctgataaacaaaatctgtcagaatgtggggccttgtgagtgctaagtgaaggtaagaaaccacggtgctggacattttctaaggtgttctttatgaaattactcagggcctcagtgccttcaccttcttcatgagcctaggcagtttccccatctgtcttcatcctactgcctgacatcctatctatcaaactgcttttggagttatgactcaataaaataaaaatcatggtgggagtcatttacaccctagtgagagtcatctaagattcccttttcttctcagaccttttagctgaagttggttatgagagaggttggggaggaggaaaagggtcggggcgagcaatcttggagcttgcactgtttcttgccgacgacctggcacagtgtgaaaatgtcaatctaaatggagagctctatgcatgttccagtctattccctttgtcaccaataccaatccccaaagcagagcccccgggagggctggactgaaaagcctggaggtaatagaaaatgcttggctttggatttcaggtcaagttctgccggcgacttgctgtgtaagattagacaagtcagttcacctctttgcacttcagtgacctcatctgtaaaaggctggtctggactagattaaagactttctttaggttttgcaatttttgttgttgttgttgatggttgtgtgtgtgtgtgtgtgtgtgtgtgtgtgtgtgtgtgtttaaacagagtctcactctgttgcccagttagagtgcagtggcgcaaactcggcttactgcaaattctcctgcctcagcctccggagtagctaggattrcagaygtgcgccaccacacccagataatttttgcatttttcatagagatggggtttcaccatgttggctaggctggtcttgaactcctgacctcaggtgatccgcccgcctcggcctcccaaagtgttgggattacaggcgtgagccactgcgctcggcctgcaattgttttttgttttaatgttatattcaattcttcctccatctttattaaagtataattgataaaaattgtgtatatttacagwgttcaatgtgatgttttgatatatgcatacattatgaaatgattaaatcaagttaattaacattttcatcacttcacatacttttattattattattattattgtggtaagaatatttaagatctattggcttagaatagtgtttactagaggcgaggaagggtaagggggagggggtagccaaaggttggctaacaggttaacagatacatgagtacatggctgagtttggtggctcacacctataatcctagcactttaggagactgaggtgggaggatcacttgaactcaggagtttgagaccagcctgtgcaacatagggagaccccatctctttaaaaaatttaaaaaattaaccaggcatgttggtgcatgcctgcggtcccagctactctggaggctgaggtgggaggatcacttgggcccgagaggtcaaggctacagtgagttgtgattgcaccactgcactttagcctggggggcagagtgagacccggactggaaaaaaaaacaaaacagctaaataggaggagtagttctagtgttctttagcattatagggtgatgataatttatgacaatttattatatattttcaaatagctagaagagtgcattttgaatgctcccagaacaaagaaaagataaatgtttgaggtggtggagatgctaattaccctgattggatcattgcacattgtataaaaatattatactgtaccccaaaaatatgtacaattcttgtgtcaattaaaaataataataaaagcaaaaaatctctcttagcaattttcaagtatacattattattaactgtagtcatcattctgtagaacagatctccagaacttataacattatatttaattctgatcaaagtactagatacacagagttaagaacaaaatggtatctggagcaagaaatcctcagtaagacaaaagaagaagaaaaaaagaacaaaatggtaataaaagggttatatcagaaagcatttcctctgccctttcctttcttgcctttgagtcctaattcccagaggccatcactttaaactcattttgctacttcctctggtataatcatatttctaaataatgcttatgttgctatttcttgatttgttttcctcagcatctgtcgacttcctggcataacagagtataaggcttacctcccttacaagtaagggagcctccattctaccaatttgactggatcacaatcttatgaaatcaaatgcatttacagtcttatagatatctaaattttgtttcctaagccaagtcctgcactgaatttgtttcatttctttcctttttttcccctggagctgataattgcttcagattgtttcccttcatttgcttatacgtttttgtccctattaactacttttttttccccagatgctccaactgatctatgaaatgcctagtaataattatccaaaaactaagatacaccagctaccctatcagccctgttattttccaggaggcatccctttctcccttgccctccatccttatgctccaaactggactcagctctctcagcccatggcacggctggcatcctggcatttctctgaattttctgctgcctcttctgtgtgcatctcccgttccctggccccatatcttctttttccttggtttaccctctcattgtgctgcaatacatcttccagtggcttcctgagaaagagtgaatggaagccaagcttgctgactcccacatattttaaaatgtcattgttctaccccaactcctgattaatagtttggctggatataatgctctaatttaaacgtaacttctcctcacattgggaaatattgctctattattttccagctcccggtgttgttgggaagaaggcagtgtcatgcggagtcttggctctttatatatgacctgtcttttctctctggaagattttaggattttctctctatccttggttttctggaatttcccaatgatgtgccttgttgtaggtctttcttcattcactgtgcttgtcacttgatagactcttttgaactagaaaattatgtccttctattacgggaagccaccagcaggtttgtgtgagctaggtaatcacattcttttcttccaaggacagaggtatcaaggccctgggaaccttataagtggattgggggtaagggggcctgaggtgaacccaacaaagccgcagcacccactgagctcgtgtcccagagctaggctctgcctgaggacaatagacatgggtgatacctacttcctgcccagtcccatggtggggctcagaacacacatggtccaggaggaccatgtagtatctggctacatttacatgcacctacctgtgtgtagcattcagtgagcaacaggacaacttaggggaaggggcagcttcagagagcaggataggaggcaggtaaataaacatggggtggggagtggccttgttgggaaagggcaaaggcagggctgtgtgtgtgtgtgtgtgtgtgtgtgtgtgtgtgtgtgtgtgtgtgtgttatgtattgggggaaatggggagagcatctgtagtttcatctgcccccttttctggccactgcatcccttttttggtgaatagtttttcttcccatcatggactgaatgtctctgtctcctccaaattcatatgttgaagccctaaacctttgtgtggctgtatttggagatgaggcctctcagggagtcattaaggttgaatgaggtcctaagggtggggccctgattccatagaattagtgtccttataagaggagacaccagagagtgcactcactctctctctgcacaaatacaaagaagagatcatgtgagcacacgatatggcagccacctacagaccaagagaagaggcctcagaatgaaacctaccttggtggcactttgatcttggatttcctagcctccagaactgggagaaataaatatttgtggtttaagccacccagtctgtggtattttggcatggcaccctgaactgactaatacatctctccacctttcttcaaccacatgccgctagagggcttggcagatttagtgtcccagctacccggccaacccagaccagaccaagcagaagctctcttctggaattttctgaataggaactaatggaggggagccccatcctttcttgggggcaaagccaggaagacggaagcctcgtgctgccaacagtctgattccaaccttgtggggaaagttgctctgagagcacaaaactgatctgcaggcggagatggagacagagacaagggaaggagcctgcaaatcctgacagtgctggtgactctgagtccaggtattcctgaggcccaactgttccctgccctgcctgtggctaacttaatgaccaatgaacttcccttcttgcctaagccaactcgagtgaattttctgttactcaccctaaagagccctgactgcaacggcagggcatgacggggctgggctggctggggcagaggacggtgtgggtgaaatcagctatgacgggaagtgcagttatcgagtggcctccatgaggtcttcctcccgccccgactgtgagcaaggctgggctcatatgctcagtgggccagagtgacggatttagtcagaggtgccatgctcagggccatctttctatgggccagactcttcagcatcaaaggctttgccatcagagacagttttagttacatcttggattcacttgatcaactgctcttctcctactttcaggatctttacactagactgccccacacaggtgttaggaagccataggcatcttggccagaagcccagaccacaaaaagggcttctgccagcctgcccagggttccagagggtagggccgaggggcggtgggaagagcccagcctgggcagccatggcatgtacaccactcttgatctgtctcctggaacttttcacccctcaagtttgggccccagtggggcacacgtgggaaaaacaatgaatgcccatgtctctgaatagtttccccatcagaagtggtcattgcaccaagcaccctcctccattaaaactggacagaccaagggccactttcctaatggatggatcttattggtccatctcatgttcccaacagagctccctccctgggatgggaatgtgccattccaggagagcccttttgaccctgtctccagccaaagccagtccccctgctttctcaaaagcaggtgagtgagaccctttctaaaaaacaaaacaagaaaagtactgttacaatggcaccaactgcatatgaagttcctgaaattccgagttccactaatattatttgtctgatttaaaaaaaaaatacatacttaaaagcaacacaccaatagaggcaagcaaaccatgttttgcacaaaacaactatcaatggtgatagcacgtgatctcccctttcag

SEQ ID NO: 10565 - DNA, 20890 bp, Homo sapiens
catcttctataagacaaggatatttatatcttccttactagatttacatttaaaatctagcacagtgcctaggataagacgaattgaatctaagtcacctatctattgactgtaaaacctcttggttgaacaattttatataatacccatttacaaaatgcccccctaaacattagtccatttgctagacactagaactatgctatcaagtatggcagccgctggccacatgtggtcatccagtaattctattgtacagcactagtctagaagatcagaagagaataagacaatgtgcatctctaaggccaaatatttggctaagggtggggggtaatataaaataactgcatgttttagaagttctctagtagaagcgtgtttaccatgggtgcacatggaaccaaatctgcgagactggggccagggcagtggcaagtctgagaaccttatgcaagtatgatgggttgtgtacctgtatgatggtagtgcaggaaacccagacaccctttgattgttcacctactgtaatgagatgcgtctgtcttgtagacacatgctctggcttcctcaacggtctgcaaaaatcgatcggaacatcaaggttcagagacatgaggaagtccaacccctgaggcaaaagcaataaacaacagatctgagactttaatcccaaactatcaagagttcttgttcttggcctatatgcggcactgctccaatttagcagtctcttaatcctcttccctaaaacctgtcaccatccctttctgtaaattctttaacaagtaatagccagctacaagtaatagccacagtagccagagtagaaacggaagtagaaagccaaaggcagctttgcacgtatacagaaaccgacctttcctataaacatttcaggttgcctgtgctatatccaagtgcagtcctatcgcttcctttaaatgctaccctggaacctttgaacacagcctttaaacatgtttggccttgagtattcatggagaaataaccatcaggccggatagatttgtttattagaattcaagactctggaaaacagcttagagcaattttaaaatagcaaccagtggaataaacacaccaatggcacagggtggtcagtgaatgtgtkgcaaacagccatttattaaagaaaatgaaaccctggtgacagttttaaaatcatcatcaaaacgctttttgtctaaaagcaatatttttatagcgtctatccctggctataaatgtggtgtttcttcttaaacagtcctttcagaaccccaggtccagcccaggagacaagctggtgacatcatcctgctctacaaaaaaggaattgttcagcctccaatgaaacagtgagatctgccttccccaaagacaaggtggggcaggggtcaccccaccctgttatctttgatgtgtgtgatttcttttttttttttttttttgatgtgattttttttttcaggtctctgccatcccacgtgcatttcctgataagatatgagggggagagcctcacctaaatgggaaggccatgtctgatgtccgtcagcatttgtgacagggagaaaaaccttcacgtgagaatgttctgaggtccatcactatccacagaccctcatcccacttcctcttctcctagccaatcctgtcagccatttagtttatttcattttctctgctttttccctgaagagggataagctggagttggaattcctacaggaggaagacaagttaaaggacagcttctgtccctgtctggcctcagggccaagaatccacaagacaagcagagcttctccagtgccgaatgtgatgatttcttagtgtgactccaagtgctggtacaacagatgagtctcagtctctttactcttccatgggttgcgttgctgttttccttggttggccaaatgccttgttgccttagagaggcggtgggaagagaaggaagcaaaagcaaagctgttcagccacacattcaaaaataattattgagcaaatactatgtgccatgtgtcatatcacatgcatggttgaactaacctgacatagcccctgccctgcaggagtttacagaccagcatccagcaagtaaatcaattaagtaggtaagtctttaaatgagaagcaaattgtgatgaagcctatcaaggaagcagggtactttgatggagaaccacagggcaggacctttctagattatgcacattgagaaggcttctctgtggaggtagcatgtgagttcagacctgaaggacaaggtggagttggccttatacaaaacagcacacaccgagatatcaagtttgggaaggcatggagtggactgacagaaaacccatgagagaaagcacagtgggggtgtgggaagagacttagataggatttagaaatggcaaacggtctttgcaactggaacaagtcaccaggaagaaccaggtaaaagggcctcagcaatcatgataagcaatgtgggtttcattttaaatgcaatggaaaattctggagggtttcaagtaggtgactgacaatttcattagtgatgcgtggtgcatccatttgaattggaaaggggctgagttgggatgggttaggacaagagctcttgacttggaatgggatgatgatggcaggagtgaagaacaaaggtcacgaatcaacatgtatgtgggggcacttgctgctgacaaggtcgtggggaagggtgttgagggcaaggacaggggcctcataaatgcctcccatgtttctgaattggcccattgagtgggtggagacattaactatgacaagggagactctggaggaatgagacttaagttcataggtcattagtgagagaagcagctagaattcaatatttgactatcatgggttagaaatgtctgagacattgaattctaagtgtcacatggacaactggaaatatgagactgaagggaggagctccaggttggggaggctgatgcgggagccacagacagcactctgaagccatgagaagaattaaggtcttctagggagagagtataggggaattagagcagccagaggagagctctgaggagcaccaggcaccggaagtgaggaagaggtgaattctcaaatatttaattagaacaaaaagcaggggttaaatatcccagtgaatagttaatagctaatagtttcagtgaaactattctgtacaacactatacatttgtccaaacccacaggacgaatactaccaaaatgaaccctaatgtaacctgtggacttcagttaatactaacatcagtattcattcagcagttgtgacaaatacacaacattaattcaagatattttgtgttttgagacaaagtcttgatttgttgcccatgctggagtgtagttgtgcaaacatgggccaccacggttgaggctatggtagcctcaacttcctgggctcaagtcatcctcctacttcagcctcctaagcaatctgggaccacgagcacgtgccaccgcacccggctaattttttctgttttttgtagagataggatctcatcatattgcccagggtggtctcaaagtcctgggctcaagcagtcctcctgcctcggcctcccaaagtgctaagattataggcacgagccaccacacctggcccataacttgaaatttttttaaaaggatttaggaagatggcaaagaaaatttttgatcaattgtaagatcaggtgtaaatcattgatcttttcccctgttcaaaccaaagcacattttcacagcccaggtcttctggagttaatcaaaactggattgtaatttctactcagttccttgagatcttagtgatgttagacaaaaaccacttaacttttgaggctcaatcacctttaaaatggagataatattattacttatcccacaggcttgctgtgaagactaaaaagatggcattccataaattgtatgtaccattgtaattaatggtaaggatcttattattaaatactggacattgcgctaagtgcttcatagccattatctcatttaatctttccaacagccctgtaaaataagcattcctagcccccactgttaagatgagagaagccttatagaggtttattgacttgcctgagatcacacagctaagcggtaggttgtgaactgagctcagcctgtcttcacaatgttctcaaatgcccatgcattaactgcccatgttggtacaaagagtcaacaccggaggtcagatctttaattgtacagttactttgctgaatcatgtcagactttcctacatcagtggtcttactatggtcttactatattggtaggttacaaaatggctttaacttggaggaaatgaagatgaaatagactgtggtttttctcattaagattcagaaggaagcactcgttccttgattctttctgtattgtctcaaagaaaaaacaaaggcaaaatgaacttggtccttcagaccttccaaatctgcaaccactgccctycatttgcacctggtcagccaaataagcatgtggaatgcaggaaggcctttccctgggtctaaattcctccctctcggctattcctgtaatgcaagtccattgcttttgatgcaaaagcctatcaggtcccgaaaacttgcccttaaagcctatggttaaaggtaggaataattgagtttctcattacattaattttatttttattttttatttgagaaggagtctggctccgtcgcccaggctggagtgctgtgacaaaatcccggctcactgcaacttctgccttgtgagttcaagcgattctcctgcctcagcctccagagtagctgggactacagactcctgccaccacgcccaactaatctttttgcgttttttagtagagacagggtttcctcatgttggccaggctggtctcgaactcctgacctcaagtgatccacacacctcagcgtcccaaagtgccgggattacaggcgtgagccaccacgcccggcgagtctctcactaggtttctgtgctattacatcatgcacttgaaagtgttgtttaatgtgttcaaggaaaaatgattggtgaggacctgaaaaaatagctattgatctattacattaattcttattctaatggaaataattcactttttaaaattttcttttcactgtaaggtacattttcccaagaaagtaatttgcccgggctggagggcagtgatctcgaactsctggggctcaggtgattctcacacctcaacctcccaggtagctggcattacaaatgtgtgccaccatgcctgatgaatttttttatttttttgtagagatggtgtttcgccatgttgcccgtgctcttctcgaactcctgacctcaagggatccacccacttcggcctcccactgggactacaggtgtgagccaccacatgcagccccaaggaagtaattcttgatgagtctacaaaatcctaatggaggaaagccctatattttatcatcaagtatctatttccgcaatctccataaatcccactgagaaaactacttccaagctacacttgagctgcgcagacacatgagtatgagtagacacactggcttgaatggtgctgtggcaccacacacacacacacacgcagtaactttcctttttctccaattttttttttgccctgaaaactaaattgaatccattttccagaacatttagtgaatttcagagttccaratcaaagaatttttcacaaagaccccaatcttctcagagtttaaatttaaaaaaagaaagcaggctaaacctgtagttaagtttgacacactccaaaaaggcaaatcactaggaaatgcagcagaaattaaataaatagaaagcctaacatgaggcacaagaacaagaggccaccttatgctgtggccagcagaggcattcaaacattccgtcagcaggattccagccaacctccgaagctcacttttataagccagccccaggcatcccagagcaagatgtagctgtgtagtctccttccatagctgctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagaggtaatggggcttctmaatcaagcaaaattctaggcttagacagtgtggggaggtgctggacaatgttaattttcaaactcctccaggagactatcttcggtgatggcaccatgccatcatccctatatggcatttcaggggattaagtgaacttgtaatgctctgggatagtttattttaaagaaaccaggctgctgggtttwaaaaaaaaacaacagggaaaaaatttgatagtaaaagaattctgtgttgtatattttttgttaggtgggcttaaatagaatgtgcttcagaggaagctcaagtggatttctgaaaatctggtgttattaatayggggcaagaagaatgtattaactgarcacactgtttcactagtagatattgagtaactcaattcagttatattttaagataactataatcttattcaatgtgtagcagaggatagagattttggtaatkgtgacttcctgttttgtcattagttatcattagctgtatttccatatccttggcagcataaggacaacctataccatatatttaaactttttcatgtcagagacattgaatctctccaacttaaaaaagtcaatatgcaaagtcatctagtatttgaaggcattgtgatgcaaaactgaatctcccaggaacctcaaattttgagtgacttgaattgggttaacaggttaaagaaattgaaaagaacaatgatgatagcgaggtgtttgcaatacsttgaaacctaagcaaaagaaaaaaacaagacagagggtcatgttttatcacatcctctgcatcattttcatttcaggatatttcagattatgactatttccttattttcactccattagtaacaacacacacatacacaaatttcagcaaggttacagtctatttcacatgacagatggctggtgggtaaaaaggggtcttgtgctttaaggattataaagtaccattttttcagggacatttatttacaaaatttaggtctggtgcaaggtttcttttttttttttttttctgagacagagtctcgctctgtcgcccaggctggagggcagtgacacaatcttggctcactacaagctccacctcctgggttcacgccattctcctgcctcagcctcccaagtagctaggactacaggcgcctgccaccacgctcgactaattttttgtatttttagtagagacgaggtttcgccgtgttagccaggatggtctcgatctcctgacctcgtgattcgtcagcctcggcctcccaaagtgctggaattacaggcgtgagccaccgcgcccggctagtgcaaggtttcttaagtggaatcttttttccttaagaaatactgtacttctttcggtgaaagrttaaaatatttctcatgagtagatgaaacatattgctgaagatkgtatcgaaaggagaggggagagagaagatactgggtgacatggtacatttctgtagccagcgtttcttcactgctggatggagtggcactcctcgtgagagtggcgatcacccagtaggaatgtgtgaagagggtctgaacatgactgagtgtgcatgtgggtgctgtgtgggtgtttctgaagtaatcgcagcttaggtcacatccaggttttccaggggcctccctccccttcctcctcccactctcttctctctccctaccttctttcccacttctttacccccttcttccccactgcctctgtcataaccacatgtgcatgcacatgcttttatttaaaaacaaaacaaaacaaaactgactaggtacacacctcttaaatgtcattcccccagtatagtttttgctactttttgccattaggtcctagaaagtagattctacagtaggtgaagcaataaacctaaaccgatcaagcaattatatccccacccatccatatacttttaaaatagtttaagtaccttgaaatataataataccagtgttaaagagatcaaaagtgaaagccatcttctctctcccaatcctcaccacaaaattatccactattaactatcaggtaatactattcccagaagttttgtgttttgttttttgtaggattgtttgttttgagacagagtctcactctgccacccaggctggagtgcagtggtgtgatctcggctcactgcaacctctacccaccaggttcaaacaattctagtacctcagcctctcaagtagctgggactacaggtgctcgccaccatgcccagctgatatttgtacatacatcttttttagtatagatggggtttcaccatgttggccaggctagtctcaaactcctgacctcaggtgatgggattgcaggcatgagccatcatacccagcctattcccagagtttttaaaatgcacaattawaatacatatttttaacaaaataagaattggctatgcagaatgtttggctaggcaaataaatttatttcatctattaaaccttggatagttaccagtgtaagcaatactttattcattttaacagctgcataatattccattgtttggatgggtcatcacttaatctgatctctcccaatacatctctttttgattcaatagccccaagtaactgctttgcacacatactgctccccatgttaggatgttatgagacatttccagaagtaaaattgcaggttaattatactttctaattgtccctccaaatgataacaccaatccatcttcccatcttctgtgtatgggagtgcccattcctatgtattttgacagtccaacatcatataatggttttactggccatgtcttctgggaatgacttttgtgtttctacactgtgtctacctctggagagcaacagtaaaatgaaagggagccttctgggggactcaaaatagcaaccgaagaatttagcttcaaacacaagatctctctggtacttgcttcataggtctcaatttatgtgttgcattcatgaataaaatatgacttttccagctcagtagttgttccacatattccctttgtttgttgtacataaaagacatctatatcagctacaaaggatggaagctacagccaagtccctggacaatgaatttcataaccatctcccaggagcctaatatcaattcatgtgtcttcatgttaattacaatgtttacaatctcccagtagaggccacttatttaaggagaatggagcaggaagctgagagggatgggggatgacatttttagaggtgacagcttataccttggaagaaagtgttcagcagtctttgcaagcccggcccccaccagctgatgaatttgcattctgaatgcacccttacattttttctggattaaatggtcacacaggtaaaaatctttaggttatagtatttctgagctgagccatgggatgctttgagaactgatgtgtagcattaagtaaaacagaggcaggggccacccctggatattccagaagacagcttcctaacccaaatgaggaaacatctggcttatgaagcacatgtttaaggggacagtgaattagcacatgtgaattwtagactgtcctgaaaaatccagtacagmacayagacttcctccatggaatccccacaaagaagcagctggggacagttcataccaagctttaagtatcttctctgtctggggccatgtgctcgggaccaagaasgtagaggcaatcactgtgcagaagcaggtaagagggatgaaatgagaacaggcctggagctgggcaaatttaaatcccaattcttcactttactagctgggtgaccttcagcaggtgaattcagctttccgggactctttcttctgcagaatggagacaatgattgtgtctctctcaaagcactactgaaagaattgatctctgacaaacagtatgtggaagcttttaataatttttgttatgatttataattcctgcttttgaagacctcacaagctgccaatctctaagagaatccttattacacctgaaatttcaatttatccaaggcttcttgttttctgccacttacttatagccaagattggtcaaggacagctataaagatcctttagcctcatccaggaacatacaagacttaagttgctaatacctaatatagacgtatttctatatgaacctttagcacttaaccctgctagtagccaccatacctgaggcatgtgttgagtcggaacactggggacaggggacctggggacccaaatcagtcagagtatgaattctgccatgtatcttttgagacactctcattggacttgtcctcattcttcagtgggaatccaatttttctcccttcatagctatgtttgaagagcaagtgaaaacaattttgtataccataaagtgtgtattcactagacaatattatgaacacctattatgtaccaagtatcatgttaagyatcagaagaaccaagaataataagacagatgaaataaagtaaaatagagaaaagaaaatatacagaatactctataaaatatggaataaaataaaatgtgaactgagactagagaatgaagaaraataagtttcaaagacagattagcagaagggatactaaattatagtataaccaggaaagccttctcagaagaggagatatttaagcttgctaagaatacaggaaagcgctggagcaagagtgatcctagcagaaggaacacacagggaagatgagattgagctcattctcagatgaccctgaaagtcaacaagcctagagtcacaggatgtgactggagagacagaaggagcctcatctcacagaaggaccttctagtattatgattgccatgaagctcttaagaatcttcctgtccaagttattttctttttctttttttccttccttctttccttcattcattgtttttttgtttgtttggtttkttttcagacagagtttcactccctcaccaaggctggagtgcagtggaatgatctttgctcactgcaacctctgcctcccaagttgaagcagttctcatgcctcagcttcccaaatagctggaattacaggcattcaacaccatgcccagctaatttttatacttttagtagagacagggttttgctatgttggccaggctggtctcgaactcctggcctcaagtggtccacccgccttggcctccccaagtgctgggattacaggcgtgagccacttcgccagcsccaagttattttcacgcattattttttgtatacactgggctcaggttcaccaaaaccactattgccttgggtcctacattccaaagcttgattttattttaatcatacgcttttcatccacctaccccatcccaccctaaaattttccccagacaaggatggagatctgaagactcaaattgaaaagctctggacagaagtcaatgccttgaaggaaattcaagccctgcagacaggtaaggtgcagaccttctcagtgccttgtcccaaaggagacaggaaaatttctgggtcaatttctgggggaygtctttttaaaagaaacattgacaaatcaayaatgtggccaataagagggccccaatgcygggagatgattgttttaggaaatcagcttcatttacaatcccattctcctatatatgggtggtatagaaataaaaataagtagttcaggaataaatttgaaaagtcagtccatacttattctctaaagagtagtgaaacagaatgaagccagtatgaaatgactaaaatsattagcatttattggatgatagctaagtgcctatcaggccaccaggactctctcgggccacacccagcctaagatgctggaaggacatgggttagaaccgcagcttgccaacagggcagcgccagcgttcctccccacagttatgcagccacatgcgctactgcccaggagctattctccaaggggtgaggaagtgagccatgtgggcaggtttgggaacagccctggtttacaaggctcatcccccaaggagctaatatcctttgtagcaatttcaaaagcaaggtgttgaggttcctcacaagagacctgcctcattacaagttactgccttcagggaagactgaagttacggctttccatcaagtatttataactcccagaccagatgcatgttaccaacctggggtcatttttaccacaagcaatgttgcctagtaacaagggtgacatactccctttatcaggcttccgggggaacagaattagaaagttaaaagacagtcaaatgcttatgcagaaggtgagtttggttcatcctttacccacagtcaggtactagaaattctttataaacacaaatccattaatcctccagcaacttaagctaytatgatcctaattttacagatgaggaaaatgaggcacaaagaaggtaagtaatttgttcaagakatacacagctagttaaatgtcagagatgagacctaaacccaggcactatgggctctgaggcctgactctccagtgctatggcctaaaactatctttatgctcagtttatcctgaataatctaaacaatattaccaaggctcagttatctgcttaagaaaatccctgtctctccacatgcaaaactagaatttaattgattgattgattgattgatttttgagacagagtcttgcactgttgcccgggctggagtacaatggcgcaatctcggctcactgcaacctctggctcccaggttcgcacgattctcctgcttcagcctcctgagtagctgggattataggcacacaccaccacatccagctaattttttgtatttttagtacagacggggtttcactatgttggccagactggtcttgaactcttgaccttgtgatccrcccrcttctgcctccctaagtgctgggattataagtgtgagccaccacgccaagcattttttttttaaataaatatttttaaaaataaatattaaataccatctagttccaaaactcccaaagaaatccaacacagagtagcaagcatgtatatatcagaacagcatgaagtttaaggccatgtcttgggatagggcagacctgcatttgggtagctgtgatctcacatgctgcaaaaattacttcatttaaaaaaatgtggctaggcgcagtggctcacgcctgtaatccaagcactttgggaggccgaggcaggcggatcatgaggtcaggagatcgagaccatcctggctaacacggtgaaatcccgtctctactaaaaatacaaaarattagccgagtgtggtggcaggcacctgtagtcccagctactcgggagcctgagacgggagaatggcgtraatccgggaggcggagcttgcagtgagccgagatggcgccactgcactccagcctgggcgacagagcgagactccaactcaaaaaaaaaaaaaaaaaaaatgctaaggtgttacaagtaacaacttctctaagcctaaatatcctgatatgtaaaaataggggtaataaaatacaacttcatggggttgtcaggattatgtaacttaatttatgtaaaatgcttagcatgttgtccggcacatagaaaattgtaactgttgtctcatcattatcatacttcattccacaaatacttattgctatttgccaggtccagccctagkcataatacactcaaaatgcatcttaatatgttacacttcacatcttcacagtctgtctscgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctmaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaraattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattttttttttttcttcatgcctaccctttttttggaagtttccagccgcaatttgaaatgaaatgacaaggtgtatatttgatcaattttcattcccaccattgcattacaacctctaacttaaatgggtaaccctaaggcatatcaaagaagcagattgcatgataaacggaaatagaaaaaaagaacctacatttattttgctttagcatccttactctcaccttttatgagattgagagtggacttacatttccttttttacattttcgtatacttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattgctcaataataaagcctgaattctgatcaatagaaaatgtgttcgagtgttaattacagttattcaaaatatgttggtttatattaaacttggcagagtttgaggggaattaccctgaatttaatcaaactggtgattcggatatactcagagaacaattttacctggcaatgaagaggtatggtctggctagaggagggaaacttttaaaaaattttagctgcagaggctgggcgcagtggctcacacctataatcccagctttttgggaagctgaggtgggcgtatcacttgagctcaagtgttcaagaccaacctgggcaacagggcgaaaccctgtctctacacaaagtaccaaaattagccaggtgtggtaaggcatacctgtgatcccagctactcaggagactgagctgggaggatttcttgaactcaggaagctgaggctacaatgagctcagattgtgccacgacactgcagcctggatgacagagcaagaccttgtctcaaaacagcaaaaaatgtagctgcaattatatctggttgatcttggccaactccctacttccaacgtaaccacagtcttcgtaaaggtaatgaccataatgaaacgggtggacactggtgagtaagtgcattctcttcacatttcaggtactatgctagatcttatataattatcatttatcttgaggaacaaccctgggaatttaacccggagaattaggctctagaatcatttcatattacagaagaagaaaaaaaagagagttaagttgccctaagtcacaggccaggaaatagtggaactgtcactggaacttaacaagctgactcagatcctgtatacttactacccatggggagcaataaaaggtaaagcccattcagaaaggcaatgggagtggattctaatccagtatctcaatttccttaggtgaagtaacaatctggactaacagctgaccttgagaagcattcagtctgaggctacttcacagaaggtgtttttccttccccctttgcaagggcccaaataaagacaaagacaaccaatgttactgagcatggtggttcaagcccctaatcccaacgacatcagagactgaggcaggaggattacttgaggtcaggagttcaagaccagcctgggcaacacagcaagacatggtctctacaaaaaaaatttaaaaactagccaagtgtgatggcacatgactgtagtcccagctacttgggaggctgaggcagggggattgcttgagcccaggagtttgaggctgcaaggagccatgattgtaccacttgactccagccagggcaacagacagagtgagaccctattgaaaaaaaaaaaaaagacaacatttgaagatgatccattaaataaggcaatccttcccaaagtgcctcaagaagaccaagagagtaagttaatgcaaaggaatagatgaaggttagtgacatcaagatgagggttagcgaatatcaagatcagttagcaagacaaagcacagatgatgggaaacagcaaaactggaaggaatggattaaaagattacctggtttgttcctgggtctaactcatgacctcgactttgttacttagccaacaaagcagatgaaagccacacccacaagattccctaacctagacttctctttggtctgttttgcctgttgggtactctctagcaaacaaatggtcttcaggcaggaatgataaattgttcttaactctcaggccaacttttttttttttttttttttgaggcagggtcttgctttgtcacccaggctgcagtgcaatggcacaaacatggctcattgcagcctcaaccacctgggctcaaagtagcagggacgacaggtgtgtgccatcatgcccagctaatttttacttttgtagagacaggggtcttgccatgttgcccaggctggtctagaactcctggtctcaggcgatcttcctgcctcagccttccaaagctctgggattacaggcataagcccatgctcccagcctcaggccaactcttatgcttccataaaagctgtctggactagaggatagagaagcatcctgaagcctggtggaaacaatgacataaagaattagcaatgtctcccctacaaggtcatggtcagaggatgtgaacattgtatcatgtaagtgtcaggtgataaaacttcgaatataactgacatcttcaggaaggtaggcgtttcccgtcttcccaaagatgtcagttacgttcgaagcccaaacagtctaggctccccaaaccttaccaggaagctgattctaatcttcagagcagtgcttctccccaaaccttaccaggaagctgattctaatcttcagagcagtgcttctccccaaaccttaccaggaagctgattctaatcttcagagcagtgcttctccccagaccttaccaggaagctgattctaatcttcagagcagtgcttctcccaattttaaatgcttgcagatcacctgaggcccttgctaaaccacagatctcatggggctgggccgattccaacaagctcccagtgcacaccaaaagtctagaccacagaccacagcatgagtagcaaggttctaaagtttcagctacttgcccagacaccatctctgattaattgtagttctgctgcttgctagcacaaaagggtaagatttacagttcttctgagtaaggaacaatacagacagcaattttctacttaccaaaatgcttccatgcccgtcattaagtgagataacaagaaaaatcagtaagctaaaggaaacacctataacagactcaggctcaattagtattgtgaagaactggcttattgcaaggctcaatggcttctttctctttcccacttatctggttgattttggccaactctgtactccaacataaccatagtcttcctaaagataacgaccctaatgcaataggtagacactggtaagtaagtgcattctcctcacatttcaggtactgtgctagatcttatataactctcatttatttctgggcagcatttcttatctaaaaataaagttctattactggaggccaagaatttgaggctgcagtgcactatgcttacacccataaatagccactgcagtctagcccgggcaacatagtgaggccccatctcaaaagacagtaacaaaataaataaattaaacaaatagaaatataaaatattttcttctctcagattagcaagaacttccataacatcaccaaaaaaggcacatctaacaaatgaaacccccaaaatttagtatttggaggatgcaataaataacatcaaattttagtaagctcagtatcttatttaatctggtgcaagaaattcaaaggctatctactaacggtaataggtaatatggagagacagaaaaagtcagtcatatcacgcaagagagcaagactacctgcgggggtctgtgaagacaatattaggatctataattacacatggcattaagcagatggattactatctaatttttttctaaactgacacccacaaaatggaaaatagtttaaataaaattctgctaaggaactataaagtgaatatacaatagtcaaaaacatgtgcacacatgccagcaagcaaagctgacacttctcctctcagtgtgggtggttcagggaggtatccgcagcccacacagagccaatcagattattttccagtggttgtcacctggaaactgggagcaatggaacactttcccctggacatgttcaataaggacaaagtaaatttagggcttctggcagaattctttctttctagatgagtgcaatgtgcagaatgaagcaaaacaaagataagcagtgatgagaaataaggggacaaaaacggaaggagagggaagggaaagaaaacaacagggagaaaatgtgtgtgttctgatagttcttagtccatcatttcaatcccctaaggcccgggttctatttctgtacattctgtgagctgccccacaatgcctccaaactacagaatacaattcttccttttcatttgtgctagtttcagttggcatattagccaagataggctaggttatgatgcagtaacaatctcaaaacctgagtggcttcaaacagcaaaggttactactgtcccttcatgttcatattcttcgtgcattaaaaaggggctcttctcggcattgtgctcattctagaaaccagcggatggagaagcaactactgtcattctctacagcagaggaaaagagttttggagagactcacagcagccattaaatgatctgatacagaaatagtaaacatttccactctgagagatacctgcaagtgcagttcagccatgtgcccaggaggtagagagctcgaatacttggtggtgatcagcatgtctcccacagttgggtttctgtcacttgcaatcaaaagaattctgattaacataagccatgaagagaaatgagactagaaagacctgtattccaattgaaagagaaaatgggttcatggagataggtagatagcagtagaaacgcatctcatatttggtaaatggaagccgagttcaaagcttcaaaagctggaagtcagtttaactgtttaactgtataaattggaattattacatgcaactccaaaggcaggttcttagcatctgtgatagctttctagaagtgggacatgcatttttaagttgggagatggtatgtgcaaattttatcttattaaaagccaattattccagttgtccaatatatttaatctacccaagtagagtgaccatggattacattccaatttgccctggagagtgctgatgaatgacaattgtttaaaaatttatagcaccctttttcactctgaaagtttcccagtttgggtaataaattatactgtcatcctaactataactcaggctttgtttcagaggattgatgatcttgcctattcctacattttaaaattcaccttccattcctttcatggaggagccctacacttgagacaaactatgctactcatgggaacttaaatgcaccattaatttacaccagcagcactctgatcatatttctctttcctctgtctagaactctttcttatcattgtgtttctggtgactttcttctctttatttaatattcaacacaatggtgaccttttctgccctcctgcaagacatatttcttcctctgtgcattcataataccttatataactcacagcccttattgcatttgtctaacaatggacaagtattatcatattatcctcccctaattcaaacctttcaatggctttccaagtttcttaaaaacaaaactttaatgtggcctggaaa

SEQ ID NO: 10566 - DNA, 39181 bp, Homo sapiens
  misc_feature (1)...(39181): n = A,T,C or G, or insertion/deletion polymorphism (see Tables 1-2)
ggctcacagaccaggggcaggagattcccatgtgataatttgaatataaattggttagtgctacaggccttctcagaattgcagagggcatggagagagattggtcaggctgtaagatctagggaggattttccttgtggggtttaaacaaggcctggaaaaaatgcttaattggggtgaggtgggggagcaatagagagggttgcatagtcctagacatgaaaatagacaagaggccgggcgcggtggctcatgcctgtaatcccagcactttgggaggctgaggtgggtggatcctgaggtcaggagttcgagatcagcttggccaagatggggaaaccccgtctctactaaaaatacaaaaattagccgtgtgtggtggcgggtgcctgtaatcccagctactggggaggctgaggcaggagaattgctggaggccaggaggcagtggttgcagtgagccgagatagtgccactgcactccagcctgggtgaaagagcaagactctgtctcaaaaaaaaaagaaaaaaagaaaatagacacaaaatgtagacattttcgaggaagtgaaaggagctgactgtaatgaaagtgtgagtctgtgatgtctctgagctgggaggacagcagaagggaagcagatatgatgtggggcagccatgtggctgggttaggacactggcaggcctgtgcaaccccgagagtgaacacctcctaaaattctcctaggacatgtgtctttctggtctcgccttagtcctgcccccgattctatagaacaaacatcttgataaacactggacagaagagcccagcttgcaacttctttaagggcaggaatcatatcgttttttcaatttttttttttttgaggcagagtctcgctccgcgcccaggctggagtgcagtggcgtgatcttggctcactgaaggttctgccccactgggttcatgccattctcctgtctcagcctcccgagtagctgggactacaggcgcccgccaccacgcccagctaatttttttgtacttttagtagagatggggtttcaccgtgttagccaggatggtcttcatctcctgacctcgtgatctgcccgcctcggcctcccaaagtgctgggattacaggtgtgagccaccatacccagattttgttttgttttgttttgtttttgagacagagtctccctttgttgtccaggctggggtgcagtggtgggatctcggttcactgcaacctctgcctttcaagtgattctcctgcttcagcctcccgagtagctgggattaagggcacgtgccaccacacttggataatttttctatttttagtagagatagggtttccccacgttggccacgctggtctcgaactccctacctcaggtgatccacctgcctcagcctcccaaagtgatgggattacaggcttgagccaccgtgcccagcgtttttcaattttacatttatctgtctattccctgtgctctagtgctggacagagagactgggacctagaagattctcaaaaatgtttatcaaatgaataaatatttgtttaatgacacagggtaaccaaggcaaatctggtaagcaaatgaatagtggagttttaaataatcagtctccaaatagaaattcagcaataaaagagtatttgttgtgttaatgtgtcaagagaagaccttggcctggaatgagttcagtatttaaaacccattttccaaggggtagaagaatggaatgtgtataactttggatcaaaatgtgtataagttgtaatcaaactcaaggtctgatgccttgacattgggaaaaatacatgattcaaaaggcaaaactgcaaagcagaaaaatgttttgtaaaatctgtaacagttaaaatgctctcctctgacaatctttactgaagggaattttttaaaagtcatttaatacaaatacgtcatcttaaaaataaacatataaatgtcactcttttcttaggtttgaggttgctatgttacttacttacattaaatgtaacttctgttaatcgaaagaaaatctttttttttgccctctttttgtggaataatgtatgtgtagtctaagtaaatattcatttgaggccgggcgcagtggctcacacctgtaatcctagcagtttgggaggctgaggctggaagatcacttgagccctggagttcaagaccagcctgggcaacgtggtaagaccctatctcttcaaaaaaataaaaaaatagctgggcatggtggtgcatgcctgtagtcccagttactagggaggttgaggtaggaggatcgcttgaatctggaaggtcaagtctgcagtgagccatgattgcaccactgcactccagcctgagtgatagagtgagacctggtctcaagaaagaaaaaaaaagtcatttgagagaatatattcttagcataaaatttattataatgaattcagctttattttatcataatggtggtttacatttcagaaacaaacagaaagctagaattcttctttatctggggactgaaatcaaaatgagaaaggcagcaaatgtcattcttctacacccatttagtatggtagaatcaaggaaggacagtaggtttctaacagcccctgggtttttaggtgatgggcagctctgcttgcactgtatttatcctccactaggaccgaattaataaaagaaagtgagcttaatgatattctttttctatgattaaatatattcactgtccaatagatacatgaatgtagcatctgtttgttttcagaagcaagaattgtgaggtagaaatgcccctagagaacagcggtgcatagagggtgtgtctcctgggtcagcacccagccttcaccacctgcctcctgcctccctcccttccttggccccattgctatatcaaaaacccctgcagtctattttttcatgtattctgttggggggcatgtacacagaaattaaacaacacctcttagacttgttttttgttttgttttgagacgctgtaatcccagcactttgggaggccgaggcgggtggatcacccaagatcaggggtatgagacaagcctggctgacacgatggaaccccgtctctactaataacagaaaaattagctgggcgtggtggcacatgcctgtaatcccagttactctggaggctgaggcaggagaattgcttgaacccaggaggcagaggttgcagtgagctgagatcacaccattgcactccagcctgggtaacaagagtgaaactccaactcaaaaaaaaaaaaaaaaagaaagtaataaatgctttcagtgagaaaattcaaataatatagaaaggtaaacatttgaactgaaagcttccttcttcacccaattactctctttctagaaggctcctgttaataatttctcaagtgtcttttcagaaaaaagggctatgtaccagcatatatttctttttgaaatgtacataattgaattataatatattttattttataccttggtcttttcacttaataaactttgaacatgttttcattatcagtgtctacagtatagatcttcccatattctttttataatgcttcctagtattctattgtataaaggtattctaatctatttatatacagtgtgccctgctggtggacatttgtgataatttattttgctgttacaatgaatacccttttacatataactcgatatcttctttcatatgaattcatgaggtcactgggccgttgcatgtagttagataagttgtacactgcataaagtgccttttctatgagggcaccattcagtttgtagacaccataaatttaaatagttattatgatactcttctggaagatagacataaaatctcctgatgaggggatactttattctaatttgaacaaagtcaccatggccctgggtaaatcaatattaacagaacaactgagtcaaagggcatatgcggccaggcgtggtggctcatgcctgtacattgggaggccaaggcgtgtggatcatctgaggtcaggagtctgagatgaaactcaaactcaggagtttggcaaaagcctgtctctagtaaaaatataaaaattagccaggcatggtggcgcatgcctgtaatcccagctgctcaggagctacctaaaaaaaaaaaaaaaaaaaagaaggcatatgcacatggacttttgataaactattgtcaactttccctgcaaaatgtttgtaccaagagagattgatttttgacagacaatagggcttgatttctaagatctaaaacatactgtgttgttttaagtcatggtcaacttttatttacctgaggttgtaagaaagaatgagaataggaatagccaaaagctacctccccaaaaattctcaatgagaaaatcaggtaatttgcatgttacctgttttcctttcctttctagggatgatctaatgcacaatcccttgaaggattggatgccggcaggagacaaaataatctgctctagttgcagggcacctgaaacctgcatagttggttcctgaacatatatatgttgataaaaatgtttgcttttgttcttttttttttttttttttttctgagacagagtgtcactctgttctccaggctggagtgcagtggcatgatcttggctcactgcaacctccacctactgggttcaagtgattctcccacctcagcctcaccagtagctgggactacaggtgcctgccaccacgccttgctaatttttgtatttttagtagagatgaggtttggccatgttggccaggctggtctcgaattcctgacctcaagtgatctgcccaccttggccgcccaaattgttgggattacaggtgagccactgcgcctggctgttcttttgttatttactggggaaattaaatgaacaataatgggaaaggtgcagtaatgctgtgatggagttgtggtgggaagctggtattatgggatcaaagacagactgttgtaatgtatctattgtggggtatataaaaaaaaggttctactcttagagtcttctccaatctctcaaggaagagtcaacagttccaataatggactggatctttatcacggcagcaggcctggtaaagcacttttgggcatgggtttattgttttattggtcacattgtgcctgacattacactcattgtcataaaacgcctacaggtttgtcgctttgtgggattcgactggattctactctaagtataaaattgagggacaagccgtggaatgttaagactatgagaggaaggaatatgttaagcaatgctcaaaacaaacttaaaatagaaacaaggcaggtgggggtgggggagggggcagagaagaaaacaagttgagaaaagatttttaaaaagtgggaggaaggaaggccatgggaataagaactctgcctttagaggtgaaaggcagaatccatagaatgactggctggacaaagcacaagaggaagccaaacatttagatcccaatcccatcaactagctttgggactttggggaagttccccactcactcttctccactcccccaaatttccctatatgtcaaagaagcacaagaatgacctttccaaggttgagaggagaaaatgacaaatagcctaagaacactttgaggtgttaagagcagaaatcataggcagtgttgtctgcaggattggtttgatgtctcgtggtgccgtttactgattttgttctcttccacaataaaacatgtgtagctttctcactgggccctcgcacaaataggaaatgtaatgtgagaatcttagaagtttgcaaaactgcatcatttagaatgtatcactagcaattatcaggggcagatagcagaggccttattacgtatttctctcttgtgataaaactctaatctggcctatgtttcatccttaaggacaaaatgtggcttattgttcactgcaagcttgtttaaaggacagagatgtttctagattgattcatattcacccttcatgaggatgagcacagagcaagaagctagccacgctgggctcctcattgcctagctcaggtaagacagcacagaacagtttcaggactcaactgattctgttagacactgtagttcaacacagttgatagactgctatagacttaaccagttcaactgaaaaatgtttacagaagttcataattaccttttggaagtaggggtgttggtgatggtgtgggagtaattaatatctcaggtaggaaaggcatttaaacttgaacttactttttttttttaatttttttttttttttaagatggaatcttgctcttgtggcccaggctggagtggagtgcagtggtgcgatctcggctcactgcgacctctgcctcccaggtggttctcctgcctcagcctccgaagtagctgggatcacaggcatgcaccaccacacctggctaatttttgtatttttagtggagacagggtttcaccacattggccaggctggtcttgaactcctgacctcaggtgatcctcccgtctcggcctcccaaagtgtggggattataggcgtgagccactgtgccggcctttttttttttttgaacttttttttaaaagacagtgtcttggctgaatgtggtggctcatgcctgtaatcccaacactttgggaggccgaggtgggcggatcacaaggtcaggagatcgagaccagcctgaccaacatggtgaaaccctgtttctactaaaaatacaaaaaattagtcaggcatggtggcacgcacctgtagtcccagctactaaggaggctgaggcaggaaaattgcttgaacccgggaggcagaggttgcagtgagccgagatcgcaatattgcactccagtctatgcaacagaatgagactctgtctcaaaaaaaaaaaaagaaagaaaaaaaaaaagaaaagacagtgtcttgctctatcacccaggctggagtgcagtggcatgatcatggcttactttagccttgacctcctgagctcaagcaatcctcctgccttagcctcctaagtagctaggaccacaggtacatgccaccttgcctgggtaattaaattttttgtttaactatagagatgggggtctccctatgttgcctaggctggtctcaaactcctaggctcaagtgatcttcctgcctcagcctcccaaagtgtttggattacaggtgtgagccaccatgcctggctaaactattatttgcatttatcttatactgaatgtattcctaggccatgttgtttcttcagtttcttgtgggatacctttttcttgtgtgtaaatatctcttctggtttagaaacaatttgttccttttcagcgaggatcatctccatgtagcagggggatctctcatatgggttaatctgaccatgagctctgtaaatatggtgtayatcttggctttgctcaactgaatgtgctcaatgatccaagaatctacctctaaaccctgaagttcagcattgttctctgcatttttaagcacatgcagcaaaaattcaacacatttttgggccaccaatcctgtgtccagccccattgtttggcctgggcacacatgtcagctccacctttgtaatgacggaaaggcacacagtgcctctgaaaagtgacatctttcaggtacttggtggttttttgggtatgcataccttgatggcctgcacagttacatgggtgttcttaaagcgaacataaagatttgagtcccttggtttgcatgattttgtggagttttctgggtcaagggataggcaaaccattttcagagattacccctggccaagaggctacagaaagagcttgaattttttcttgcattctggtaccaacaataactatcaagtaacaaaatagagaaaatggaaggcataacagccagatggagggttggatgagacagcttactgtttatagagtttggagaactgcatctgggcgtgaggagacctaggccacggggcgctcctgcctccatgtgctggagggataaaccccagtgcttcttcctgcagcatctattgcattcaaagattagcagccaaaagacctttgtttttagattaaaacacataggtagagaagtgggaggaagcaaatgtggcatgaagtttgggaagagcctcccaaggctgtctgccttggaggcgagtggactgtggaggagtcaggttaggtggctcatggggtggctagctggmgggctttcatggcctcgtgttctcgctgggcctgcctcctgggaggcatttctcatatgcctctctgtctaacaggtttcactaagcgcaggagtagatgctccatcctctacaaagggttttcccgagtgactgccctttgactcattatcacctcctctccttggctcttatcaattcctgccttgcgctgtgggcacgtaagccccagtcccaagtcctctactggttgattctccttgagagcgcagtccgagtgttggtcccacctgccgagcactctgcctccatggaagcaggatctcagtaaacactggragaaagaaggaaagaatgagaagctgctaaacccaacctgtggctaaggaggtggctgattttacttctttttagaagtgaaaatcaagacagagtttagcttagctggggggcggggggcggggggcgggggatgtatttcctgaaagaagatgagagggaggaaacttaaatctctctctttaagataaatttcctggcagggcccagtggctcatgcctgtaatcccagaggcaggcagatcacctgaggtcaggagttggagaccagcctggccaacatggtgaaaccccgtctttatcaaaaatacaaaaattagccgggtgtggtggcaggcgcctgtagtcccgctactcggtaggctgaggcgtaagattcgcttgaacctgggaggcggaggttgcagtgagccaagttccccccactgcactccagcctggctgayagagtgagaccctgtctcaaaaataaaataaaataaactaaaaaagataaatttcctgattacacattgtaatacacatgtaattcacatacaaggtgaattgtggattgctttagctttgcctgttgcccttttcatcagtaatgcaggctaaataattaccctctttgctttttccagttgtgccagccccagtgtacttctggcaataaggaaatgttaattgagaatgaaaatagagtcattaaatccttacattaaataattatggtgtgttcttttaaggacatcatgttatagatatgcaaatatgttgcaatcaaattatcaaacttgccctctaatttccaaagaactgtactgtgacccagggccacataaggagaatcttagactcttgtgggcatcatgcgttgattttgatgcttcccaagtttgtgctgtgtctgggattctctaggggcagttagctgcatccaggccgtttatgagaagtgtttagtagagctgaggtcagcacagtgcaagtatcagaaaggctcctggatatcaattccagttctggccctgatgttctttgtagttttaagtcaaacaggaaaatttatctgcatattagttctcctatttaacagtagagaagatactatttctctgtcaaatatcttaaaacatgaatacaaagaaactttagacacaaggggttattaatagtttgttgtgtttctgttcatggggaggaggggatgtaaatttcagttctgattcacaaaggagattttgcagagaatctttacaatcatactttgggcttcctttctccagtckcctctgttcttcggataatcttattacctttttggtcattctaagcactacatggattagttcagtatatagattatggccgtataaacctcattctcgctcttggcagataacctaactctggttttactgaaaagattaaagctaatttggaagaattgaactcgcccattcctctcagttttgtgttgatgtatcttcatctctgtggctgcctcccagttgcaggcagaggcagccatctttcttcctcctccagagctaaccctttccctcgtgcccttgatgccccctccacctcttcctattaccactacttggcaccasccacatattagggctcccttgcaaccactttcaaacaaggccaggctttattccatttcaaaaagcacacaagaaaaccaaaatgcttttgcctgaccttgctgtctcttctagtctatttattgctttccttttgcagcaagacatctcaatttcctctttcctcatagccccttagttttgcagtctagcttcctttctctgtcactctattgaaattgtgtcctcaaatgtcacagtggttcccttgtaacttaatctgaagagggtggtgttttagcctcattcttcttattttctcagcagcatcgattttctttctgcctttttctttcatcttccactctgacatagttctctggtttatatttttctgtttatctcctgggttttctagaccagtccagtgcatagcatcatggctgagtccaagctcttacattagcctgcctgtagctgaatttyaactgccacaaattaactgcatgacctttgtcaaggtaatctccctgtgcctcagtttctccagccttaaaatggagactatagtaggagtattaacctttggtttgatgtaacaattgaatgagatagtctatgtaatatttatcacaacatttggcacacagaagttttaattgaatgttatctattagcataacaataagtgcctctgtctttgaaaatataactgttcttttttcctttcaggacatattttctccctttatgacccaatgcagagcgagacgataactaattattgttaaatagatttatgcacgtgtttggagagtcagggaaggagggctgatgagagagagaggctcctaaattctgcaggtgctgtaattccccggttttaattttgctttgctttttaccaataaatcattttgagagcttaaatcgctcctttcgggacatacggtgtttcttgagcaggaagggacgtcaacggttaaagctcttgttgttggtgcaacaatcagccacgatgaggctgcttggcatggaacacagtgtcccatccttagattaaatgcgctctaacaggattatgtaaggaaggaggcagccacggcggcggctrtgtgcaggggtcgcctggaacccgtccattgagtcatgccgccatctcgcggccgcatggggaacgggccttggcagggaggttttgtttggtgcagaggaaaggtccccagaattgccatctgcagaatttctgcagaaagtgtcgaccaggctggcatgagggaagaaggaggggaaatcacagcaaggagaaggaaaaacacctcagcatggcgtggggaagcaaaggtagcaagtcatgcttgtgccaccctacaatattcttgtcggtttcattccagaacaattccctcccctgcccaaatactctataaactttgactttcccctcttatttgattctcactttccaacactctgtgccgacccgttatcctggacagaccctgcgtcacctcctaatttcccttcttgtatgttaggaattcagggctgggaaaatttagccgagtcatcacatttggctactamccgggaaagcagccctcccgagtcaggaacgggctccggttcatcacgtggcagccgcctgcaggagccgcaggtaagggacactgttggccggggcagccagatgcagcgggaggcgtcctggctgcacttgggttcccaaaacctttctggaatgtcactctggtcaccagtatgggagctcgacctctagggggtaggatttggtaatgttctctttgtaaaactgaagtgggcaatgttgaccaggaagctgattttgtttgcttttcacaaactatgttaatcgatcaatagttgggttatagatcattctattgtcagcaatataatagaatggcagggactcagggaagatattgacactttaaamtgaaatgtctatgcggtctgtcttccctcgttcagctcacaggacattgcctgggagctgaacctaggcttatagcacagtgactgaaaggwtatctttcagagtcctaaaatctgctctgccagtatttgactttgagttaattgttcaacattactttaagcccagtttcttcttttctaaaatgaagasgatttttttaatattaattttttttttcatttttttgagacagggtcttgttgtgttgcccaagctggggtgcggtggcccgatctcggctcactgcaacctctgtctcctgggttcaagtgattcttctgcctcagcctcctgagtagctgggactacaggtgtgcaccaccatgtctggctaatttttgtatttttagtagaggcggggtttcaccatgttgctcaggctggtcttgatctcctgacctcaagcaatctgcctgcctcagcctcccaaaatgctgggatttataggcatgagccaccacacgcagcctactattgtcatttataagttcagtgttggaaggatttttaagcaatctaacagtttcttctgctcattttacagatgagataaaatcaaagtgttttataattttggccttcataatataccttttggcttcaataaataaaaggattattgaccaaaaatctaatattttgagtcagaatcattcaagtttgcaaaagcagatgggagtcagtgtaaagcataaaacagtcttctaagttaccccaaatccatgtatcttcagtaagatcaggtagagcacaacctggcaatgaaracaagccccagccggggtcttggggttcgtgaaaaccaaggggtctgcacatagctcactcaggggtatgttccagaggaagaagaattcgttgaagaacgtgtgcagagatgagtaaaactataagcagagctgtgtctttggcttccaaatggccaggtgacctcctggtcttggtcatacaaggctaggcatatgtggtgaccatagaaacccaccagaaaatgtaattctcctaggaaagaatgcctgtcttacgggtgagagggcttggagaaggagttagaacatcctaagaaatcttggaatctgtatactacgttcattcacagtgtgtttaaaacgatcctctctgagatcctgtgttgcaacagatgagaatgatccttttgtttttgttggattgggtgtaaaggacttcatgttttagaaaggagggaggcactgcaggcaggaaggagggcatggggvgsggggtgggagttctttaagaagctgcaagtacaagaaacacaaggctccagcgaggggccttgtgaccttgatttaactcctaatttgttttattttttaatgaaacttttaactgaagaatagcatcctagaaaagttgcataaatcatagacaaacagctgctgtgattttaattttatttttaaagtgaaattcaaagtgcttcacaaacatatggtatcaatctcttgttctctgcaaagacactgacctctttctctttctcatccctcggccccagctccctccctgacttccatggtttctgctactgcatgggctcggattagctttatttaatttccaggatagaggttcttctataccaacaggcgtgtagcatcaccaggcaccacatacaaaaagtgcaatgctcaggcccgacactccctgagattcagatcmaataattctggggcaggcctggagtttattrttattattattatttatttttattttttagagacaggatcttgctctgtcaacccagctggagtgcagtggcgcaatcatggcttacggcagcctcagactcctgggctcaagggatgctcagcctcccaaagtgctgggattacaggtgtgagccactgcacccacctctggcttggagtttgtaacacgtaccccggggaattctgatatagaaggtgcaaccaacactgagaaatgctytacttttcctgcacccaagattgagatgatccctgacaacctgtaagattaaaccacatcacagtttttctcttgtgatggggaggtagggtttgctagaagaggtagtgagctcaagatgtaactctgtgagtttctctaatcacagatcgaatcttccaggtggagccactcagttctcatttactttgccgtgcatgggagcatgaccttgagttctacttacgcctatgaaggcgatgctggctgcttggtttctgaagcctggggaagttgccttggctggctaaagcccttagctgttatgctaatcttgcaagagaagtcaagcagaaagaacagggtagcaggtttgttttctttaccaatggaaaggagcttcaggcatgattttcttatgccttggaacagagataccagctgttttataatgaggcccacaccctccttggtgagtgggccctcagcttgagggagttttgcttcttttattttgattttgaaatttgagattttttcatttgaaggtaatcttaatgctattaaattcataaatatgctaatttaaatacccaatcctatttatttaaaatagacgttgcaagcgtacaaatattctctccacatgtcagcacccatttagatcatggtttggaaatggggagaatagaattcccttaaactgcaagtcagctggtgtttctttacagctaacgttagcaaaatttatgcaaagcagtaattcacaatgatcttctttatttgttaacccacaaggaaacaccctcaaaactattctgttaaagtgtctgttcagaaatgtggaaaaactgaactatataaatattgaaaagttaaaaattccttaattttttattcttgraaccactaccacaatttacagggcaatatacctgatgtaatgaaaagaaaaagaaaaagaaaaagctatagcagataaaagaccatagggatgttcatctagccaatgctacattgcattatcaatagctgcactttttgcaaactgtggctatgacagtcctgaacaagaaaggttttctgtttaagctgcagtaacttttctaactatgtatcatcgtttcttccgtggcagatttttagttcctaatgcatttgggacaactgtttcaaggtaacttgctgctttcccaaaacttcttgttctttctcctgctaagaactgtatcccttttctgctgtttttatttttttattttttttggagacagagtctcactctaccccccatgctggagtgcaggggcatgatcttggctcattgcaacctctgcctcccgggttcaagcgattctcgtgcctcagcctcccaagtagctgggattacaggcacccgccaccatgcccagctaatttttgtatttttagtagagacggggtttcaccatgttgaccagactggtctcgaactcctgacctcaggtgatctgctcacctcggcttcccaaagtgctgggattacaggtgtgagccaccgtgcccagccttcttttctgctgtttttagaaccttctgttaccatatccaccatttccactaccagatccataacggtcaccacagggactgcctgaacttcttccaccaaaactgccccctttcatgcattcataatttgatcgctgtttccaagatcattatagtttccaccaccaccatagttaccaccaccaaaatttcaatgtaaccatcatatcatccaccactgccaccatatccactaccttggtttccatatcctggtccaccaccaccacggccccctctactattacgaccaggatcaccacccatagtggctaccatcacctccaaatccattctatccactgtcatctcctgcataactgtctctgctaccatcaccttcaccaccatagcctcctttccaccaaagttcccaccacggcaaaaattatctccaccacctccaaagtttcctccatgaccagccaagttgccagatccacttccatgacctctttatgacctggtagactccatctcatttagaaaggacactttttacttcacaattatgcccattaatggcgtggtatatctgaataacaatttcatcatttgtttcatgatcatcaaaagttacaagagcaaatcctctctgttttccactctgcctggcttccataacttttttattttttattattattttttgagacgaagtcttgctctatcacccagctggagaacagtggcatgatctcagctcactgcaacctctgcctcctgggttcaagcaattctcctgccttaacctcccaagtagctgggattacaggcacgtgccaccatgcccagctaatttttgtatttgtagtagagacsggggtttcaccatgttggtcaggctggtctcgaactcctgagctcaagtcatctgcccacctcagcctcccaaagtgctgaaattacacgcgtgagccaccgtgactggttcataacttctgtgstttcaatcttgtcactcttttcaaaggagtctctcaaattatattcttctgtctcttccttattacttccygacaaacattttctttactgttggatgggcaccaggctttacagaaccctctctagagacagctgtctttggttccgctatatgcccatcaaccttatgtggttgagcacactttgctgcatgagcgtaagtcacaaaaccaaggcccccgagatgttttgtttgggagtttctccttaccacacagtctgtgggtgtgccccattcctcaaaatggtctcttaaacgggcctctgtagtttcaaagctcaggccaccaagaacagttttctcaactgccctgattcccgtgggtcatggctctcctccccgcccccaccttcactggctgcaggggcagatggtgatggcccgagtcgggctgggggcaatcgggtgacagctttgcctccactttgagtttttttttttttgaaggtaatcttaatgctattaaaattcacaagtatgctaatataaataaccaatcctatttgtctaaagtaagattgtgttcaacccctcgttcaacatgggacaggagttttacgtcttttagtctccctgtacccattgtcaggcacctgtcggctctgatctggagcatctgacctgagaatcattaggttctattgaaacatgaagttgttaaaagaaaagccccagaaagaaacaaccaagcatgttttttgactctatgtgaatttaaaatttttaaattttattttagtttcaggggtacatgtgtgggtttgttataaaggcaaattgtgtgttgtgggtgtttgaagtacagattgttttgtcactcaggtaataagcatggtacccaacaggtagtttttccatcttcaccctcctcccaccctccaaccctcaagtaggccctggtgtctgtggccttctttgtgtccacaagtactcaacatttagctcccacttataagtgagaacatgagaacatgcygtacttggttttctgttcctgtgttagtttgcttaggataatgacctccagctccatccttaatgtgaattttaaaatccctttattctggagagaagctacactgtactgctgtggtttctttctgttaatgcagtggttctccaagtgtggtcaccaaaccagccacatcccagtgtcccctgggagcttgttagaaatagaaattattaggccctgctgccgatgcacagaatcagaaactctggggcctaggcctgggaatgtgtgttttaacaagtcttccgggtgattctgatgcacactgaagtgtgagaaccactggtttaatgaggaagcctgtgggaataccttcaatcaaacagagagaatctcagttcagccaggtaactgatggaaagagaaactcttgctaattggtgggggtgcagttttctggggttttattttggtgccccattgcagtggtgagaagattcctgttggccagatatgaaggagatataggtcctggaagttaggcggtgagggagtgttttcatggacctctccagaatggagcaaatccacctggggtttcatggaccaaatccacccagggagcaaggatggcagagaaaccgagtccccatgcacctccagatcaagtgagtcaaatgttccaaagtacagctgttgaaaagggtcaggttgcatcagagaggagtgtgtcttggtttggccaggacttttccagctttagcaatgaaagtcccatgtccctggaagctccccagccctgggtaaaccaaggcagtttgtcactggtcactgtagttcagtgactgcctgctggaattacttggtgggctttaaaaaatactgatgcctgggtctccctccagagataatggcagacttagtctggaggtttagaagttcctcaggtgatcctaatgtagccagggttaagaatggctgcagctgcttgcctgccatctctcctattaaaaaaaataaaacacaaaacacatacaagtcaatggttctaatgcagttgaacccctaccatgtattatatacaaatattaactcaaaatggatcaatgacctaaatagaaatgtgaaaactataaaacgcttaaaagaacatataggggtaaatcttcatgaccttagatgtggcaatagattcatagatttaacactaaaagcatgagtaagaacaacaaaaatagacaaattggacttcattaaaaataaaaacttttctgcacaacagacgttatccagaaagtgaaaagacagcccacagaatgggagaaaatatttgtaaatcatacgtctggtaatagtctagtattcagaatatataaagaattcttacaactcagaaaaagacaaacaacccaactgacaatgagcaaaggatttgaatggaaatttctccaaagaagacatagaaatcaccaacaagcacacgaaaagatgcttagcctcattagtcattaggggaatgcaaataaaaaccacaaaggatagaccacttcatacctactaacatggatctagtaataataacaataataatggaaaataaatgttggtaaggatgtggagaaattggaaccctcatacgttgctggtgggtatgtaaaatggtgtaaccactgtggaaaacagtttggtggttcttcaaaaagttaaacatagaattaccatatgatggccaggctaggtggctaacgcctgtaatcctgacacttgggaggctraggtaggcagatcacttgaggtcaggaattcaagaccagcctggccaacatgctgaaaccccgtgtctactaaaaatacaaaaattatccaggcatggtggcgtacgcctgtaatcccagcaactcaggaggctgaggcaagagaatcccttgaacccagggtcagaagttgcagtgagctactgcattccagcctgggagacagagtaagactctgtctcaaaaaaaaaaaaaaaaaaaaaaaaagaattaccacatgactcagcaattctactcctaggtatatgccccaaataaatgaaagcagatacaaatagttgtgcacagatattcatagtagcattattcaaaatagccaaaacagggaaacagcccaagtgcctatcaacaggtgaatggataaacaaattgtggtataaccatacaattgaatactattcagccataaaaaagaatgaaatactgatacatgctacaacatggatgaaccttgaaaacaatatactaagaaaaagaagccagttataaatgatcacaataatgtatgattctatatatgtgaaatattcagaataggtaaatccatagagacagaaggcagattaacattgcctgaggctgggggaggatggaatatggaatgaatgcctaatgggtgcagggctttcttttggggtgatgaaaaagttttgatattagaggtggtggttgcagaacattgtttgaatgactaattgtatgttacatggatttcacctaaattaaaagaaaatcatcaggttactcatatctacaaagtacaattgaaatcaagctctttagaagtcagagtcctccacagctggcctttagctagcctctgtagcctatcttctacctctctcctactattttaattgttactgctaccatcaccatgatactgcatgggatcccgttgactcccaatgtgtcatatacgctctgcctctgcttccaagctcaccagtgtgctttgggaagtctccaccagctgttccagcccacggtcctctctcgacttcagtggctcttaactttatgcccctcacatgtatacatatgcaacaaacctgcacgttgtgcgcatgtaccctagaacttaaagtataataataattaaaaaaacaaactttatgcccttgccactcaaagcatagtccctgtttggaatcccctgggagcttggaagaaaggcagaatctcgagttcccgctgcagacacactgaacaagatcttcaaattattttagtgcatattaaagtttgagaagtgctggtttgtactagttggacccaagtcaagctgtgatcagaatcacttggtaagctacatttatgtatattatattctttcaataatacatgcgcatggtaaaattacaagctgtacatatacaaaaaaggtgaaaaaagtaagtttccctccaatttcagttcctcggatttccagcccagaggccatctctcttaatgtttcttgtgtatttttccttctcctatgcatatgcaagcatatacgtacatatgtatttcctgccctcattctgattttacacgagtagtaacatactgtacacatggatttgcacttttcactcaacagtatatcgtggagattattttagcacatgttgatctgcccaatattcttcttagtgactgcatagcagtcgttgtaaagttgtatagttgtaatatatgtaatttatttatgttcaaaccattggctggggacagtggctcaagcctataatcccaacactttgggaggctgaggcagaaggattgcatgagcccaggagtttgagacaagactggacaacgtaaaaaaaaataaaaattaattgggcgtggtggcatgcacctgtggccccagccactcagaggctgaggcagggggactgcttaagcctgggaggtagaagctgcaatgagctgtgttcctgccactgcactccagcctgggagacagagcaaaaccctgtctcaaacccctgccccactctcccttcccytgcccaaaccattaaagaacacaatattgtttattacagtgctatggtggctatcctttgtgtatatctttgaacatatgatgtgttcmtatctataggattaaagaattgcctattacgtgtgctttaaagtggtaagagatagtgccaaatcctctctaaaaagaggtacngatttacattctcagagaacttttaaaaacacaaaatttgaggctactctgtatttcaattcatgagaactctgtgggcagagcctgggaatctgcgttttacttctttggtgacagtgataaaagaaatctgcagaatggagtggggaactagagggcagatccccctygacccccaagctgctattcctcttgggctgccttgggttgctattcatctgtgtgactgttctatctcaccacagtggaaggttcctaaagacaggcctcaggattgctgcctctttatattcttaccccagcacaatgcattgtacaacaatgtttgttgatgatgagtgtctgtggcgcatgtgattttgttttgttttgtttttagtyccatggaccaaagacagaggagaatcctgggccagcccctttccatccctacttcccagcccaagcagaaaaggacatcaatgatatctttcttttccaaggtctgacacaaaatattatgaacaaatttctcctcccagcagctgttttgtaagatgtatgtttgcttggtctgtggttagttaggcctgctccactgaagttccttctgaaaaaactttgatgacagtttttttttttttttttttttttttttttttgacgtagtctcgctctgtcgcccaggctggactgcggactgcagtggcgcaatctgggctcactgcaagctccacttcccgggttcacgccattctcctgcctcagcctcccgagtagctgggactacaggcgcccgccactacgcccggctaatttttttgtatttttagtagagacggggtttcaccttgttagccaggatggtctcgatctcctgacctcatgatccacccgcctcggcctcccaaagtgctgggattacaggcgtgagccaccgcgcccggccgacagttcttttaacatggataggatgtttacaggatgacaggaagataagttgagaataatttaacttgctgctaactcaataatacaaatatggaatgaggccgggtgtggtggctcacctctgtaatgccagcactttgggaggctgaggcaggcggatcacttgagctgaggagttctagaccagccggcaacgtggcaaaaccctgtctctaccaaaaacacaaaaattagctgggcatggtggcatgcacctgtagtcccagctactcagggctgaggtgggaggatcgcttgagcccaggaagtaggggctgcagtgagttgagatcatgccactgcactgcagcctgggcgacagagcgagacgctgtcttaaattaaaaaaaaaaaaaagataagataaaaaaggaatgaactgtaatgaaaatccaggaatactaatgaagctttgaaatcaccaaatctcatccatagcaccamtgagatagctgaatctcaagccagtctgcccctctaggcccctttctaaggatggtagggaggtggcttttgtcttctttgatcttgtctggatatttcgtcatcttgattctgactctagcacatgttgctgtcttctgggtcctgctgcacaccagggtcttcctgcatgagagctcataggcttgccacaaaggctcagagactagcctatctcttgccccatccctggccctgcaattacttagagtttggtgtttgtgtttgtttgtttgtttgtttttgagacagagtctcgctctgttgcccaggctggagtgcaatggcgtgatctcagctcactgcaactttcgcctcccagattcaagcaattctccctgcctcagcctcccaagtagctgggatcacaggcattcgccaccatgcccagctaattttttgtatttttatagagacggggtttcagggtttcgccatgttggccaggctagtctcgaactcctgacctcaggcgatccgcctgcctcggcctcccaaagtgctgggattacaggcatgatagagtttagttcttaaagtacaggtgtctgcatcagacacacagtgttccccaatttgcattattcatgcatttctcttcctgttcttaactgcatgctcagatgcatgcattctggagttgggacatcctttaagtgccctgaaatgtttgtagatgtgtactacatcagtgctgaaatgtttgtagatgtgtactagatcagtgctgaaatgtttgtagatgtgtactagattaatcctgaaatgtttgtagatgtgtactagattaatcctgaaatgtttgtagatgtgtactagatcagtgctgaaatgtttgtagatgtgtactagatgtttgcagatatgctttgctaattgtgtcaagtgctattgagaggttgagtaagatgactactgagaactgacccttggaattagtcatttggcagggtaggggtgaggggacattagcctgattgcagagggttcaagaggcaatgggaggagacaaacgggagaaaacaagtatagatgtctttcaaggcatttggctacaaaggagagcagaaaaatgggaaagagctggagaagaaggggtaaagggagctctttgaggagtaacggcacacctttccctgtgaaacagatccctattcccacatcacatcaacactgatcaagtcctctttttttcaacttctatcacacccatagctgctctagagcctctccccttaatctcctaaacctacctcaacaccagcctgcactatctttattgccctctttctccatcaatttyttcgttatgtagaccaaatgagtacatttccracaaaacccagccgtctttagtaggagaaagaaggggtaaaattgagcaggcaatcacgggattttctttagagggagagattggggttgggattggtatgactctgaacactcccaaattaatacatttttgacccatcacccaggtctcttggaaactgagsttccagaagcgggagcctctgaagaatgtgtttttcatcttggcagaaagagctcgggaccccagtgctaaaaagcgtcacatggcaatgagaaacttgggaaccatggcctatgaagcccctgacaaggtagggaaggagaktggggctcagccagctccccaagcctctccaaccaccttggtgtggagactcccagggctggagtatggtgtctgttgtattagttatctatcaccccggaacaaaccaccgcacacttagcagcttacagcaacacgtgttgattatctcgggttttcgcgggtcaggagtccaggtgcagctcagctgggtcatctgcttaggatctcacgaggctgcaatcaagcgtctgccagactgcattccttcctgaagctcagggttcgcttacatcgttgttggcagaattcagttacttcccattgtgggacagaggtttctgtttttttgcctgctgtatgccgggggccactttcgatgcctacaggccactctgtcacagcaggcagctcacttcctccaggccagcaggagggtgtcgcctcctcctgtctgctaagatagagtcttatgggctgggccgtagtggttcacgcctgcagttccagcactttgggaggccaaggcgggtggaccacttgaagtcaggagttcaagactagcctggccaacatggtgaaaccccatttcttttatatttttgtaaaaatacaaaaaattgcccaggcatggtggcatgtgcctgcaatctcagctactcgggaggctgaggcttgagcagagatcacaccaggcactccagcctgagcgacagagcgagactccatttcaaaaaaaaaaaaaaagatagagtcttatgcaatgtaaagtcatgtccgtaggctggaagcgagtcacaggttccttctgcactcaaggggaggagactcattcagggtgtcactcattcagggtcatcttaggctcatgacacctcagcaatatcagctgtgagagacagagctgcaggaaggataaactcacagctgttacccttcctggtgaatttaagtgatttttttttctagtaatttaatgtttgtttcataaaagatgtttttcccacctcctcctttaccatccgccaacttcagtgtccattttgtctcctccccactataaaggtacctagttctccccaggccctgagatcacccaggtctgctgccctatttgaagagccccactgagcctcacccacccacatgccacactccagattgctctttctgttttccttcctaggctgagttgggctcttgggttgggttaatggaagcatttgtattttaatgagagttgtgcagatcttgaaaaaagccctggtgtgttagttcaagtcctaggttattagtagcttagatgtggggttgcttttcaacctatggggagcagttcctgtgctattactgcttttcaaaccttggtgacaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcrcccttcagaccaggactttattagatgangtaagtaaatcagaaaaattctgggttattgaaatcaaaatgggcttagaaatatgactgtggggcygggtgyggtggctcatgcctgtaatctcagcacttygggaggccgaggcgggtgggatcacgaggtcaggagatcgagaccatcctggccaacatggtgaaaccctatctttactaaaatacaaagaactagctgggcatggtggtgcacgcctgtagtcccagctagtcgggaggctgaggcaggagaatcgcttgaacttgggaggtggmggttgcagtgagccgagatcacgccactgcactccagcctggcaatagagcaagactccctctcaaataaaaaaagaaagaaagaaatgtgagctgcgggtggtttgttgctgtgggaacaaggtctctagtattcacttatttattaccacatcttgttgagagactagtactgtgctaggggttgggaggacatgtaaagatgtatagaattttatctctaaccctcaagggtttttttgtctgtttgagacagggtctcactctgtcacccaggctggagtgcaatggtgtgatctcggctcactgcaacctccaccttctgggctcaattgatcctcccacctcagcctcccaagtagctgggactataggcacatgccaccgcagctggctaatttttgtatttttggtaaagatgggttttcactatattgcccaggctagtctcaaactcctgggctcaaatgacccacctgccttggcctcccaaagtgttaggattacaggtgtaagccactgtgcctggtgagttttcatcttaacagagaagtgggtatatttacactgatgatgatgtacactgattgactaacatgtagtcaatgctgtcttataartgtggcaatagcaatgattagtgtctagtgagccctcactgtgtgccaggcacagtgctaggcaatttacatgaatcatctcatataatcttcccaataaccctgtgagatgggcactgtaattatcttcactttgtagacaaggaaaccaaagcacagaaaggttagaacttgcccaaattcacagagccaggaagtggacatgccaccagctcctctgactatagggctacactcaactaccagatgacaaatcaggctaagcaaaaagtgcaccggcacatcgttcagcccgaaactgagaagagtcagagaccctgactgcaagctaacaagttagcctgccagttattctgtccctgaaagacaagacctacagaacagcgaacagaccgtttatttactcccagagagatttgcatctccccacgccctaattctctccggagccacgtggcgagagccagatgtgtcagcaggacagaaggggagaagaggccttgaccttatgtaacttggagctcatatgggagctgggcacatgtgtctcacctgctccagagacacagagggatttttgctcttgaatgtaagccagtcctctctggggagggagcgggcgaaggtccctacttaccaccctgaagtgtaagcagatgtctccggggagatggctctaaatctcttggaggagccatctgaacttcgaggacttgtttgtcattcaaccacttttwtttttttttttgagacagggtctcgctgtattgcccaggctggagtacagtggcaggaacacagctcactgcagcctcaacctcccaggctcaactgatcctcccacctcagcctcctgagtggctgggaccacaagtgcatgccactgtgcctggctaattttcgtagtttttgtagagatagggtcttgttatgttgcccaggctggtctctgaccgggctcaagcgattctcctgtctcggcctcccaaagggctgggatttcaggcatgagacatgtgtctggccttcaaccatttttttaaaccctggttgcctggaatttttgagcagaaatccccggccatgtagaaacacagaaattcttatgcagagctgtttgctgatagtttacatctccattacagatagcactcttcactatctgaggccatgaagctcaccygtgcgtgtgttcccagttagatggttgtcagactcctagcggggcgagcatctgtcttacgtgtctgtacatcttaaagcattagggtatggctttgaatggggtacattctccattaaaattwgttaaacacacacacacacacacacacacactacacacacacayacacaaacactcactaatagagccatgaagataatacaaccctaagccaggcatggtggtgtgtgcctgtaatcccagctacttaggaggctgaggcatgagggtcayttgagcacaggagttggaggccagcctgggcaatgtagcaagatgttgtctctaaaacaaaaacaaaaacaaaaacaaaaaaaracaaaaaccctaagacaatttctgtatgcatcatgtgctaaattttttaaagatacttcacaatatgattagtgttcctcagtcttgctgggtctctgtgaccctcagttctttgtgcttcttccccgctgtgaaggcccaccccagccctcctccctctggtttacctggaggaggacttagactacaaaacactgatataaaaacccgtgcaccatgagtcaggtgtttaggttactatactggctctgttacctgacagtgtgattttgggcaagttccttaagtgccttgggccttggtctcctcacctggaaatgtratacttggaccaaacagctcaccttggaaagaaagagagggcggagtccactgaaatgcactcagggacaaaccaaccaatcagactggaagcagggagaggtgggagggtgttgggggaagaaacatgattattatatccactgcagataggagaaactcaaaccaaaagcaaagagaagagacttggcaaaaatgctggagtaataaacagggaactggttgaatgaattttggtgcagaaaagaaaaagagaaaaaagaaaagaaaaagaaaaatgaaaactcttttatgtattgatgtagaaagagctctcagactgatgaaaactcaaggtgcacaacaacagtggcatgtgcttccattatgtaaaaaagagggaaaggattatgtgatatacatctttcttctttattttttggagagatacacacaaaacataactttattagcttgtggggaggaaaatttggtggctgatggagaggagtaggaagtagacctacttttcctgtaaagctttttggttattttgaattttgggaagtttataaatgtattctatctccaaaacatgaaataacgaacaaaaaatctgggaaggtgggagtagcactagtgatttcccaggctagtcctctcgtctgctggagaagaggttcattgaagcctttgggccctcttcaagccacccccacccacccagctaagtgctttagaccagatctcaccacccaccctgtaatgtacagtcaagrtcgatggctgtgatgtgttctgattgacggctgtgatgtgttctgaccgatggctgtgatgtgttcagatgcagttgccttttggtaatgatctggctttcttattgttttgttgatggggaccgcaggagaacracagtctgagatactcggcctttgttttgtttgggcaattggctgcctttgcygggaggaaatggaaaaaatttttcaccagtcaggttaagcagacacgagattccctcctgatccatttacaggacagaaatccccaggttgccaaggtaagaccttgactctgcaaccaacagagtgacatctccatgctattcataaagggagttgcgagttgagacgccagaccctagggttcctgccagcactgctgtagatacttagcagcgtttctgtgtgcatccttgacaaggtgcctctttggtgtgtaatctctctttgagcaagagtgttggtttccatctgccccacctgcccaagcccagcacctgtcaatgcaagataagctcagggtaatggggttgagggcagagaggcacaggtttaatcaatggtgcagcagcccacataatgaggatatttattcatgcccacttagcttttgtcattgtgcctggtatagatttccacccatggcttcttttcttttctgttcttttctcttttctttccttccttccttctttccttccttcctttcttccttcgttctttcttyctttttttttttttgagacagttttgctcttgttgcccaggctggagtgcagtggtgtgatctcggctcactacaacttccgcctctggggttcaagcaattctcctgcctcaacctcctgagtagctgggattacaggtgcccaccaccacgccctgctaattttttgtattttaagtagagatgggatttcaccatgctggccaggctggtctcgaactcctgacctcaggtgatccacccacctcagcctcccaaggtgttgggattataggcgtgagccatcttgctgggctccacccatgacttattaatttcttctggtagttttgttttattcttggagaaaattgtatcccaacaaggttggatcaacttcaggcctgctttggagtgggacttggtgaacgtttcaaaacaattgggagcaaagctttctaccaaaccacttgccttctttaagttactgagagagagattaaatttaggaatccagtactacttttgatgggataataacaaaggctgtgctaaactgtaaagctacgcccttcccaccagtccccaaattatagacatggccattttataagcatacatcctttaagattcaaattttgaaactacctggaagttactttcacactttcagtgggcccctgaccacagattgggtgcaatcctctaggatacttttccttgcttgggattatggaactctctaataaataaaatagtaatattatttttctcaggcttgcaaaacaacatttcaagcctgttctccatatctgaaactaaaggagraatacagcttccagagtgaagaagatcaaaggaacactaagctctaccagcagctggtgagtgagccagggtaggagagaattmttttccggtccctgccctcctggtgkttaacacggaaggtggccaagcacaagaaagagttacccccttaaaatgactcaggccaactatgtttatttttttattttttctttttttctgagaagagcaagtgcagtggcaccatcttggctcactgcagccttcacctcccaagttcaagtgattctcgtgcctcagcttcttgagtagctgagattacaggcgtgcaccaccacacccggctaatttttgtatttttagtagagatggggtttcaccacgttgcccaggctggtcttgaactcctgatctcaagtgatctgcctgcctcagcctcccaaagtactgggattacaggcatgagtcagcatgcccggccaagccaactgtgttttgattgtaattgacccatcatacaatgtaaatggcaaaacgcctagaggatcaagcacgagatatatcggcagttccaattcaggtcactagctggatacagatgatgcctccacctctcctgcttatccacatgccctgcactgatcactgcctactagttacattgtcaaggaagtttgttgaatcctgccctcasgcgtacctttgctaatttctttcagagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttcatttcctccccatacaaatttgatgagcaggtacacactttctttaaaacattccaagtgtatatagattcagtgcttatttctcagctttttctttcttaagttcatctctgtcacctagcttttatttttaatactcaatttctgaggcttaggagaatacttgttaccttaagcgtttttttgttttttttttgttgttgttttgtttttttttagtgtatttgctattgatactttgctattgatacctttacttgccaagatttatttaaagttggccaagataccaagaaggtggcttgcaggggcatctttggcttctcataattttaaacagtcattgctttcaagatcatcctaaacaagaattaatagagagaaaaaaatctataaagcatgtgttgaaaatcctcaggctcatgataacttacgggataacaatagtaggtaacaccgagtgcttacaattcagtgggcacggtcaaagtgctttttgtaagttctatttaatacttgcgacaaccctgagatagtaagtattattattgttctcattttatagatgagaaagctaacacatagggaaattaggtaactttccccagrtaactcagtaaacagtggagctggaattcaaacatgtacggtctgacttcttgagcccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttattaattactttttggctattaatgtcaattattttggtgatcaatcctagttatccaaggagtcacatcactcgtaaaaattacaagaaaaatctctaagtccctctcaccctccctctaaccagattgcatcccaagcttctatagaaactctggtaccacccctgaattcagtatccaggccacacccggagcgttttgttcaagacaatttaaaacacgggggattataaaagctatagctggatcttaagtggcattctgagaatgaggaactcaattttctgctgtagctcccagggacagggtggtgtgacacagatgcggggatgaggagagacctaggcgagatgaggatgtgggagatggcagacagagtggcaagtgccaggcaggaatggattttcttccttcctgttctgaatctgaagaacatgacagcaagagattttaggagggacacaggctcacgagcaaatgggtggttctgagctgtaagccccctgcccctccctagcacccactccccggatgctggcctctttgaaattttgttgcaaggttggtttaaacttgatgcagttccattaagtgatcagtgagtggtctgagaaatggctgcatgtggctggcattcaaaaaggtggggatagggtgagatgggtggggttacgtgctctggagtagaaaaacctatgcagttaatgtccctctgtcggttaaaattgtggaagatgcggttggattatttgactttaagattcaatggtaggcttttattttggtggcccccaatgagtcatgcctcctgatactcatgtccttatttagtcccttctgtttgaatctgggctgcctttgtgacttgctttaatcaggagattgtgataaatggcactgtgccgggcatagaaaccctggcagtttcctcgtttgaattgtgggggaagccagctgccacataaggagttgaactaccaggaacaaatgagagtgcctgagatcaccatgtgaaggagaacggagacacccaacccacagcagagtctgaggcccggacacatgacacaagttgtcccttccagccagacccgagctgttgaagctactccagctgacaccatacggaaaagagacgagcgtctccatcaagcctgtgtcagttgcagaagcatgaacaaagaatcaaatgattgttgttttaagtcattaacctttgggataatttgtcacactgcaataagtaaccagagaagattccttattattaactgttgtcttggctaattttgttttgctcttcataagtcctctttgagtttaaattctatttccagaaatttatgttatcatgaaatttggtggcaagagcaagggactatgtttttttgtttgtttgtttctgtttctcaccatacctaccacagagcctggccatgtgattaaggaacatttgctgaatgactaaatgattccaaattgtagagggaataaagtccaatgtccagtctgccatttcaggctttcaaccttcgttttcttctgttactctctttgcttcagacaagtttgggtcctttctcttctctcaacatgtcttgttctcctataccccctcacctttgctcagtctgctatttctgtgttgagtcccctccctgctcacctgtacacacccacctggaatcacatgcacacacacacacacacatttcacgtgtatctcttatctgtactccaatgcctaggtcaaagtcctgatccccccaatcaggggagagctcaagtctctgaattcccagaacattctagcaatattataccacttatatcttatctgaaaagtttttttttgtatatggctttatgtttttttttttatcctgttagattgaaactacagaaggcagggctgtatcttgtacatcattgtatctccccggtgactgcaaaagtactctgtaaatgaatgttgattagggggaaaaatgtcagaaagtcatctgaagctgtcattccttactgggaggagcccattttgacaaatgagggtcaccaatttcattccttataaccaatgtacaggttacttttatgcttgtgcatttcaagtttccccttccccacgtttatctgaatgccaacccaaaggtaatgttttgacatttcttaattttgaacattaattttgaaccttattgagcagttgaatgaaagaaagaaaaaaggaatgttcaagtgccccraccctcatgctaagtgcccagggtagagctttgcttggtccctgtgtctctggtgctcatgagataggtctttctttctttatttttatttttgagatggagcctcactctgtcacccaggctggagtgcaatgacacgatctcggctcactgcaacctccacctcctgggttcaagcgattctcctgtctcagcctcctgagtagctgggattacaggtgcctgccaccatggctggctaatttttgtgtttttagtagagacggggtttcaccatgttggccaggctggtctcaaactcctgacctcaagtgatctgctcaccttggtctcccaaagtgctgggattacaggcgtgagccaccgctcctggctgagataggtctttcttaaaggggagagggaagtggtggagagagaggagagaaaatgacaaaggaggaggctgagaatctaacaggtgtgaccaattctgctactgaatgagagcagaagcctgtgaacttccagttaatagaccacttaattgggggaacgcttcacacgttataaaaaagcactagaatgttttgaaagcgagaaacaacagctgtgtagggtagctagcagttagtgttgtacagaagacagatatttgtgcatttctgcattttctaagtttgctgcaatgagcatgtattactttcatagttataaaacacatgcaaaatgcccttttaaaatgaaaaaaaagtccatgagtgtaagtgatatatatgctttggaaagcctgggacggtcattgtttactctcaatagtatgtgtttgcctttgtctttttgagacattttgttttaatctgttgatgacaataacctgttgataatataacttgataacaaataaaatgacttatgattgattatcattttatttatgtgactgaacttacattaattttgtctgaccacagtagagtaaatattttgttcctttatttacatgttaaatggtttcaggaaaaccctgggttctagataaagccaacacatcctaatttactgaggagggatgatttgatatgcaaaggcacctattatttaccaagttaagcacttgggagttaaggctcccaagccagacttctaagattccttataataaacaccaacctagaatttcccatgatgcttcctcgattcctactgtctggaatactttccagttccttggttctatcagccattccctggactgactccaaatgccctcttcttcagaggtagagcagagctgctggaagaatgcagcctggctctgccatttagccaagtgtgggcaagtcagcgcaccaagcctcagtgtgctgatatgtgaaatggagacaataacccaatgtatagaattgctgggctgcaaagattcaattaagtcacactgagcacttggcagagtgcttggtacatagaaggtgctcaggaaatgttatttttgttcctcattcctaacaaactctccagacattatttcttctcttcttgaagctgcccaggtcttcagacaggtccattggtaatttgagcattaccctgatccaccagtcctggaggtagcctccgtatcctttattagttctccaagaatgtggctttgagccttgcctgacatgggtgttcagtaaagattggttgaattcttcgagttgcaaatgctggcattttgaccaagtaggaatctgtcacctgataggttttggaattttaatacagataagaatcatagcaatgagaatagcaagtggttctttcccactcggccctttggggtgctgtgattgctcagagcgggagcagtgcatttttatgctctagagatggtttcaataggccctgttcattccatcctaatattcccaacagctctgttaagaattctgtattgtatcttttaagcaagctcttgttaataattaacaccccaccttctttttccaagggtgatgctattaatcatgttcctttcaagcagatgaatttcctacagcagtttgcaaatgttaaccaggtaatggcccaaatgtctcccgcaagaaggaaatgtttttcagaaatgcggatcagagagttaaaaatgtcatttcctaagcgacactgctagaggcacatgcctctgccacagcaaaaatgcaatcagaaatccaaagcttttcaacctgcctgcctgactgcatcagcagatataaccagccgctggaagaggagagaagctcaattctcaaatgtgacatcatgcgggctgaaaggacactacatttggtatcagaagacccggcttcatagtctgactctatcatttactagctggttatcttgagcaagtcacataacctctcagagccttggggtcttcatttgtcaagtggaggtaaaacccacagcacaagttactctgatgatcagatgagacagtccatgtaaactgtggaccattactcccaaatggagtgttcctgtttacatggtagccactcatgattggagcctatttatacaaggtggaggatggagggaatgaaataagatgttaacacagatctcaatttatttatttatttgagatagagtctcactctgctgcccaggctggagttcagtggcgctatctcggctcaccgcaaactccgcctccgaggtccaagcaattcgccttcctcagcctcccaagtggctgggattacaggcacatgccaccacgcctgctaatttttgtatttttagtagagacggggtgttggccaggctggtcttgaactcctgacctcaagcgatccgcccatcttggcctcccaaagtactaggattacaggcgtgagccactgtgcccagcgtacttgtggccaggtgccacagattttaatttaaaataaataataaaataaataaataataaacaataaaataacataaataaatagtataaataaaaataaataaaaaataaaagcaccaagtaatcactatgcataaatatcttaaaaatataaatgcaataagattaggtagatacattgttttacataaggctgtttgttccagatactaagtacccattacatgtcaaataggattcagtttacaagtttaatacctatctattttgtacaatttagttatatccaaattttttggtatgatagaaagaataacattcagaagttgtggaaaacctgactcttttcctttaagttactctaatagtaagatcaagtttaagtagcctgggcgtggtggcttacacctgtaatcccagcactttgggaggccgaggcgggcagatcacgaggtcaagagatggagatcatcctggccaacatggggaaaccctgtctctactaaaaatacaaaaattagctgggcgtggtggcacatgcctgtagtcccagctacttgggaggttgagccaggagaatggcatgaacctgggaggcggagcttgcagtgagctgagatcgcaccactgcactccagtctggtgacagagtgagactccgtctcaaaaaaaaaaaaaaaaaaaaaaaagtttaagtcaaaaactaattaaactccattagggaaaaatgaaaattttatatgtttggatttaaatctactagagtgacagttgatttactagcttccaacaagcctgagaagaggaagcccaggaatgtgagattttctgacgagtaagatctacacactgtgcagagtggtggattaaattaattcaaagctagtgagctcattttacaacttaaaggaacaaattcaatttcctaaataaaaattttatgacttaagggaacaaac

SEQ ID NO: 10567 - DNA, 60230 bp, Homo sapiens
gcaacaaacatgggagtgcagatgatctcttccatatactgacttcctttcttttgggtatagatctagtagtgggattgctgggtcatatggtagatctatatttagttttttgaggaacctcccaactgttctccatagtggttgtactaattcacattcccaccaacagcgtaaaagggttcctttttctccacatcctcgctggcatttgttattgcctgtcttttggataaaagccatgctcactggggtgggatgatacctcattgtagttttgatttgcatttctctgatgatcaatgatgttgagcaattttcatatacctgtttgccatttgtatgccatcttcttttgagaaacgtctattcaaatctttttgcatgttttaaaatcaaattattagattttgttctatatagttgtcttagcttcttatatattctggttgttaatccctcatcagatggatagtttgcaaatattttctcccattctgtgggttgtcttttcactttgttgattgtttgctttgctgtgcaagagctttttaacttgatgtgatctcatttgtccatttttgctttggttgcctgtgcttgttgggtattactcaagaaattttgcccagaccgaagtcctggagagttyccccaatgttttattgctgtggtttcatagtttaaagtcttagattcaagtctttaattcatttaaatttgatttttgtatatggcaaaagayaggggtctagtttcattcttctgcatatggatatccagttttcccatcaccatttattggactatcttttcccctgtgtatgttcttggcacctttgtcaaaaatgagttcactgtaggtgtgcagatttgtttctgggttctctattctgttccattgttctatgtatttgtttttatgtcagtaacatgctgttttggttactatagctctgtagtataatttgaagtcaggtaatgtgattactccagtttggttctttttgtttaggatagttttgactattctgggtcttttgtggttccacataaattttaggattgttttttctatttccgtgaagaatgtcaatgatattttgatagggattgcactgaatctgtatattgctttgggagtatctttccattatttggtgtcctcttcaatttctttcactttatattttatagttttcattatagagatcttgtatttctttggttaaattagttcttagatatttaattttatttttagctattttaaatgggattatttttaaatttctttttcagattgttcactgttggcatatagaaatgctactgattttcatatgttgattttgtatcctgcaatcttattgaatttgtttatcagttctaatagttttgtggtggagtctttaggttttcccaaatataagattatatcatcgacaaacaaggataatttgacttcttcctttccaatttggatgcgctgtatttctttctgttgcctgattgctctagctaggacttccagtactacgttgaataacagtggcgaaagtgggcatccttgttgtgttccagatcttagaggaaaggctttcagttttttcccattccatatgatactagctgtgggtctgttatatatggcttttattatgttgaggtatgttccttctatacctggttttttgagggtttttaatcgtgagtggaagttgacttttatcaaatgcattttcaatatcgattgaaatgaccatatggtttttgtccttcattctgttgatgtgatgtatgtgatgtgatgtatcacaacagaatggattgatttgcatatgttgaactatccttgcatcccagagataaatcccacctagtcatgatgaatgatctttttaatgtattgttgaattcagtttgctagtattttgttaagaagttttgcatccatattcatcagagatattggcctgtagttttcttttttagatgtgtctttgtctggttttggtattggagtaatactggcctcatagaatgagtttggaagtattccctcctccctattttttggaataacagcactattttatatgacgcatgttaattctatgtaccagacacagtgcaaagcactttacattcattaacttatttattcttccccatgacgaatcttacccatcttttacaaaagacgattctgaagctcagaaaagtgaacctccctgaggtcacacacagtatgactacaaaccatagaggtgtgtgtgtgtatgtgtgtgtgcacattgttggttgcatatggaactgctataccacatcagtagagaggagttttggaagaacatgcctgtgaacaaggatataaagtatgttgagaggcccaatggatagaccgtaattgcacctttttgttgttgtggtggtggtggtggttgttgttgttttgagacagagtctcactctgtcacccaggctggagtgtagtggtgtgatctctgctcactgcaacctccacctcccaggttcaagtgattctcctgcctcaacctcccagtagccgggattacaggtgtgcgccaccatgcctggttatttttttgcatttttagtagagacaaggttttgccatgttgccccggctggtctcaaactcctgagctcaggcaatctgcccacctcggcctcccaaagtgctgggattacaggcatgagccactgtgcccaggctgtaattgcacttgtttatggacaatttcatattcatttcttctccttcttatgcaatttaatttccttttgggtgaccaactattcctgatatgtgtaggtgcagtcttagtgaggccctgggcacatgacgcaattagaatttctctataaaggttttattttgtttgtttgttttttagagatggggtctcactctgtctcccaggttggagtgcaatggtgcaatcatagctcactgcagccttgaactcctgggctcaagtgatcctcccaccttggcctcctaagtagctgggactacaggagcatgccaccatgcctggctcttttaaggttctgagtccatcagtgaggaacacaagggcagagagaatggttaggatttatgcaggtagcatagcaaagtggttaataacataacttacggaattggatagctgtgtccaattctgaaatccacagtttactagctatctgacattgggcaggctacataccctctctgtgccttagtttttcatttgtaaagtgaggacaataatagaatctacttcataactgttatatacttagaaaactacctgacacatataaagttctactttggtgtgtttgtttgtcttaatgtaattccatgtgttcaaacgtttccaactctttccgataacgagaccccccagagcatcctacttactccagtgctttccagaggataggccccagccttcgcattgattctctgactgccaatccattcttttctgcttaattaactcagaatccgcttctgttgcctgcaaccccagaacgctggctgtcatgtcaattctgtctcatggcaacctgggactctaaaaccttcaagctgtgaccccacaactctcagtggaattctgtactgaacatcaagtctgttctctcctaaattcacatctggagtcatgatactaaaaccatccagaccatctcctgtagagagagtttacttgattgctgggctgtggaaatattgcaggggattattagtcccaaattagtgataagcaagtgaaggtcggggatgtgaaggaacttatcaaaagttgggataggatggctcctaattcaggttttctctgctaaaagactgattaacctatgtggggtgggagatgggctgtgaataaggcttgggtctgaactctaacccttacaactacactcgtctttttcagttcttcacttactccccagctcctttaagcttaatattgcctcagagcctttgcatatgcggttctctctgcttagaacttggttcctctgcgtctccccatctccactcttctaattcctcccctttcagatctaggctttcagacccaggcttcctagaccaccagctataagttgatccctctactgttcccaatgtcaacatttgtttgtttccttcttagcagttaccacagttattatttttttatttttcctgtttatctgctccttgcctgtctcccccactagactgtacattacttgagggccgggactctcaagtaatgtatagtctagtgggggagacaggctgactcagtgcacagtgtttgataaataaatggacaaaaccctgagccatctaaccaggaataactttggtcactgttttagtctgggctgctataacaacataccttagactgaggggcttatacacaacagaaattctcttctcacagttctggaggctgggaagccctagatcaaggcacaagcaagttgggtgtttggtaagagccttctttctggaccttatgtttctgggcctttctggttcatagacagccccttctcgctgtgtccttccatggtggaaggggcaaggcagctagctctctggggcctcttgggcactaagctgggcatggtggctcacgcctgtaatcccagcactttaggagggtgaggtgggcagatcacctgaggtcaggagttcgagaccagcctggccaacatggcgaaatgcagtctctactaaaaatacaaaaattggccaggtgtggtggcgggtgcctaaaatcccagctgctcgggaggctgaggcaggaaaattgcttgaacctgggaggtagaggttgcagtgagctgagatcatgccactgcactccagcttgggtgggcaacagagtgagactccatctcaaatatatatgtgtgtgcgtgtgtgtgtatatatatgtatatatgtgtgtatatatatgtgtgtgtatatatatgtgtgtgtatatatgcctatacatattagtgcctatatatgtatatatataggtgtatatatgtatatatataggtgtatatatgtatatatataggtatatatatgtaggtgtatatatatatatagagagaggcactaatcccattcgtgagggctctgtcctctcatgacccaatcactttccaaaggccccacctcctaatgccatcatactgaggattaggtctggacatacgaatttgggaggggacacacacatatagaccctagcggtcatctagtttcttagtctcactccaaagctgaggctcagtaggaaataccgacttggccaaggtcattatctgagagtcaagaacagaactcgcacacagccatcatcacctcaaagccttgaattaggccgtcatgatggggcataatgtgggagaattcaagggcgctgggacagatgcttactcctcatcaccaaatctaagcagcaggcactatcatcatcatcatcatcatcatcatcatcatcatcatcatcctcctcccaccccattttacagatgaagaaatcgaagcttaagagagtctgtgactccctgggaagtgtaggaggaggagactcgaacttgggcctgccagcgaggtccgcgggcgcttaacccggctgctgcggctcgaggcctcgctctgcgggtctgtacaatggggctgtccgggccgggtgcgccgtgggaagagcgaggagcggggaggaaaacttggcggggcggactcgggttcctcgggttccagctggctgctgagggggtggacggagggaagggggggcggtgggggcggggcgcgcgggctgggcacaaagggctcaggcacaaaggggccgctgtcccgccgcgccccgccccgccccgcctctgctgccgccccccgtctggtggcccgacccgcgccgcccgcggctcccttatgtctctcgccgtctccagcctcagtccctctctgtctctctctcagtctctctccctgtcctccccggccgctcctccgagatgacgccggggtcggtgccccgggcctgccctctcccctggctccagggctaggcgggaccgagggctgccccagacagacggacccgcggacccacagaccccgcgcccaggagaggagccgcgccgcccgccgctggcagcccgtcaccatggtaacgcgccaaggcctggaccacctcgctctgccccctttcagtgggcacagccctccccattccctgcagaacagccccgggtggccctggccttttacactgagacgaccctcagtgccttggcagggttgtgcttacctgcttccaccccagcaggggttcaagggcaggagcccatctctggccgcgtcctctcctggcttctccatgtgtgtgtatggatggagtaagattgtacttgtaaactttaatattccccaacccctagacctgagcctgaatctcagccctgaggctgagggctgaaacggggtggttttgcatgtttgttttggaactgactgtgatatgcacattgtcccggcagggagtttggatggggaagagtggtggtgggggttaaagtcccctcccaggccagccaggcagtgcagggcgaggagggttaagggtccagggtgaaaaggagagaactgcttaccaaaacttgggatgcttttgctgttttagactcagctatggaaagtcagatatacacattgaaacccagggtgcttccatgggaattggctggggagagggaagaggaagggacttttggagctggaaccttgaaaaaagttgagacattctgggagaatgtgtgtgtgtgtgtgtgtgtgtgtgtgtgtggtggtggtggtggcagggatgcgtttgtgccagtatctggcaacagggaatgaaagaaaagtctgttttcggaggatttcagcccagctccagacagatacaagagccccaggcagattcacaggggctgtaaggatttkgaaaaaagctgtgaagacaggccaaggctttaacccygtgactgtgaccaaccatgttgaatttgtgtgggttttcactcacagcaaatgcatctccacaagcagaagaattccatatagaggtgttcatactctctctctctctctctcacacacacacrcacacacacgcaggcactcacacacacgtacacatgcacacacacgtacacatgcacacacacatacacatgcacgcacagagcacacctgaatgctcccactgactcacacagctgaacacatgttcacaccctctcatacacccatgccttctgcacctgctcccccatactgctaaactatgggcatacattggcatacacaccacagacatattgcaaaaccgggcacctacatccatgcactgcggggacaggtgtacacacacatggctcttggagctgtttgaaaatactctcataagccagtggttattcacctctccctacaggcaaggccctgtgctaggtgatttacatccaggagtcagtaactcataccaactctaagattagacctgcggctatctccaacagatggggacctcaggctctgggaacttaagtagctgcccaaggtcaccccamccagaaagtgcaagttaggacagtctgaattctgagcctgcactcggcggtcatggtcactccagggccacagcgtgcacctggtgtttgccaagcctctcctgctttcacacctaacctagtcattagaaacccctcaytgaaccccagatcctcagatcaagggtcaggcactggtctgccccctgtcaaagggtgagcaactctttccagattgggaacaatgtgcagatttccttcccttgcctgttttttaaagaataaaggttgttgccagcctacctccctggcctcacttctgtgctccagccactccagccttgcttgcgagcctcttatggttcacgctccctgctgccccagggcctttgcacatgctgttcctgcttggaggaataccttcacctaatgaattcttatttacccggtaaatcttcacccaaatgtcacctcttcaggaaagccttccctgatttccctgactcttactctagcatgtcatgtatctttcctttatgataacccatcatagctgtaatttttgtggggcatttgattaacagctgtctagtgtttgggggcacccccatgtcagagaatcttatggcaaaggggcttagggttgatcctgtcccatggttcccaaatgttagtatcactgaaacaacttttacacatccacttactggataaaatatataagaaaatgataaaatctactacttattatttgctcaatatttttctttaaatcaacttactttgtacactgaaaaatatatttaaatagaaaattttatatcacaaccatgaaaaaatcagtatccattgtcataaatagaaagtaactaagccgggcgcagtggctcacgcctgtaatctcagcactttgggaggccgaggctggcggatcaccagaggtcaggagttcaagacctgcctggccaacatggtgaaaccccgtctctactgaaaacagaaaaaactagccgggcatggtggcaggtgcctgtaatcccagctactcgggaggctgaggcaggagaatcacttgaaycccggaggcggaggttgcagtgagccgagatcgcaccattgcactccagcctggaggacaagagcgagactttgtctcaaaaaaaaaaaaaaaagtaactataaaaatatgtactcaatgaaggcaaatctgtgttagtaaattctggctggatgaggttggtggtgaacaatttcaagcccgaggactgttttcttttgttaaacagagtgatgagtaagtgcctgagaggtcttcgagatagactggctccagactgaggtattgtccttggtgtcatcgtgaggaatggaagagaactggagtaactttctcgctgtgatttcacatcaatctatgttctcccaaaattgttttgtgggccacctgtgagaaaaactggtcacgttcaggttttttttttttttttttttttagatggagtctcgctctattgcccaggctgtagtgcagtgggactgtcttggctcactgcaayctctgcctcccaggtttaagcaattctcatgcctcagcctcctgcgtagctgggactataggtgtgtgacactaggcccagctaatttttgcatttttagtagagatggggttttaccatgttggccagtctggtctcaaactcctgacctcaagtgatcctcccacctcaacctcccaaagtgctcggtttacaggcatgagccaccaccctagccaagttcagtttaatccattcaacattgcccacatacctgctgcatggcagtaccccaccccagttccctactgtgtgccaggccctctataaggacgtggttcctgctttgggggctggcagtccatggagaaggcaggttcatccacagataattctaggctgtgtctgatgggtggtgggggtccatccttctgcctggaagcacatgtgtcctgaaaagcaaagagaagagaagcaagtctggaagggctctgaagggtgggcaggaggttgctcagtccagggagtggggcagtggaagcagagacacagatgtgtgtccaggcagcactttccaagatgtggcatccaccaaaggttccaggaggggagattttagatggcacttagatgaacaatttttagtttacagcttttcatcttaatgagtattaggaaggaatttaaacagcacaaacacataataataaatataaataattttttgttttgagacagggtctcgctccatcacctgggctggatggagtacagtggtatgatcatagctcactgcagcctctatctcccaggctcaagcaatcctcccacctcagcctcccaagcagctaggactacaggtgcgtgctaccatgctcagctaactttttattttttgtagagatagggcctccctctgttgcctaggctggtcttgaactcctgggctcaagcgattctcctgccttggcctcccaaaagtgctgggattataggcatgagtcgccacacccagccaaaaaatagatttaagttgaaaaagaattgacaaaaagtcaaacgttaagtaaataataattaataaaaaagagtaagccaataacaaattagaatatgtgaacatggcagaaagaacctcatgaaaggggcccatgatgattggaaagccttgggctacagcataaagtatgtttagaagaagtagggaaggtaagctgggagctgactgacgggccacagcaccagaccagtgagttgctaaggcaatagggagccacccgaggttgttgagcagtggagggtcacagttggatctctgtgttaggaagcccactatgatgrctaagaggagcctggcgtggtagcagggagcccggggaaagagacaggacagctggtggttatgtgcccagggtcataccccagtgctaccatttagtagcagtagagccttgagctcagtttcttaacttgtaaaatgggaataaaaatacccagcccatagaattattgagataaaatagttaatgaaaaatgcttagcaggggcctaacacacaagacagtaggaagcagctctggttacaattgtgatcatgatgtggtttgggtgggagatggtgagcccaaggcagaggaaaaggggagagggagagaaaggaacaaatacaaaactaaggctcagtgaggggcagggggtcgaggtcatgcagatgatacagacagagctggactataacgtgggtcttctgacagccacttgcttctcggctcactgcatcagggctgttttcccagtttctgaaagtttttttatacgagccaatactcactcatacctccacccacacaaaaataaaaaggacttaaagcagaagttttagttggaagtgagcaagaacttcctggcagccagagccacagaatgctggttctagaatctccagcctggagaagttcaggacgagtgtcccaggtcattgagactggaaattacaacctgacacccgctgggccgtatctggctcacagatgtgtttggcttggccaactttttcaaaattgggaggttttactgaaaaatcagtagatcaggtggtgctgggccaaagcaacactcagctgatgctgatgagagggggtgtgtgccccaagcccctctattccccattgcttccctggtgctgaggctgactatctccaaagggtggaagtgagtgctttctcacactcagccagtgtctgtcttcatgttacctgtcaggcccctggaagcacttatttatacctgtggctgttggtttagactgactctccctaggcctgaggcaggaagatggaagagacagattttttttttttttgagacagatctcactctgtcacccaggctggggtgcagtggcccaatctctgctcactgcagcttctgcctcccagtttcaagcaattctcctgcctcggccttctgagtagctgtgattttcagcacccgccaccacacccggctagtttttgtatttttagtagagacagggttgcactatgttggccaggctggtctcgaactcctgacatcaggtgatctgcctgcctcagcctcccaaagtactgggattacaggcatgagccaccgtgcccagccaagacagatctttttaaaccttctcaccaactgaggattaactgatcccattcagaaaccacatcccagctccaaaccttcctgaaatagattatacttttttttttttttggagttggggactcgctctgcccaggctggagtacagtggtgtgatcatagtttactgcagtctccacctcctgggcttaagcgatccttctgtctcagtgcctaaagtaactgggactaccatgagctaccatgcctggctaagttttcctattttttatagagacaggctgtcactatgttggccaggctagtctcgaacttctggccccaagagatcctcctgtctcagcctcccaaagtgctgggattataggcatgagccactgcacccggcccctgattatactttgaattctagaatgcccctactggaagggcccttggagatagatatgcttagtgcctcccttttataggtggggaaactgaggccaggatcacccagagagtcaggggcataatctcaccctccctaggcattttttttttccccaaggaacagggcagagcttgaaggtagccctaggactctgtccattttggcttttctcagtcctctcttcccaagtaaggaggcggcagatgctaagtgatactaaaatctttgcccgttgcagtaaatggataaatctggacctttaagaaaagctcagtccagctgggtgcagtggctcatgactgtaatcccagcactttgggaggccaaggtgggtggatcacctgaggtcaggagttttagaccagcctggccaacatgatgaaaccctgtctctactaaaaatacaaaaaattagctgggcgtgttggcaggtgcccgtaatcccagctacctgggaggctgaggcaggagaatcgcttgaacccaggaggcagaggttgcagtgagtcgagatggcaccattgcactccagcctgggcaacaagagcaaaactctttcttgaaaagaaaagaaaagaaaagcttaatccacatctcagaaagtccagctaacaacatctggtgagaccatttacaaagggaaccagmcttaaaaacacatactctcacacttttattttttcccctcctaattataaaagctatacaagctggttacggaatgtttggaaaatccgggaaactatgaagaaaattaaaaggctgccttacgaggcccctgccccgcacagccctcaggggtaactgcagttaacactttacttaatgtccacttggagttttttctaggcttacatggttttattcatactatagatcatacggtatgacactgttttctttaaaaaaaattccaatagtcaggggtgggagagttggctggcaaggggcctctttctggagtggtggaggtcttttgtctcttgatctgggtaagtggttacagggttcatacataggtaaaaaggcatcatcctatgccttttatatttgtttattttacttgataaaaatggtatttaagattataataatagcagctcattgcaaagacattgaaatggaagtatacgcacgcccctactcccctgcccaggttataaccgctgtgagcaagtagtccctcctaacctgcaagcttccctgggtcagtccagaaggtcgtgagcatggtataggagccagcagtgcgggcctggttctgcctgtccccttgatgagctccttctctgaccttgggctgcaggggagggggctgtggctcgtctcaccttcttccttttcagcctcacacccgctggctcctgcctgggaacagcctggctcctgcctggcvgggctgcgggctgtgttcactggkaaggaatggaaacacatctattaagtttcatggaaatcatgctgaggggcccacgtctggtgtttgggttcctgtggtcccaggctgggctgccgggtggattgggaatgagagtggctagcgttccttcctgcagccgcctgggcacccccacacccaccacagtgtgcttcctccaatacttggatggcttatgagcccctggggttcaggcctgtagtgggtaatgtgctggccaagagctcggagctctgttaactcggaacatacttcctttttactggctgccccttaaatggtaacagtgtgtggcaaaccaagccaatttgtgaaagctaagggtgtcccggtctctgagccttgctctgtgagaggtaaacagtttcttcaggctctactagaaactgggaaggacaggcagctgggatcgtcagtccccacagctggtggtccccaggcagagggggcggcaggaaacaggggaagatctgggcagacttggcaggccccaatctggattggatcctggctctgtctttctcttctgtgcggtcttgggcaagatcagcctcggtttcttgacttgcaaaacgggtcattcctacttggctcctggcatcgttgtgtgggctaagcaagagaatgcaagtaggggacctgggcacagtagccgcctggagactgttgttatcattggggtgacagtagtggacacagggagggaccaggagatgggggatgcttcacacagaggctgggacttaagcttgggctgacaggatgagtgaaaataagtaagaatgaatagcaataacagcagcggccatgcctttgactttccccaagaccctgtacatccattaattagctccttgtgtgtctagaacaatcatctgagtgaggtaggataggaatcagaatcccatctatgtgcagaaggggaaactgaggcacatcagggaaagatagtttaactcactgtttccctgaggttaggatgcagaccacagtgatgacatagacaactggcaaggggcctctctctggagtatggagctcttttgtctcttgatctgggtaagtggttacaggggctcatacataggttaaaaaggcatcaacctgtgccctttaaatttgtttattttacttgacgaaaatgatacttaagattataatggggccaggcacagtgtctcatgcctgtaatctcagcacttcaggaggccgaggagggcggatcacctgaggtcaggagttcaagaccagcttggccaacatggtgaaactgcatctctactaaaactacaaaaattagctgggcgcggtggtgggtgcctataatcccagctacatgggaggctgaggcagaagaatcacttgagcccgggaggcggaggttgcagtgagccaagattgcatcactgtactccagcctgggtgacaaagtgagactctgtctcaaaaaaaaaaaaaaagactataatagcagtggctcattgcaaagacattgaaatagaagtatacacatccccccacccccactccattgcccaggtataaccactgtgagcaggtagttttctatgtccctctgcactacaaggttccctgggtcagtccagaaggtcatgagcatagtataggggccaggaatgcgggcctggttagacacaaggtatgtcacagactggaactaaatgacatggaaccatgtgatggacaatcagtccctttcaaattccctgagcttctccagacctaaggagaaagacttcctctggggataagatgtctttaacatctctctgatgcatttgggagaaagagagggagaagacccccttaggctccaagaggtgaccagatgtccctagaatttaatggtactattcgttttcattgtttatttttattttttaaagtagtttattttcacagaaatacaaacagtaaacaaaaaatatactttatataagtaatatatttaaatatattttaataaatgaaataatacaaaaaccatccaatgcatcatcagtttatttttggagttacattcgatttatgccagtttacagttatttytccatttatagtgatgatgtaataacagttataatattgccacagatccacccaaacatggtgattcctaccttcttcttcttgcccttgcccccacatgtgcctggtaacatggccgcccccacatatccccacctgtgtagaacatcatggcgccctgcatttgcatattaaaaagctagggtagtagggccagttttttcgtgggctacatgagtgacatgcctggtcaaaccaatcccttgagccctatgcaaatcagacaccatctcctccaacctcctcgtagaagcagccacttttctgcagcacacggggttttctctttgttagaatcctcctccctctgtctccatacaggggaactgttttcttcttccttctttctttcttgcctattaaactttctgctccttaaaaccacacacacacacacacacacacacasacasrcacacacacacacacacaccataataataataataataataatatgaccacagaaattgtagtgatggctcttacttaatgagcacctactaaattctagtcctgtgcagagaattygcatgtattacctcaatacacccaatcttgatcaactccttaaggtgggtgtaattacagtctccattttacagatgaggaaactgaggcacaacgagttaaatctgacttgccaggtacacacaaccagtaagtgacagaaccagagtttgaacccgggcagtctggctgcacttgcataaccactgtgatgatacagagtctcattgaaaaacacaattatgtaagttttgaaaaagtgagtggatttgaagaaaaatagtaagtgctaatagtatgcatggtatgaggagatgctaaacatcataaaagtcatcatgaatgattaaatttccaaaaccaaaacaaatcaagcttagcccagctcaatatgctttctttacacaaggaaagaggcccagagagggaaaggacctactcaaggctgcacagagaggctggagccaacgtctcaacagagaggccagagcccaagtctcaggagagaggagggagggagtggggagggcacctggcaggggaagggactgctcccaggattgcatggggtgggaaatgtcagagtttgaccatgattggtgggggttggggggggattagaagaggacaccgggccagatgagaccttccctgttctgccaagttgaaggcccctccctccacctcagtgtaaaacctcctgggtacatgtgatttcagcaccagatgcctgtcggtccatcatcctctctgagctcactgccacggcagtgcccggaccctgtttccatcacaatgggctgtggacactcattcattcactcattcattctacaaatagtgatggcggtcccctgcgcccagcactgtgtgggctacgggtgggagggagcctcagtcctctgtaaaagcctcctggcattggaatcttgctggcattgagaaatgccaccctcctcctcctcagagttcctaytgtatttctctttcttcaggggcctcatttactaaaatgatttttccctccttaagtaagctccctttgagtggggtccttatttattctyatctccctttgcccccctgggcaacaggtggacctggagcttgcaaccaggctggggcaaccagaagggcccccgtgaggctcatgacctatgggtcctaagaccatacctgggtggaaacctctggcctagtccaacttgtctatttgacagaaaaatggtggttctgaccaggcgtggtggttcatgcctctaatcccagcattttgggaaggcgagacgggtggctagcttgagctcaggagttcaagaccagcctgggcaacatggtgaaaccccatctctaccaaaaatacaaaaattagctaggcatggtggtgggtgcctgtggtccacagctactcgggaggctgaggtggaaggattgctggagcccaggaagtcaagactgcagtgagccgagatagcaccactgcactccagtctgggcaacagagcaagatcttgtctttaaaaacaaacaaacaaacaaacaaacaaaaaggccaagcacggtggctcatccctgtaattccagctactcgggctgaggcaggagaatcgcttcaacccagraggcggaggctgcagcaagcagagatcggaacactgcactccagcctgggcaacagagcaagactctgtctcaaaaataataataataataataataataataataaagagaagacaagaaaaggaaaagaaaaattgtgattcagagagggacattttgtttcttctgccataaaatttatgaagcacctgtttgtgcctggtcctgtgcagacaccgaggccccaaagaggaaaagaagccagtgcttactgtacctgcctcctgttgccacygtagcaaatgatcatgcactttagtttcaagctacacaagtatagtaycttgcaggtaataaaagatcagaggcctgacatgcatttcactgggccaaaaacaaagtcttggcagggctatttctcttctggaggctctaggggagaatccatttgcttgccttctccagcttctaggagacgcccgcattccttggctcccgctctatgttccaagccagcaacatcacatctctctgatcctgcttccgttgtcatatttccgctatttatttattattttattttatttattattgctctgtcgcctaggctggagtgcagtggcgccatcttggctcactgaaacctccatctcccaggttcaagcaattctcatgccttggcctcccgagtagctgggattacaggcatgcatcaccacacckggctacttttttgtatttttagtaaagatggggttttgctatgttggccaggctggccttgaactcctgacctcaagggatccacccacctcagcctcccaaagtgctgggatacaggcatgagccaccacacccagcctatttacgatttttaatgtaataagagatgggatctcactatgttgcccaggctggtctcaaattcctagcctcaggcgatcctcccacctcagcttcccagagtgctgggattacaggtgtgagccaccacccctggcccatagtcacatttcctcttacccttycctcttctgcatcctcttccacctggtgattacactgggcccatytgtctaatccaggatggtctccttgttttaaagtcagctgattagcaaacttaattccattggtagccttaactcccctttgtcttgtaacagcacgttcacaggttccagagattaggatgagggcgtcattggaggtcattctacccattacacctgcctttagatgggaaccgctgtaataggggtactataggatcccagaaaaggggacacctgatctcmctggggtagttgggggcacccaagaaaatctcctggaggagttgacagctgacctgagtcttgaatgaggagttggccaggtgaggaggggtggaagtgaagggcattccagcaggaagccactgcatgtgcggtggcctcgaggtgagcaagggaaggcatgtgccactgtggccgaagcatggagaggggtggcgaggctggaggggaggcgggggcggagggcagctgccagatctcaggggagctggatgcctggaggctgatgcttcctgaagacggtgggaacctttgaggagtttggagcagagactgatgaggtctggtttgcatttgagaaaggtcactctggggtcctggtggaaaatggctggggtgaggcagacgagaatttggcagccaaagagaggagtcaggtgatcctgggtcctgggcccagttttccctcttctggactctgactgccagggggacgggctgactgccttctggatcccttcctggaagaggcggtgaagcctggatcagggcgggggcaggggacagcgcggagcacctggctggagagctgttggtggaggggaagtggtgtgggacacactgagggctgattgtgggttgggaggcaggaggagaagcagtgctgtgagcagatttctggcctaggagcctgactgggcggtggggtcatcaccgaggtaggactgggggaggagcaggtttgggaagttgccaggttgggtctgatatgttggcggttggtggctgagaggcatctaggaggtccatgggaggcagctggctgtacagtctgcagccgtggacttgtatcagttattgctgtgtgaaaaatgaccccaaagctcagtggcaaaacagcaatcacttattctcactctcccatctgcatgtggagtggggctgtctggtctgggctgggcttccctcgtggctcagcttcaggctgcaggcctgcaggccagccaggcggtcagactggggcaatgccaaaatcctctttccctttgaccctgacctgaatgcccaccccccacccctattcctccacgtctccgtggatcagcagatgacatttgagcaaagacctgcaagaggtgtgggaatgaggctgtcttgaggaagagcattctaggcagagggaacagccagtgcaaaggccccgaggtgagattgtgcctagtgtgtttgagggacaggaaagaaggccagtgtggctggcagtgatgagtgaggggggtggggtaggagaggaggtcagagaattagcaggggccttaggcatatggggcctggaaggtcacgggaagtggtctctgcccttattatcattgctattatcaccccctcctcctgtcccccacaggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagmaagtgcgagaagcagcctgtgtaagtcaagagggaaamagggacagggaacaagctgttccagaaagtcatggggctagaggcgggcagagaaggaggtgggctggcctgtgtcttgtttcacggggagctgagggtgtggggggactttccaagtatcattgcttgcccagggggagacatcagccccccagatcgaaggggatttaccttgtgacatctatgagttcattacattgtactgtcaccagcagagaagaaggcctgagtaaaggcatccttgggggctccctggtcttggggagcctgccctgcgcctgacattgtgggcactgccaagtgcctttggtgaagtgaggcagcttcagtggaaatagcagagaaggtcctagagcttccctggagcccctgaggcatcaggactcttgctttcttcccctgtgacctcttcaaactcagatctcagggaggcctctgccaaggcaaagtggagagaaaagtgttttagccagactcattggctgcaaatgacagaatcctcactcaaaccagggaagggtggatcaggcctcaggcccaagttgatccactgatcaaatcccttgaagatcctttctgtccctagtctctgctttgcgctgcttgttggcattattcttccaggctaagtgttcccacaaggctggaacccagggaagctcaaggatttatattctatcctagagaggaaaataaactctttcccatccactgcacatagaaaaatctcaaggaaggatcctgattggccaggcttgggtcatatgcccattcctggaccaatcactgtggccagaggagtggggtaccaggattggccaagcttgagtcacgtgtctacctctatggtcagagggtggagctgttttaagaaaaggatgagaaggccggcagtggtggctcatgcctgtaatcccagtactttgggaggccaaggcaggtggatcatgacgtcaggggtttgagaccagcctggccaacatggtgaaaccccgtctctactaaaaatacaaaaattagccgggcgtggtggcacatgcctgtagtcccagctactcrggaggctgaggcaagagaatcgcttggaggcaggagaatcgcttgaacccaggaggcagaggttgcagtgagccaagatcacgccattgcactccagcctgggtggcacagtgagaccctgtctcaaaaacaaaaaacaaaaaacaaaaaacagaaaaggatgagagaagcctgaggagaccaagccgtcaaatgcccaccacaggaacttgccattcccttcatgggtttccctactgttccctgctctgttgttattaacatccaccctcctgctacctcagcctcaagaatcacaaagaggttctaaggtcccatcagcctgtcctgagttgcccactgcctgtcagggacacagctcatcagaagcaacaaggaagggtggggactgtgtgcgtcattccagtggtagaaataaattgaacgtggcagctaaaagtccagggttaggaaccagaaggaaagtgagataatctattttacatgcttagcacagagcctggctcatagatcatagctcaatacatgggaactagtattggagaagaagggagcttctcatggaagcatttgcagccacttccacatgacactatttcatgcagatgctcccccatccttatttcttctccctgacaagctacacaattgcccacttcccttatttggccatttaaacttcatttgcactggccgcttcctcaaggtaacaacatttccgcgtctttatttttccttgtaggtgagtttaatctaattgtaatgataggcaaatatctgtcaatctcagagcaatgggaagtcatgtgtgattaacaggatggcttctgggttcagatgccccaggttcaaatccaagctcatcactgtgaactttggagatccatgccacctctctgagtttcagtttccttatgtgtcaagcagaaacgttaataacacagcacctaacacatggagatgacaacacatggagatgacaacacatggcttagcaaagactctggcatgcagcaagtgcccagtagctattggctatcgctatcccacttccttgtttctccatctgaaataagagcatggcagcctcaaagtctgcctctccagccaccatcacccagaagcagccaccttcacatgaagtctggtggggcttggggacagatacagctgacttgaaatgtgaaggcctaggtccaagtccctgatgcttatcagctgtgtggctatgagccaaatgtttcaccacactgagcctcagttgcatcatctgtaaaatgaaaataataatgcctggactgcctacatcaaactgagttactgtgaaagtcaagtgagatgagcaaagccatcatcactctggtgctttgctgtttgcaaaaaatggctgggctgttttttctcattcaatgagaaggtgagagagaaagcatgttgcaaacccaagagggctaagtgaaaagggtcgagaaaacctacagactcatgaaggtttatggatattaagcttctctgaggcagcccaatctacaatatgactgatataaatgggtttatcaacataaggtataactatggtcagatctcactatttccgcaatcaataattccaggaaacacctgtttaattagcaggaaattcagtctcactctctgtacatctcccctacacacatccaaattatataagattgtctgggacttactcaatccacagaactcagactctttttccaaaagccagttaaagacctgttgtcagcccagtggagctgttgtttccgttgttgccacatggtgtcactgttgaacactggtcccgcacagcccagtggacaggctcaactgagagggatcacttgggtcacagcctgttccagaatgaccctctgtacccacctatacagggaatttctggcaactcctgttaaaaaaaaatttctttttaaagttttgcttcaccttcgtgttattatccattaatgggaaataaataaaaaataaacaaataagccttcatttatttaatgagaaataaataaacaaacaaataaaaaataaacattcaggcccagaataacctttgggtcaggaaaaactggacagccatctagtaagttagtggcagggtcagatttcctgacttctcattcaatactgtttctacttcaccctcatacactatccaaattcaataagatgttcaacactttattataaaataggcattgtgttagatgattttggccaactgtaggctgatgtaagtgctctgtgcacttttaagataggctagtctaaataagctatgatgttctgtagattaggtacattaaatgcatttttgacttatgatagtttcaatttatgatggatttaccaggatataaccccaccataaattgaggccatctgtataatctcactkaatcctcataccaacccagtaatactgacatgtattattatcctatttgcagatagggaaattggggctcaaagaagttaagcaatttgcacaaattagcaacatagacgtttgtctaaaccacgtctccctggctttaaaatggagggctaagacttgaattgggttgggaaatgttctggatagatgcagagaggaagggagcatgagccaagcaaggggaccacttgggaaagccgattgctaactagtgcatggtgctctgagctttctcacttgggtcagtaggctagratttccaaggtcagggccaggacgagggtggggcaggagagtcaacctttgcacaaccttgacagtgagtgcctcctaaatgctgcctcatcctagtccctgacctgttccagattccacgtgggagagggaaaggagcaaatccaagggtggagcctttcagggccaggttctctgatgccatccccttctctccacaggctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccmgagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccrgtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaakccagaaagctctgaggagaggccctataatttgggcttcaggagaaaggtcaatcttaaagcacccacccacaactcagaaaggccgccccaaggctcctacatgaatgtccttgaggaygcactggactstgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaaggtaagatgcccacatgctcagctgtacaaggaggttattgtctggttgagatcacattttaggtggttttggttgtaagtgatagagaccacctgggctggctcagcttcaggggtttagtatacagtgtggcatgttaaggggcttgaagtctcatgtgtctggaattgagcaaggcactgtgactgtgttacaactgcctgagttcacactccacctttgccatacactggctgtgtgacgttggccaagtactgagtttctctgagtccacgttctccctatctgtgcaatgggaatgtcacctatttcacagtgttattttgagggttcaaagcgacaccagaagctaggtgtagaggcttatcctgtaatcccagtgctttggtggctgaagcgggagaatttgggtggcttgaggccaggaatttacaagaaagaaagaaaagaaggaaaaaaggaaggaaggaagacggaaggaaggaaggaaggaaggaaagaaggaaggaataaataaaaaagctgggcttcgtggtgcatgcctttagccccagctactcgggaggctgaggtgggaggatctttcaagcccaggagttcaaagctgcagtgagctatgttcatgccactgcattccagcctgggcaacagagtgagactctgtcactaaagaaaaaaaagtgaggtgtggggaggggtaacactagaagtaaggggcttagcgcaatgcctggcacatgggagagatcaatagttgtaagctattattagtcagaaagagaaagaggagacrttttccccttagaaagcccatcttctgcttaacgtccttttctttgttgttgctttttcccagctggaacaactcagaccaaaayatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggttccaggggattcaagcaggaggtggtagggagggagctgggggccccagagcatcttcagctgctgttgggtggaggggaggcagggaatgccctggaggcctaggttctagaccaagcctccttgggcctcagtttcctcatctttcccatgggasaattggaatagatgaaagcaatttgttggyatccatccacccatctatctgtctgtccatctgtctacttgtccatccatcagtgaagcagccaaggtggatactgggttccccagaagcagagcctgagacatagatttttgggaaagtgacctattggaggagggctctgaggagaaggacagagggtcaaggcaggggaaggagccaagcaaggctgtgggctgaccccaaggagagcactggggcatgacccgccccacagagctggctccagctgaaggtgtaggggactggccttttataagccttgtctgtcagtcattaactgtgggctgatccccagtctgtccgtcattaatgaactgcaggaacttcgggctgatcctggaatggggtggggcagggggagccagtgatccagttcagcccagagtgcttcttcagagagggggcatctgtgagccactgacaactgatactttcagactctggggatgggttctctgcctgctgaggggatctgggtttggggtactagcagcatccaatacagaaggtcttatcactcgtatttaatatttccccattgttgtaacagacatttactggttcctgggcttagcactggcgattcataagagaacaagtctgatgtgttctctgctatcaggaaacctatattctagtggtggggaaaagccaacaggttatcacaacagattattgaaacccagtgtaaacaaagtgtgacagttgggaaggacagggggctgtgggagcacagatgagtcccctggttcaggcttagggtagtagaggtcaaggatgacttcccggaggaagtaacgtaaagcccagtcctatggtatgagtaggaattatccaggtgaagagttgggaayggcgttccagacaaagggaacagcatgtgcaaaggtccagagacaagagaaccacagtgctttctggagactgattgtcctgaaatactattttacttcacagacttccatatctctycaggaccttgagcactgccctgtctttttgcagctcccaggagaccttatctgtcmttttcctggtcatctttgctgaagctcctgctgtttgttccatattaattgtacacaaaggatctcatgatcctcttagggccatcatgggccaagggctcagattttgtccatggaaggctctgctatgggaggaagrtgacctttgttttagttctaactctatcattagctccctgtgtgtccttggagaagtcactgccctctctgggcctccttgagaggaggagaatagrcagataggacctggctcactgtcactcttccctcagttacttttgttgtaattcttgggggttgcaacatgcactgttagctcgcacatgcctgatgtgtagcatgtgtgcaaaaagcatttgctgtgtgaatgagcaacgtccacatgcgtgctccttctgtccgttttttgtcctgctcttctctagtgatcttgtcctcattccccacatgactccccccatcgcatcccccgtaaccaacttctccccgccgggttttcatgttaaggctccctctcctttattaccactgcttctctttccaggtcacccactgccccaagtttcatcatcttcaggcctcccaaaaccttgaacctattggttcaaccaccttttcactccccttttccagcatgtctccccaccctccaccacatcccttccccatcatcatatcttcctcactctccaccacatcccttccccatcattatgtctcccccaccttctgtcacatcctcacatcccttcttcctagcttagattccaggctcacattgtaatcacttcctttcaaacactcactcgcttgctttcctcttccaccttcacacttacccagataaatcccaacctccgtgagatccaactctccacctgcaccctcaagctgaacgaagctggaaaaatccacacaattgtgcaggctaattgtgttgaattcctgaccactgacctctgggggtcccaatggtgctagtggatcctacttcacctccagagtcctgaatgactcccccacagtcctgtgtgatgacttcacaccttctctctcctttgaccttcaacaccaccttccccaacttaaatctcagctgatgaccttccttctggtctgagtgagtaagcagaagcaattggaaggaagtctatgaattgcttctgcttactcagtcagaccagaaggaaggtcattcacctacctgctggcatctgtacccacaggctcagcattctagtatggatgaattgtccatgtgcctgaggctgaccctgaacccgtgctctgttcctctttacctcctcaaagacatccctccagcaagattctcttctccttcctacaggatcatctttcctctttggctctgggccattcccatcaggatgagaacacgctgcaatattgcccagcttgaaatgagctattctaggcccccgtgttcccaccctcacccttttacattaaaactccacaaagcagttgtctgtgttccctgtttccacaccttctctcttccactcactctaatcagaatcccttccccactgtgccactgagacacgtcttgtcraggtcgtcattgcgttccatgtttctagatccaggggtcrattctcagtcctcatcaccctaggcccttccgcagcatttggcatggatggccacttcctcctgttgaaaggctttcttcacttgccattagatcttcagtcacccagtcctcctctcacctcactggccacaattttgcagcctcctttcctgtctcctcatctccacaacctgtaaatcctggagggcccccaaagcccagtccttggtccctttctcctctccatccacactcacttcctaggcgatctcatcctggaggtggaatattttctgtaaatgctctctccaggctgacaaccccgacactgatttttccagcctgggccctggccatgaactccagacttatccatccagctgtttactacttgatgtctctgcgtggaggtctcacagacatctctaacttagcatgcccaaatatggactcctgacttcacatcccctcaccccacacttcccaaccttccagtctttcctcatggcagtaaaagatgaccacatcatccttgattgctctttctcttacaycccacattcaatttgttaactgtcaactctcccattaaattgtattcagaatctgttgacttcaccccacccaagtccaaaccagcgtggtctcttgcctgctgcagtggtctcctcgctggtgtctctgcgtccacaccggcctctgttggagtttccttatagggcaaacagtccccagagcctgtgcttcaagatctagatctgctccaagccagccctgtgaagcaggtctccccgtaaagttttcataaagatctgttctcaggaaagaaactgatcaacatgcaggtgtgaatgtctgctcccatgctggggatggggttttgtttaataggcactgtgtttcccattgtggccataacaagttattacaaattagtgacgtaaaacaacacaaatgtattatctgatcgctctgtatgttagaagctcaacatggatctcgctaggctacatccagstgtctgcagagctgcattctttcctggaggctctaagggagactccatttccttgccttttccagcttctagagaccactactttccttggcttgtggccccttcctccatcctcaaagccagcaatgttgcatctccctcaccccccatccatcttggcaccttgctcctaccaaagccaggaaaagttctctgcttttaaggattcctatgattagagtggatgatccaggataatctccccacctcaaggtcctgcccttcatcacatctgcagtgtcccttttgccatgtaaggtaacatattcaaggttctggggattagggcatggacatctttggggccacaggcacgaagccttaggagagggcttccctgtctttccactggaaaatccctaatgcagaagagaatgaacagagcccctgagattgagacctcaccctgagctctcagttgctccatatagatctttgaaatcctttttgcctttaaaatttctatacattttaaatatccataaatagaatacattcacactcgttttgatatgaaaaaaatgcttttaattgcttgcaaattcaattacttaccattcctccctccccaaacttggagtgactcttcatgctgctggcagatgcaacacatttttcagcaactttgggcaaccccgacttacccaccaccctcattttgccatcctcattttcacctgaggctcacaatatctgtgaacagcacagcttcaagccacggttctgagatgctaatgatggtatttctggcgccagctggtaggtgaggataacatttggggcaaaagggtctccttggcccagctgaagacaaatcaggtggacaactgccccttgctgtaatcaactcagctggcactgggtgtgtgcagggccctgttccaggcagtgtggggaaccagacatgtgaactaatcgtatgactactgtgtcccagtgtggaatgtcctgagtgtgtgaaccctttgctgctcaaagtgtggtctggggactacctayatcagcgtgaccttggagctagggggagaggcagaatctcaggcctgctgaactggcatctgcattctaacaagatccccaggcccatcaaagtttgagaggtgttgctctaaccctccattccttcatgaatcaatcacagacattgattatccagccttgtgctgagcacagggatgcaacaatgagtttgacccagtgcacacccgtaagggctctcagtcttgcaggatctcacagaggcctacatttgctttgggaacctgggactggggaagagcttctaaagagggaaggcagtaaggaggtcttccaggaagaggtggcatcttggctagtctttgagcgatgagggggatttcaccagatagagataggacagaagggcatacctggcagaaggaatagggtgaacaaagctgggtggtatcatctgtcattggtggcaaggggagacttagtatattagtgtcccaggactgccataacgtgggtggcttaagcaacagagattcattttctcataggtctggaggctggaagtccaagatcaaggtgttggcagggttgtttccttctgtggcctctctccttggcttgcaaatgcccatcttctccctgtatcttcatggggtcttccctctgtgtccaaatttcttcttgtaaggacactggccatattctattagggcccacagtaacctcattttaactgaattacctctttaaacaccctatctccaaatacagtcacatgctgatgtactgggagttaagacttccacatataaatttggaggggcaggggacacagctwcgcccctaacacctagtgtatgaaatgaggatggaagagtgtgcagagcctgagacacttcaatgccaggtccagaagcttgcagtttctcttcaaggccacaaggagccatagaaggttatagagcaggggagtgcagcaccatcagagctgcaattgagctccaggcctcaggtgtgtagcagacaaaggcacccctaattcaaggggtgaatcaggcatggtctctacccttgcagagagtttgggtacctgagcccatgggggactgggaagctgcttccccaccccagtttcctcatcagcaaaatggacccaggtatgtgatgtagcatttcctgacccaagggacccaacaaacagctgcgataggattttggagggacctgtacccgcacctccaccttcacaagttgtgcatttatttcatggtttaatgacttcaccttcttttggacttttatattatgaaaaatttcaaacctatagaaaagtagacagaatagtatcatgaatacccacatacctatcacccagatttaataaatcttaacattttgtcatgcttcatctatttgtttctgaagtatttataaaaatattacaaatcttcatattctatcacctaaatacttcagtgtgttccctaataatcacaataccatttagtacacttaacagataaaaaaaaatttcttttgagacaaggtctcactctgtcacccaggctggagtgcagtgaaacaattatggttcttgcagcctcaacctccccggctcaagcgattctcccacctcagcctcctgagcagctgggactgcaggcacacaccaccactcctggctaattatttttttaatttttagtaaagacaaggtcttgctatgttgcccaggctggtctcgaactcccgagctcaagccattctcttaccttggtctcccaaaatgctgggattacaggcatgagccactgcacccggccccctaacaaaatgaaaaagaatgtcctcatactaatcaatttccagtttctgttcaagtctcccctcttatccccaacaaaatgtctttactttcgaaatttgtaagtgaatagtaggaaaaagatcaaatccataatatcaagaggataacattgatatatatgtatacacatttatatacacacaaatttttttttttttttttctgagacagagtctcactctgtcgcccaggctggagtgcagtggcgagatctcggctcactgcaagctccacctcccaggttcacgccattctcatgcctcagcctcccaagtagctgggactacaggcgcccgccaccatgcctggctaatttttttgtattttttagtagagacggggtttcaccatgttagccaggatggtgtcgatctcctgacctcgtgatccacccgcctcagcctcccaaagtgctgggattacaggcgtgagccaccgtgcccagccacaaattttttttttattttaaaaattatatcagattttaagacatatgtgaaagaatgttccaggtggttggacccctgtgaggcggcacttgtgaaggtggttaggtttgtccaaggcttcgtgagctgtgaagggttttgcacgctgcagagggtggtgcccacgtggagtggctggtggtcattgcagggcatcctggagtgaggtgactgaagtgcagggctctgagtccaggctgcgagacaggtgtggtttcccaaggcccgagcctctttccctgctgctgtatttgccctcccctttcctccccatgaggatgggctgtactggctcccggagcctcagcctcatgactcctgtggggagagtgaggcacaccgcccagattcctggaacaggaaatagcctgtcggaaacccagggttgaaagtctgcaagaagaaatagtgctggtggccacagggctgcacgctcaccaccccttggactggagacgagaacagagacagtgatcattgtaacgaccaacgattgagcaactcaatcattcactgagctcttgctgtgtattaagtgcttctcaggagctgtctgatttcatcctygaaataacctaataagctcagcatattattctccctgtttaacagatgaggaaactgaagctcagaggtgcactgacttgcccacagacacayagtgagtcactgcagagcagagacttgacccctttctgtgtgaccccagagctcatgccatgagctttgcctgcccacgtatcttatacagagggagtgctctgcacagaggagattcagggaagacttttctcacgaagtggtgtttgagctgggtcttgaaggataagtagaagtcagagttcacagaaggagaaggagagaaagggtgttccaggcaaaggaaccgttacggccaaaggtctgcaggccacaggagaggtccctagagggccccccacaagttctcactgctcacgtgtgccctctgtcctccaggtggccgggacagggcygggcggcccctgcttctggtgtcaactacagagggggcctgggaggcaccatggtgcacagtttcagaggtcaccaagctactgtcctacctgtgtaccatccccaggtaaggatctgggccaccctgactgctccatccccacctcaaccctctgggcccagagccctggaccagacactgagtggagaggcaccatatccttccatccagtcgtctgttcacagagccagtccccagacagatgccgggggaaagcaaaacagcctcagtccctgccatcggggggttgtcaggctggtgggagagatggacagagtgcaagaaacaaaccatggccaagaaactttcaggagtgtcagtgtgatgaagaaaasagtgatgtttgtagatcagtggttttcattttttttttttttttgaaatggagtttcactcttgttgcccagactggagtgcaacaatgcaatctcagctcactgcaatctccgcctcccgggttcaagcgattctcctgcctcagcctcccgagtagctgggattacaggcatgcaccaccacacctggctaattttgtatttttagtagagaccgcatttttccatgttggtcaggctggtcttgagctcccaacctcaggtgatccacccacctcggcctcccaaagtgctgagattacaggcgtgagccaccgtgcctggccggttttcaaatttgaaggtgcattcgaatcacctggtgggctgttaaaacagattgcaggggcccatcccccagattttctgattcagttgatgaaggtgggtgggacctgaaaatctgcatttgtaacaaatttcccggtgataacaggtgctgggcctgggactacactttaagaaccactgttgtagagtaagaagaataggggatgttaatttcaattgggaaatcrgggaaggcttccctgaggaggtgataattgagctgtcatctgaattataaatatttgaataaacaaaggaaaggggtgaatgagtaaatgaatgaatgagagagtgaaagaatgagtgggtgagtcagtgagtgagtgagtgaatgaatgatgagtggactcaggctgatttctaatgctcctcctaacactcctacccctgccaccattcagacttaatggactggctggggaagaggcgccctcttttcctcgggacccagcccctagccagggcagtcttagaggggatgctgctcaggactggctaataagccccaactcaacctagaggtctgctgttgggggtaaggggtggaaggtgatggaaccctctggaactatcttcatgcatcccaccccactggagccatcactgccacctgctggtcactaacattttttttcttcttgtccaaggtggagtggcttttctggactgagtgggagatgggaccccctttttctgtggtggaaagtgactagtgtggtagacagagctctgggatcccaccgactggctatgcaaccatagggaaataatctcccctccccaaggctcgcctgaataaagggcatgaccaagagggctctaaggaccaagctgggcacaagtggcagggatgagggggtgtagaggatgtaaactgtggagtgcagtgcacaccaggtgcttgtgtgctgggctggttttctccacttgtgctctgaatgaacattggctgggcccctgctctgggcttggcttcatgctacatggtgctagggacagaggcacctcacaccgggccctgacttttaagggcctccaggttggtagcagagacaggtctggaaacaaatcactgtccagcatgggcatcgccagagggaggcaaggacataaagtcagagacttgaaatcacctcccagagcctcctgtcactatctgccactgggcctttctgtgcctcagtttccccttctaggataatcatagcaaatatttacatcccatttactctgtgcagtcactgagtgctttacaagaatgaattcatcagtcctcactacagcccataaggccggtactatcattattaaattgactcagggagatgaaataacttgcccagaccacaaggtactaatggcagtgccacagctctaccctcccactgggccacctcaggttttgtctgtgcactgagtggttgtaaggcttgagggcagttgggggctatttttcaatcctgcctgatcattagactggccgagggtgcttggaaccacacagattccctggccaccctgtacccactggccagatggctagaggggtggggatgggagaggagtagggtgaggaatctgtattttaacaagtcttgaaaattgtgccagtttggaaaatcctaagatagtcactgaaaagtggcccactgtaagctcagtgcaatgtggctgaaccagggagggtgttttggctgcaatcaacagaaattcccatttaaaatgttttatctgttaaggaaatgtatcattgtatgtctctgcctcatatctctttgttaagaactttttaaaggagggaatgtctttcccagaagcctctttccctggaaaactttccctcacatatcattggccagaaatgtcacatgaccctccccatctaaaccaatcactggccagaggaattacgtcactactgttggcctcaaccaatcagaagccaggctctgggggaacttggctttttggagggagttggattcttgagcaaaataaggattctgcctacacaaaaaagtggatgagtcccaagtgacttgcctactgtacctgggttagttgctagagttaggaatagtagggctataaacgagggctgtatgaggtcttgcaggagcaccaaagaggaagcaaaaggctctgcctggagaagaaccacggagggcttcctagaaggggcattggaacttggtcttaacaggatgaagagttcaccagtaaatcaaggtttctagcagccaggttccctcaccttccactaggtcctgccccctgtccgaggccatccagcaagactgtcaattctgtttaccacccacaggcctgaagataaagccaaggggctggyggtcctgattgacgccaggagacagcccccacagcccrgtctggtcagcgccctgcaggccacccaggtgagtgggaggtggagagccttagcctagtaagtcctgggagccaccaggggcctcctgacattcatagagtccgggggtgcttaaggctgggaccaggactctcaggcagggacttttactgcagccaacagaaaactcagccctaacaagcttgaagctcattggttcatgtcaatggacagtccaggagccaagtccagcttcaagtatggcctgatccaagggctcagatattatcattagaacctggttcctctctctccatttctggccccgttctctttggaggatgccaagccaccccgcttggcaccccgcgccccttggtggccggatggctcccagcagctctgacttcacatggtctctaatttaaatccattaggaaagagtaagagattattttcccagaggtctcagcaaaaatttctttgtgtctcagttacagtggattcaggagtccctccacacccaaccctgtggcctgggggtgaatgcaacacactgattggctcagacttagatcacataaagctcatgagctgagaagggaggagagaagattcctatccagcaattatgggcagcagagtcaatggaggttctgcatctgcttaccttatggtctgacctcctttgctttgtagatgggcaaactggggcccagaggggcaggtcatctggaaagatttgcaacacaacttgaacctgctgctctcatgacttctaaccaatgattcacggtccaaacgtatcacacaaagattccagtcatggagggaccccactctgtccttgtgacccatttgcctgcatcttacaggggatgaaggaggaaatcaaagtgtgtgaggcttcatgaagccttgggcagagcaactctgcagtggttgtctttgacaggctcaggtcccagcctctatccgggctattctcttcctgggggagaaggaggcggctctccagctgcagacattacctgacgtccaggtgagggggactcagggtcggcggttgaggaagggagttgttgggctcgagctgagctggggttaaggagagggagaactgcagaattcatgagctagaagaggcctggaggtaatctagtgtaaggcaataaatacgaggcctaagcgctaccaatccccagtatagatccgtggcaggcattgtcaaatcagtcacagagtgatatctctctggcaatcctagcagctcctggtgggtgctgccacatgatcgagaattgcacatggcatagaacctatttgaaaagcttcatctggtccatccytcctccctttgttttcagagggggaaactgaagcctaaggccacacagcaagctagacgcagagctggagtcacctgactccagtgcctttttcacactgcggtcacacctgctcttcctgtatttctcgccctaattaatacagatgtggagctgaagcgggactctgcaggaaagagccctgcagctccctttaattagtgccatacaccacagtaatgagtaagggcagtcagtcctctgtcctgcttcgggatgtgattttaaaactctccttcctcctggttagtgaagaggcagattgtgggctggaggtgtgctgttccaactttaatgtgcttactgatctcttggggaaatacattaatgtgcaggttctgattgagtagttctgggtgggtcctgggactctgaatttccaacatgtcctaggtgatgccggcgatgctggcccatggaccacactttgagtagcaggaatatcaggtgggtccaaaaaaaccacagaatccaccaaatcccaagcctaggtatctggagctattcccagcataaacctcaaatttctctgcctggcagaagcagtcacctagttcttccatgtcttagaggacactgttgggatttagtgacttttctcaccagccccaagaaggaaacagctcttggctcctcagggaactgtgcaaagattacaaagaagtttcatcacaagggccagcttccatcagtttgtatgattgcccggagagctgtactgggaaagagccaagctcagagggaacgagtgctatgattgattaatgatgtctgccttgggcacaagctaggagagtggcagtatgagtgctgtttatttgccattccctaaccagggtctggttctgrattttgatttgtcagagtttccagagaagattggttgctggcaaagcaacttttaaagctggagtcaaccttacttgtgggaaatgaactggtgctggggcagggatctgggcaggaccttctaaaatgactgtcctcacwttgagtccctggttctcctgattctttggtctgcaggtggaggtgctgacctcattgaaggccctcagccaccatgtggaccccagccagctgcccgcagtcctggaaggccccttcccctactgccacaccgagtgggttcatttcttccaggtgtttaccgtcacagcctttagcccctgacccccactccttctcttcttctcttcactcttctgtcccatggatccatcaaccctgctatgctaaaaaataaacggtcactcaacaaatgtttacagtgaaggtacagagtcaaatgattaagagctcaggctctggggccaggctgcctacattgcaatcccagctctgctgtgtgattttggataagttacttaccttctctgagccttggtttcctcatcagctaaacaggggataataatagtacctcctcatggggtttttgtgaggattaatttagttaatacgggtaaagagctaggtctatgttaactgaaaataaatttacagggccgggcgctgtgattcacacctgtaatcccagcactttgggaggccgagatgggtggatcacatgaggtgaggagtttgagaccagcctggccaacatggtaaaacctcatatctactaaaaatacaagaaagaaaaagttagccaggcatggtggtatgcacctgtagtcccagctactcgggaggctgaggcatgagaattgcttgaacccaggaggcagagattgcagtgagccaagatcacaccactgcactccagcctaggtggcacagtgagactctgtctcaaaaagaatcttaaaataaaataaaataaatttacaggcacttgctctatggacccacacaactcaggaagctcagggtctggttccctcctataagagggaggaaataaggcagccgccagtgttgggctcctttcctgtgtaatcacagtccctcctccccacaaccccaagagggggcatttcatacccaatttagtacacgaggacacatagggcgagggtgcctttcggtgggcttaaaccacaccgaaaccgatgcccatcaatgcccgccccgggtcctctctagaccagggttgctcaaccttaacctattcacatttggggttgagcaattctgttttgttgggagctgtcttgtgtattgcggcatgcttggtaccagccctggctctacccactgtttgcaccccacaaattatgacaattaaaaaagtctcctgacattgctgaatgtccccgggggcaaagtcacccctcattgagaaccgccggtctatactaacagtgtaacatggtggcttatttactttttgcccaagtgatctttttaaaattgtgtgtttttgaataggcagtaagtatattcacatttcaaatggtccaaaaagatacctactgaacaatctccttttccgcttgtcccccagggtcctagcttccctttccagaggcctccaatgaatccactggtttttgaactgtattttagctttaaaccctttcctttacatgaaatcttacctgtagacccactacatggaagtgagaatgatgataaacacagtatgggctgggctctgttctaagtgccttgcatatattaatgggtttaatcctcacacaaccctataaggcaggaactactatgatctccattttaaagaggaggaagcagagacacagagaggttaagtaacttgcccaaggtctcacagcttgtaagtgatggagctgggccgaagtgggactcagctgaaaatgttcccctaactctgccctcttcctttccttaccaatcatggtatccccactggcctgggagtcgctcaggcctgtctcctttcttctccctcactcatactcaacaccagtggttctcaaagtgtggttccccmggccagcagcatcagcaacacctgggaacttgttagaaatgcactttctaccatgcctcgccccagaggaactgaagcagaacctcaggagcagagcccagagcctgtgttttaaccagctctccagatgcttctgatgcacctggagttggagagccactgcctcccacctcccctctgtgctcctgagatgcaagaggcatcctcctggttggcctgggctgacacctgccctttggtcctctgtcctgcagaagctggaccctttccttgctgacctccaccaggcctcttccctgctacaagcttccatcgaggaattcgagaaggccgacccccctggggggatgcaggtgagcctggagcatggtgactggggaagctacatcacaccccagaccccatggaccaagggcttcgagaaggggacggcctggggaaaagggggaggacattattcctgtttttcatcattcatttgactcatatttgaggggcacccactttgtaccctgcactggagaccagcctggagcaaactgacttatccctgccctcttggggctcgtggtgctgtggcagaggtggtagtttaaaaagcaaactattataaatgggtatgtcattccaaattgtgtcaagtcctgtggaagtaagattgggaataatgagggagggaggagggcctctctgaagagctggagtttaagttgaggcttgaagtttgagaaggagcctgcctttgtggggggctgtgctccaggcagggggcaaacacatgtgaaggccctgaggtgggattatacctggggtgttcaggagtagcaaggaggccagtgtggagcagaatgagtgggaaagaagcatgagtggagcttctagatgcagcaggagctggaccaaggaagagttgggctgggattcagttcgaagcctgcagggaaagccactggagagttttaaaccaggggttatcagatttgcactttgagatccgttcaactgccatgtggagaacagactgtagggggagccagagggcagcagggagatcagcgaagaggctggaatgggtgtcccagcaagagatgctggagggtggaccaatgaggttgccgtggtgaygagaggggacatggctagaggggatgttttagagacagaaatgacagactttctggaggaccttgaatgccaaactgggagttggacttgatctgggtgtggggagccttggaaggttgcagagggagagtggggatggggcctcagggcacctccctacgctggcaggaggctaccagrtgcctgagcaagtccaaggagctgatggaggctgtgctgagggacccsggcctactgggcctccagcgggaaggtggagccaccctggccaggctgcagcatgatgccagcaggctggacttcagccctgatgtcaggtacagacgtccaggcctttcctcttccaccccatcctgtttctggcccaggagcttggagctgggaccacaccacctagggcacacatagctgagccccgagggcgcccagctttgcagtagttgcagggcctgtatcccaggctgacgcctggtcacagaaacctgccctgagccctggcaatttcctcgccccttctctgctttccctccttcagccccagccatcttgagcctgggatgggcatcagaggatgtcgcctacccatttctggtcacccttttggaaaagcactttctctgacccacacaccacgctgaacccctgcaagagcctgcctcatttatttctggcaagaaccctgtgaggtccacattgtccatttggctgatgggtaactgaggctcagcgaagggaaatagcagctagacagcggctggtaagggatttgaagccaggccttctgggcatttaacccctacccggccctgcctttcccggtaggctgctcagacacacttgtgagaacctcatggtgtctcaggggtctcagagccagaataaattatagacattcctggaaagtcccagctttcttaaatttagggggtggggaaaagtcagtcattaaattggtcagtaattgcaagtattttcaccctcttagaacacagctacttatattcaaagtcaagggctggtatgcatgagcttttaagaacattttgtttacagaaccaagacctaaatagcactttgtatgtgtccagcatttttctcagggatttacaaataccagctcacttaattcactccgaggtagctgcagatattatgcctattttacagtggaggaacctgaggctcagagaaggtaagtgattagtccagggtcacatagctgggatgtggtggggcccggacttgaatccaggcagtctggtcccagaatcttgaacacaccacccagagctgcactagacttgagagcaggcttacacagatggacgcacgggcagcactggtatggggtcatctccctgcccctcagtgcctggtgggggttggcactgcctttctcagcctcttccacccttacctgccccaccagcccaggcccctcctgtccatccgaggcccygcagacccgcagctaccagcatctccagcaggggtcactgtggtcccacatgagctgctgtgggcgtttgttctgcagcgggtccctgcagcccytaggctgtccccgtccctccgtccctccctctccaggcaggcagagattttctatcctattcacgcaccctgggccacacctcttccctgcaagggtggcaacccgtggggagctgcagtcagatggggaggctgaggtagagcaaagcaccctccaggaagtcaaaagcttttcttccatcttctctcttccattttccctctgaaggcagaggagggcagagcagggttggagattcctcccttcacacaaatatcaccatgcctgaaatcccatccacacttcttccttagtgacttgtggctttgagcattttttaaaattatgtgcagaaacagccctgggtggggttccaactcaggttgtcatctgcaagtcgattcccctcccttgacctcagttttcccatctgtgaaatggaggcagggccggcaggcatgttgcagctacttcccaccattgcaatagaaatagcacggacctgacaaacatcgtgcgctgggcactgtgttaagtgttttgcatgcatgagcgctggttctctgccctggctgtccctggaaccgcctgaggtgctttagaaagcatcagtgtctcagccgggcgtggtggcttatgcctataatgccagcacttttggaggctgaggcagacagatcacctgaagtcaggagttcaagaccagcctggccaatatgtgaaaccctgtctctactaaaaatacaaaaattagcccggcatggtggtgcgtgcctgtaatcccagctacccaggaggctgaggcaggagaatcgttggaacccaggaggcagaggttgcagtgaatggagatcgcgccactgcactctagcctgggtgaccagcctgggtgacagagtgagactccgtctcaaaaaaaaaaaaaaaaaaaaaagggaaacatcagtgtgttggttgcactcagagtctgactttgttggcctggggcagggcactaagatttgttaaagctcccagggcaggttataatgtatagctagagttgagggccagggcgttagatcatttaatccttacaaccatgctatgaagtgggttctgtgattatctccacctcacagaataaaaagcagagacatagaaaggttgagaaatttgcacagagcctcctactagaaggcagcagagctgggctttgaacccagatctgtccggccagcttcattcccttctagggaagggggagggtcagttcacttcctactgtgttctcttgtcctcccagtcccatggaagaccaaggctgaggcccttggtgaagggcctgcccacagtcacacagcaagttagctggaaacccaggctggggccacagagatggaggggcaggcctatgcgggacagaagtacagcagggtgaagagggcaacagaggccttttctcacctccgcccacctcccaggagccatctggctgcagccactgccttgtacagccttgtggacgagcagcttcatgttctggtcaccgcttccaacagcctcctggggaagctggagctccgtgtccgcctgggccgcctggaagctgccattcaccaggtgaaaggggtgtctggcttggggtgtgggggttctgcctggccacattccacaggaaagccccgactctgggcccrtccctagtcaggtgctttgttctggagaaaggacaccaagctggcgatccttcaaaggccaggcaggcatccttggggcgtagcacatgacctggtgctcaataagtgctcagtgggtgaaaacatagccccaagagctgcacttattgagcgccaactctgtgccaagccctgggccagagccgttgtgaacatcattgctttctgaactcatggggaaggtgctaggatttcatccactgcacagatgaggaaactgaggctgggagacattatgttacctgcttgtggttgcatatctcggggtctgattctggaacctgcacctggtgtggcttcatctgactgccggtgccgagaaccaacacattcctgtcagcctggagctgtggggcacggcacactcctgcatcagacagccctggttcattcctggctccagcacttactcgtggtgtggccctggacaagatgtttaactcttcagtgcttcagtatcttcatttgttgaatggggggtaatatcagtacgtgctacattggatctgtgaagataaagtgagtgaataggctctttaagatgccccagaataagaaaggaacttccactcggggttgagagccattatataccctctatccctcattgaatcttcatgtctaccccattttaccactgagtaaactgaggcccagaaagggggagtggcttaccatgttcacatggtgagttcccagcaggcccatggactttcctctgcagcctgcagcttcttctccagcactgtttgcatgtgcacgcgcacacaaacacacacacacacccgaacagggagctcatcacccctgaggccaccccttttatgatccggcgtctctgagtggttagagtagcctgaagttcaccaccctgtgccttcattcagataactgtgcactgagggcgttggccaggccagatgccctccagggtcccgctttgaagaacatgaccacacactccccctccccaagtcatttcttcccacgcccagaattgggagaatttcagtccaagccagtggtcacaggcctagccactgaatgagtgaagacagaagacctcagcctgcaaggaagtgggggagctggacaagggaggtctcctagcagcccctcatgtccaaatctgcctctcctgccccaggtcagcgactggatggagcaggaaggaaggcggtgcctgcaatcactgacccccaaggatggaagtttggagacagtggagaaagcccacgcagaatttgagaacttcttcctccaggctgcagtgcgttccagacaacagaggagcaggactggagcagatggagagggcgttagagggggtggcactgccagggcaaagctgtggaggtgggaaagagcaagaaaagttccagagacagtgagggaaccagcttggattgcagagttcagctgagatgttatctcccccagagattcttaccagatggccaagcccaaagaatattctgaatcccccagagggtttcttaaaatgcagtttccagggccccatcctagacctaataactcagcctcacagagccgggggttggagggcagggaagctgcatcaacgtgatgcgatgtgacaaggctctggaccacagggtgattcagccccgtatcagcgctcaggaattctcaggccagtggggagcgggggcgggggcggggacaaacagggaagcgcacagtaagggagaatgtggggactcagagcaggagcctttggagtcagagaagttttccagaaggaacatctaagcagagcccggctaggcaaagtgaactgccatggcgagggcctggagacttccagaagcgtgataactgctcttaattgttcaaccctcaccaggagctaagccctgtgaggtgggtgctattagggtccccattctacagatgaggaaactgaagctcaggaagtctcctggctcgccagcaaggcagctggaggttgctgacctccgagggaggccccagccaaggtgggtgctgagtgggcgccccctcctctcccctctcaggcccagtaccgccgaggcctggagctgtccaagcaggccgctcagctgggagctacagccagaggggctggggaggcagaacgtgcagagttcccagagctggcagcctttgcctctacccagcgggccttccaggmtragctgacccacttttacatggcrgccgagcggcaacgcacggacctcgagacgctgctccacctgcaccgcttctgcaagagggtgagccccgcggcccacctgcacagataccccccgatcccctggctrgggctayggtggggacagggatacctagacacagccccatggcctgactgcatagacaccgcccccatcccttggatacctagacacagcccccccccacccacttgcacagacaccacccccatcccctggctgggggcacagcagggacagggatacccagacacagtcggaggctcatcgtgattcactccccaagtcttgtaacaggaaaaaaacagaggaaggggaagagctgagatttgaacatagatgtgtctgtggtaccccgtgacatgccttatatgcttccccaaagagaagagaaatgacgacagatcccttcaccaagcaggcttgaccatggtgaggatgaggggttgttgggaggggagtgcacatttctgagtgtgtacaccatgccagacctcctgtgagcacttcacacaccttacttgacttcattcttatccatacctctttgatgacagggaaccaatgttgttcccattttacagatgagaaaactgcccaaagagggcagtggtgaaggatgatttgatttaggagctgccacctgtcctaaattcatgtagccaaatctctctttaaaaaaaaattatgggaaaactgaggtctgtggggacaaaggagcagcctgggagagtgtgrtccagctgggacagggacccccatggctggcccagacccagtgcccttggctgccccttgcacttgtcaccaagkacaaagcatgagaaagacctgaccccagcctcccagctgtcaggccagccccacgtgcaggccacagcgatcacaggctgcttcagagggcagcaggagggactctggtcaactcacgcctggggccctgggaggacagggcactctctgtctccttgggacagtgggcaagggaggcagatgttggcagtggcagcaaagggctcccccagttccagctgtgtacagttaagagcacgatacaggcggaatccgagccttggagtctggggcttcatgtccttgcgtgagctctgtgacctcaaccacagtcttcactgctctaggcctcagctctttgctaagaccatagttaatggccgtgtagttcttatgacaagccaggccctgttctagtcatttcacgtatcattttattgtcgccccgatcctatgagacaggtactactattatgcccatttccacctaaggaaacagagaggtcagataactcacccagggtcacacagctaactgagtgggcagagattcaaacccagaccatctggctctactgccagccttaccagctaatgacagatttcaatggaagtaacccctggcacagggctttgttcaaattcagaattgttattaacatcaatattattattatcattaagaggaggaagaagaggagtagtgcctccagggttaaagacatctggtagcttctttgccttgcccactgatttcagccaatttcagccccactggccttcccagatcgatcaaacgtgctccaactctgaggtctttgcacgtgctgttccctcagcctgggaagctcttcccgttgaccagctggcttcttgtctttcttccgctctcagctcacacatcccctccttgcagacaccctttctgactgcccactctggttctctctcgtcaccctgttttgtcgcttctgggtgctcactttgacctgaagttgtcctggtccttgtcactcgcttgtctcttgcatggtgcctgcgaggcgagctccctgagacagggactgggttcgagttggtcctggctctatccatggtgcctggcacgggctcggcccacaaggtctcagggaggctgtgcggggagtcaggataggctggaagcctggggatggcctgtgtggaggtggcgtctgtgccaggcctagaagtcatacgggggaggtagcaaccctgactctgagtccaactctcgctgttggaactgggctggccctgtttcctcactggccctgaatttcaatccgttcaataaggggttgggcaagatgatttctgaggtgctatccatctctgtccagcttagcctggaaggtcaagtcctggacacacagacagatgatgggacagcccagcaccaggctcagcccctggtggggagcgtgtgtgcagcagctttggtcctaaataataataacacaatggtgccactaacggagatttatggagctctttcccggccatgagctccgtgtgcttgcacgaatatgaagccatttatctaaagwcaagttcccttaatccgtggaaagatggtctcttcggagaaaatggttctccaatccctacagcctaacagctcgctatcgggttctaaattaatggagagaaagattatgtttttcacgagcggctgggaacgtgttggcttctttgcagtctgcagacgttttgtgggggaagcggggacagacagaatcacaaaatgaggcagaggctcggctggagggagggggcctgcgggcctggtgtggctgacagtctcaaggtgtgatggtgagggcacacccctgcctggccggtttctccttctgcccatgaaggtgcttggaggacagatcagaggtggaatcccagctcctccctgacttgctatgtgacctagggcaagtgagttcacttctctgagcctcagttttcttctctgtgaaatgggctgctggtgcagttcagtgcaaycctgcctgagacacacagaacctggcaaacggtcagtgctcaataarcattaggcagactcctccctcacagcactctcaagggttaatacaaccatggasaggaatttcacctctcaaaaggcttttcatgatcatctagtgcaacttccattttacagaagaagaaactgagccccagagagggctaagtccctgctggcccgtaggtctattagaaggtgtctgatgggctgggcgcagtgggtcatgcctataatcccagcactttgggaggctgcggcgggtggatcacctgaggtcaggagttcgagaccagcctgaccaacaaggtgaaaccccgtcctactaaaaatacaaaaattagctgggcatggcagcaggtgcctatagcctcagctactcgggaggctgagacaggagaattgtttgaacctgggaagcagagcttgcagtgagccgagatcacaccactgcactctagcctgggtgatggagcgagactccatctcaaaaaaaaaaaaaaaggtgtctgatgattctaagggtgcttgggggctgtttccagatggcaggtgtgtgcaccccagggaagagagggaaaccagggtcatcatggtcagtggagaagatcatggccaagctgagcggggccctggcattgggcacttattaattcagtcctccatggtcccacttccagcctgagcccccacctccctctcttcttgtcccccagatgacctggttccacatggactgtcaggacctgatggcccagctcaggctggacaagacctcaagggtcagtcctggggaccagcgccgcctccaccgctacctgcagcgactggcatctgagttccctgctgagaagctcgcagccgtggggctgcaggtggcctccctgagccgggcaggcctgggccaggagctatgggaggaggcccggatcaggcatgaggagatcyggatgctcctggagaaggcactgacccacagctcttgcccagaggctccagctgctcactcagcgcgcccagaaygaagaggggtggcagccaagggccagggtgtgagtgtagaggtcacttccaaggggaggtgggatcagcctccactagactcrctgggcatggaccatttgccaaagtcctattggcctcctgggccccccagaggggaacagaacagaactttccaggcaggctctccaccccaggaagctggccaggctgcagaggctgaagacggcaaaggctcccacaagctgcctgaccctgcccgcgagcatttgcttgccaccaccttcttccggcagcagccccccaggcagagccaggtccctcgcctcactgggggcagcttctcctcagaggggacagactcacagacatcccttgaggactcaccccagacaagtccccttgcctccctctagctgagaggccccttcagtcgcaccagcctccaggagcactgggccagggcccagctggaggggtagctgggagctctggtcagtcccagtgagacgtcaccatggagcactggttttacattctgcctctgctgggaggatgagaactgtygacctgcccctggctccagaaaactcctggaagacccgatcytcacccatgcagaatagcaagagtgggcgtcagaaccagggcacaataaatggtgtgattggctccatccctccaggctctcattgtggaaagacctgtcggcacagacccctccagaggtctcgctcgcaggcaggcagacacccacctgcagctcaggaacatacacagctctcccctcgggtacgagggccagtgttgcccttaggcagaatcctcggggagattcgggagtgcttccttgtcttggattccaggaaaatggaccctgagatgaggatttaaggatcagtgtgtttggtgctgatccaggaacctctgctgggggagtaggaggcgaatctgcaaagggaataaagagtatgttgtcaagmaaattttcttttttttaatttttaaaacttcattgtattttatgtttagagatggggcctcactacattgcccaggctggtctcaaactcctgggctcaagtgatcctcttgccttggcctgccaaagtgctgggattgccttttccgcccaccccccccgaccccaccagagacagggtctcactctggtgtccaggctggagtgcagtggtgcaatcatagccttaaattcctgggttcaaccaatcctcccacctcagcctcctaagtagctgggactacagttatgcaccaccatgctcagcttattatttatttattttttgtagacatggggtcttgctatgttgcccaggcaggctgatctcaagctcaagtgatcctctggactcagcctcccaaagtgctgggattataggtatgagccactgtgccccaccctcatacaaatttccatgttggcaactgtagctggatctttctggagatctctgaaagacagcatggaatccttgaacaccccctgaggcgtgaggcatccagagcatttatctgccaaccctcaggagctggcactcgtagacagcacgcacagccagctccattggtcttggcaaagagaattgcctcctggagccagaggccggttcctgtgcttagaaaggaaggacatgtcttctgtgctccctgtctcacaaggcctcttcagcaggcatgggaccttcattctcaagttcaaggaaccctgtggaaccttgtccttgtcctccagagagaatcctctccgccttagaggtccctcctctctctcacctccccaccaagcctccctgaactcaatgtcttctgtccccttccctgcccaacttccacttctctatgcccagcctctgtggcccagtaccattggggttctgtgggcagctgggtcctggtggttggggaccgtgggaaggggcctatctgtcggatcttagatggagcatccagaagccccacccttcatactggccagagtggcccctgccagcgcctctctggagtgtcattaagctgaaagtgtttgccttacctctgcagtaggatgcattactgaagtggcctcttggtcacctagctctgaattttcctggctccagaaagaggctgtggggcacaggtcccccacaatgaggctgtgaaggggagagaggcaggcctgggccaggcacaggaggacaactagggcttctcaggagctgtctcagccaagagtcacacacttgatacctaaaatggcttcaggaatcttccaagactgaagacttccccaggtgtggtctagggcctgcctgcctcagagccatgagcagagccggtcaaaaggcttcctagggaatcctaccccagacattaaaatagactcttggtgctggcaggtggctggaatctgcgtttgtagccaagtgctcttcctgtgtgactcagcaaagtgggggtgcatttggggaacacccggggctggggcctgagtcctccacccaaagccaggtttgattcttgcattcccctccctgccttccatccagacaggcccaaagatgcaagaggcgttgatcagcccatctccatccatgcctgttgcctcagagagggccgacggcttttaaaatgctgttgccatagcaacagcatccagccagtgggtaccacaggcagggagccacagaaactggggtgctgggatggaaactgacttgtgagagaccacagctactgctagaaggaaggggggcaaagcgggcacaggtaatctaagaatacttgggcgggaggagtccccaaggttaccttgtgcatccctctgtccccagaaagaactgtaccccaacaatctctcccctcactgcatcccctggggaagaagggaatgcagaaatgaaatgtcataatgagtaacaatgtataaaaatatcgaataataacagctaacatttcttttgcattttctttgtgcctagctttgagctaaatcctctaaaagctttacagggcttgttgaattttttttacaacattatgaggactgattccaccctattttactgaggacaaagctgaaactcagagagatttggaggtaccttgcccagtgccacagtgaggggcagagctggacttgatctgggcctagtttattgactttgcccaaatatgcccacagtaggggcatggcatggcatggcctcccccagagattccctgcgagtgatgacatagctttgaatcagcaaagcctcagcccctgagagactgctctgaggaggcagaggccacagtgcccctccatgggatttttaaacaaagtttgaagcctgctgtggtggaagaagatgggctttcaaggaaccccaagtcagccagtgatgtgactgtcaacatcccactgtgatgggaacacttttttcaagctcaaggggctggtaggcaagagacagaaagagaagcacagcctggaagtcaggcacttcaggtgccactctgccctgttgctgatggcctggtcacccgaggcaggttgcttcctctctctggtgctcagtttaccccatctttccaatggaggcgttggatggatgaggatctttctcatcttggagagccctgcttttgaatccaggcttaacagcctagtgcctctgagtagataggtgctcctcagtttttccatctgtccactggatttgccaagcctgctgggtcaggaaaataagatctctggatccttgtgttccgcaccaagacttcttcctttccagaggagtagccatcttgtgaaggaacaaagctttgaaaagacttttcactgctgggcagtgatgtggggcagacataggactgagccccaatagaagtctaggcactttacagttcgcaaagcactttttgtccatctatttcccatctgatatttactacaaccctttgggtcacagaagtcatactctgagatggccccattttacagatgggaagactaaagcctggagaggggcaatgacttgcccaaggtcacacagccaggaaaggggccaagaaggggaaagcacagggtctgggcctggttctggatcaatgccaaacccaggattgtggatgagcgtgtgttttgtcagccactttgaggtaggcccctcacacccttgtgacacagacagggtggctgtcacacccactttagacccagacagggtggctggctggggtcagaatacagtctgacctcataaagcagagatgtcctgttctccaggggctgtgaattggcctccagcccaggacaaatttgcctcgtctcaaaccccagctgaaaatagctctctgaggccagagccagagagtcccctgtagggtaagtgctctggataggcggcaggactctgggggtcccattgccctctgcctggggcatgctggggaactctgggtagtcaggtacttccttaggacctcctttccccatctgtgaaatggagggattaggtcagaccaggaaggaaaactggtggtgttttgcatgtggaatctctgacctgcccttccagtcctgcttccctctctgtgcactgaccatccatccaggtacccaggctggaaacttgcaagttgtcctcaaacctccccttaacccctaaatccactctcctgatctctctgttatcttctacttctctctccctccatcgtcctcaccctcatcccagcctccatcctctagccccagacaactataacagggtccgcagtggtcttcctgcagtcacttggatccccttcatctgttctccacccagaaactagaggggtatttcaaaatgtaatataatgtcagccccgcttaaccctgaacagtagcacctcatagctctccagatagaaaatccaacctttctgtgatctacaaagcctgtgttgtcagcctctgccctccacttcagcctcatctcaatctccatgtcttctgagttccagaagcactaacttgttttcatttcctcagccattccaagctttttctggggtcaggttccccagaagtggacctgggggtgaggattcaggtacaggtgattcattgaagaggtgatcacaagagaaaccagaaaggcaagcagaacagggaagggagggaagccaaggtgcaatttcagaccaagtccctgcctctgcctgactgcgtgggggaactctggaggacattttacacctccaaggcacttcaggctttctgcagaatcatgtggcacaaagcagagtctggtagctccagggcagaccttggaagagagttgcaagtgtgggcccataaaagataatattctgtatcaataatatgtaaaaagctctcacagctaaatactactattaataatagtaaattttaaactggacaaaggacctgaataggcttttctccaaagaagatgtacagatggccaataagcacatgacaagatattcaacattactggccatcagggaaatgcaaatcaaaaccacaaggagatattgtttcacatccacaaagatggctataataaaaagacgtataacaagtgttggtgaagatgtggagaaatcagaactctcatacactgctggtggcaatgtaaaatggtgcaactactttggcaagcagtttgccggttcctcaaactgtgaaacatcaagttatcatatgaccaaacaattccattactaggtcaatacccaagagaaatgaaaacatatccacacaaaaatttatacatgaatgcttattgagaattatttctgatagtcaaaaagtagaagcaacccaaatgttgattagctgttgaatggattttttaaaaacggattttaaaaatatacacataatgaaatattatttagccattaaaaaggaatgaagtcacttcctaacattttacgaagccactcttatcctgatatcaaagccaaatgtggacatcacaaagaaaattactaaacttatgaatatacctcatgaatataaatgcaaaaatcctcaacaaaatgctagcaaaccaaacatgacagcatcttaaaaggattatacagcatgaccaagtgggatttattctcgaagtgcaaagatagctaaacataagaaaatcaatcagtgtaatatgccaaattaatggaataaaggaaattaaaccacacgaccatcttaatcgatgcagaaaaggcatttaacaaaacccaatagcttttcatgataaaaacactcagaaaaataggaataaaagtgaacatactcaacatgataaaaggcatttatgaaaaacccacaaccaacatcaaattcaatggtgaaagactaaaagctttctctctgaggtcaggagaaagacaagaatgcccacttgcagcactgctattcagtattttactgtaagttctagccagcgcagttagacaagaaaaaggggaaaaaggcatccaactggaaaagcagaagtaaaactatttatatatttaaaagatcagatctcattattttatatctcaaaaatcccaaagaatccacacgaaagctactacagctaataaattcagcgaaatttcaagttagaagatcaacacacaaaaatcagctgtgtttttatataccagcaacaaacaattcaaaaaggaaattaagaaagcaatttcatttacaacagcactagaagaataaaatacccagtactaaatttaaccaaggagatgaaagatttatacacggaaacctacaaaacattactgaaagaaattaaagaagacctaaataaatggaaagacacactatattcatggataggattgttaagacgtcaataccacccaaagcaatatataggttcaatgtaatcctatcaaaattccaactgcttttttgtccagaaataaaaagccacttctcaaatttaaaacagattgcaataggccccaaatggccaaaacatcttggaaaag

SEQ ID NO: 10568 - DNA, 13981 bp, Homo sapiens
  misc_feature (1)...(13981): n = A,T,C or G, or insertion/deletion polymorphism (see Tables 1-2)
actcatattcatatatacatatatctcacatcatgtatcatatataaaataaatttaggtgtcatgatatatatttagataaatatacttagaaacttttttatggatgtataatttatggatatattgataattatgtatttgttattgactacttcaattgattcccatttttatgcattatattatagattatatagctcacacatctttgtacataaatctttgttcaaatattatttcctaaggatagacttcatgaagtggaaatactaaatcaaaagtgaaaaacattttctaaggttcttaacatatacattgccaaattgctattcaggatcataccaatttataatcccaaaataatatgraaattcctgttttatagcactcatatttacaataaattttaaaaatcactgttaacctaatagtccttcaaaagaaaaaaaaattgaaattacattattttaatgactctattagtgagggtcattcttcccatgtttcttgttagccatgaccctataagaaataaactgcactgcaaaatgataaacatgatatcaatcattacatgggaaggcactatataaagaataataccttaggttaaggccacataaatatttatcaggtgccttttctgcggaggactctgaagggatactaaactgcatttagctgcatgcaactgaaactacttttacctacattgtctcttataaacattataactactctttgagaaagtgtttactatggactgaattgtctccccatccccccaaattcatatattgaagccataaaccccaatatgactctattcctagacaggacttataagaggtaattaaggttaaatgaggtcattaggatgggttcctaactggataggattggtggccttataagaagaggaagattctgcacttggtcttccaaattaaataatttatttaaaagaaaaaaaaaaaaagaggaagagagggagctctgcacatatactgaggaaaggctatgtgagctctcacagtgagaaggtagcactctacaagccagcaagagagccctcaccagaatccagccatgctataccctgctctgagacttccagcctccagaactgtgataaaattttgttgtttaaaccacacaatctatggtatttttttatggcagcccaagccaacaaagacagcatcattgctgtcacttacagacaagaaaactaagactaggagagagaaaagttaaacttgtccaaggtcacaaaagccagaaacaagtgaggtgagaagttgaccttgttctcctcaatccaaggccaggactcctccactccacatgtagatagccacctcacagtcaacagccaaatgtccacaccccagagtcagcattagaccaagatgtcttaccaggagacaaatgcctcatcttgaataaatatgatctaacaacttacccatgtaaaacattgaatctcatgagaaacaaaaatgcaaagtatgtagaaaactatgtttaccacttaactgacagtgataaaaagcttaatgatatccttatagtcttggaggggtttgtatatgtggtgaaacaggtgctcacgcactgctgatagactgtaaattggtcctagagagaaaaataaataaactggaaggagttatgctgtatgtttactttttttatggaaacatatgatatacctggaaattcgattgrccatgcatctatttcttcaatgggtatgcacagttgagctgttcccatgcaccaggcactgtaatgggacaactgcacatgacagtcaaaaatctcagtctcatgaagtcgacatgctcatggagaggtgctacccactaaactaatatttgtatatcaattatggatacattgggccacatttacagaaattcacttacagtgggttaccagaagggattttttttcttgattggcaagaaggctaggctgttttgttgggggctggcaggagctgtctaggctgcccaagtatgcaggtctcttctatcatcctgtgttaaccatcttccatgtatctttcaacctcatggtcatctgcagcatgtctaggggtcatatctatgttccatgcaggaaaaaagggtaaagggaaagggaagtaggcatgtaccattttaatgcacaccttggttttcagaaaatttaagaagaaagactttctgcttttctctgactattctgtattctggattacaacgcaacagaaacgtcaccttaaattctaatgtttttctctccttgctttcaaaaactgactcattaacctccacgtggcttggaaaaattatttcagtcatccagtaatgagctgttcatagaaatgttttggacatcaagtctgtgttgttagcattatacatgttaagcattgaataaaaaacaacatgatgtgggtacatttctttacttacatataagtacttatatacttatagctgaaaagagaggttgaaatgtcaggtggaacagaaataagattacctagatgtttctcctatgggtgattttcagctatgctgatctttcttctgggtcaggtactcccagaacttcctaattaaatggtggccctgatcttagttcctctctcctcttagacattttccaggactacagaagatgtgcagtttataaatgagtagcagaaacctactgaacaaattattcaggctcatctgaacagagaggacaccttctctgctatactctctcagtgatttccctgccttggggtcaattattgtcttggacattgatttaagcacataataattgttgtcattgcttatgtttggatttcatctcccaaaatagatggtaaattctttagtttagagaccaagtaatacttacaaaaaaattttgtgtgtgtgtgtgtgttttttctgtgtctctcagccctgtaatagcatcgtacttacacttgttagatttttagagacaacttttacaaaacatggaattatctacataccctttctacaaaacagacaaattaaatactcagtagttgaaccaaaaaaagcagttcaaataaaatacttgaaaatgaagaaatcatttgaacagagttaaagttaatcgtaaaataatgtctgtaaaaattattgccaatcaaatataaagttcaaaaytagtgcttgaaaaaggaagaatcatatgaaaagggactactcattttaaaaatgttagatatcaggaaaagccaagaagtgagtatggtaagagtgctgtcyagtgaaaccctgctaatctcactgaacatgtaaaaatctgtagatgcctttattttattcactyaracacatatgtagaaagagaaatatatggtaaacattaaaaaaaacaaattagaatgtaaaattaatactttaaaaaatgggctgtatacttttcttatcaccggagataagaatttattatttttaaaataaagttattttctctgtgactgtttccatgactttgctacttagaagttagagatgccaaagtttatctaagaaaatgtttatggaaatattatttcaataatgaatgtttagaagactgaatttcctgactgggcacagtggctcatgcctgtaatcccagcactttgagaggctgaagaaggaggatcgcttgagtccgggagttcaagagcatcctgggcaacacagcgagaccctgcagcaaagtaaaaagaaaaaagaattgaaaaaggaagactgaatttcctttgggcaagtcatgtgacattcctgtgcctcagtttcttcatctataaagttaattcctacatttttggggaagggagagaaaaacttaggatagtgactggcacagaagaagcactatatactatatatatgtggatatcatttgtttttatggtaccattttagctatctaatgcaaaatatgaatcttttttttctgggtcttaaattatggaatgtaagaattttctaaattctctaattctgtgttagttttaaagcaatggagtaacgtatctgtcaacttgtaaatataaggatcaacctgatccacaatttgacccctagccactaatatttaatagtacaacactcagaaattatcaaaggtcagagaagccaaacaaatgtaaaaacatacaggtgctcagaaagatgcacctgtaatctctctaaggagaaatattttccaaactgagtgacacggtgctttagtgagttgtggaytcaatctcatgytttccaacctagtgttcttttaaaaatgaactagtccacagtagaatatactaaagtgctggtgcttaagatagtattgttttctggaaaaaaaaaaaaaattttttttttttgagacagggtctcgctcttgcccaggctgaagtgcagtggcacaatcatgctcactgcagccttgacctcctgggcccaagtgattctcccacctcagccttttgagtaactgggaccacaggtacgtgccaccacacccgggtaattttttaattgtagagacagggtcttgctatgtgcttaggctggccttgtgaactcctgggctctagtgatccactagcctcagcctcccaaatttatgggattataggcatgagccaccctacctggcctgttccctgaatttttttttctttcaggtgtttgtgcatatgtgtgtgtgtatgggtataacagagagacagagagaaagaaacttttctatcacactttgcaatcagaagtttgaagtcttatcttttggcttttgtttcagaaatatttcaaatgtagactctctcctttaccacactgtccccttaggcaaggtctttgccattcttctgagactattgcaacagactcccaacttctgactgtgggcccttctcaaaaatgattgtttatgcaataaatctaaacccaagacaactacaacaatacaacaaattctctgcttaaaaacttccaatgtctgccgggcgcggcggctcacgcatgtattcccagcactttggaggcagaggcgggcagatcacttgaggtggggagttcgagactagcctggccaacatgatgaaaccccatctctactaaaaatacaaaaaattagccaggcatggtggtgggcgcctataatcccagctaattgggaggctgaggcaggagaattgcctgaacctgggaggtggaggttgcactgagccaagatcacaccattgcactccagcctgggcaacaagagcaaaactctgtctcaaaccaaaccaaaacaaaacttctaatatctaccaaatgtttcacacaagtatttggggatcttcacaaatggcccttatggagttttcctttgctgagaccctatgctctggccacactaaactcattcagcatcccagaaaggcctcagcctttgtgagcaagctcttatctccaggcctctcacaaagacctgttccagtagaagctcaggggagcacactggacattattccaacaaccctttccccacagctatgcagccaaatctgccagctcagttaattaattaagcaattcagagatgagggtctgcccaggctggagtgcagtagctgcgacctcaagctcctgggctctaagtgatcctcttcagtctacccagaagctgggactgcaggcatgtgccaccacacccagctaatttttttttttttcagtagggaccaggccaacctagtcttgaactcctggcctccagccttccgaagtgctgtaattacaggcatgaatcactgcgcccagccaacccgcccagtcttgttagacatggggtctgtagtttctagtaggttcttgagtctagggttcctacctcatgttttatagttaatttaggggagggactgtgtctgtttatctggggatgtaggggtgggcagggggatagaggggacttcaattaatgaaaccagaagcaaaactcagttgaggacaccggtcatgagagtggcctgattatggccaatcttacataatgtgtgagatcttgatattaccccatccttgagagtcctctataaagctacagggacttgggagcacctttaattacagacaacccatgttcctgtggattatgatttattagattgcacatgcctaaataaagacatcctctgcagtcttttgacaattctataagcatcttctgactccgcaattagacagctaagagatctgtgttacttccctcacatatataaataattttaaataaaaatcatggcgtgaataatttctttcctctaccgatttgaagctatccatttggaagaccactctgaagagatgaaataagtcttctgccaaagattacttattaatttacaaggaaaaggggaagttttgttcctctccgtgaatttgattgaaaatcgagggctttctcgaatagttttggcatccagggtcatttttcattaaaaagagaaaagtcatgtcaaatatgaatttccgcagattattcagcactagaccctgggagattctgtaaagaggggttttgttatactcaacttttccgggtaaaacaaacacaaatactcctcctccaaggggcgggggcggtgcctaggtgatgcaccaatcacagcgcgccctaccctatataaggccccgaggccgyccgggtgtttcatgcttttcgctggttattacatcttgcgtttctctgttgttatgtctgaaaccgtgcctgcagcttctgccagtgctggtstagccgctatggagaaacttccaaccaagaarcgagggaggaagccggctggcttgataagtgcaagtcgcaaagtgcygaacctctctgtgtccaagttgatcaccgrggccntttcagtgtcacaggaacgagtaggtatgtctttggttgcgctcaagaaggcattggccgctgctggctacgacgtagagaagaataacagccgcatcaaactgtccctcaagagcttagtgaacaagggaatcctggtgcaaaccaggggtactggtgcttccggttcctttaagcttagtaagaaggtgattcctaaatctaccagaagcaaggctaaaaartcagtttctgccaagaccaagaagctggttttatccagggactccaagtcaccaaagactgctaaaaccaataagagagccaagaagycgagagcgacaactcctaaaactgttaggagcgggwgaaaggctaaaggagccaagggtaagcaamagcagaagagcccagtgaaggcaagggcttcgaagtcaaaattgacccaacatcatgaagttaatgttagaaaggccacatctaagaagtaaagagctttccgggaggccaatttggaargaacccaaaggctcttttaagagccacccacattattttaagatggcgtaacactggaaacaagtttctgtgacagttatctataggtttaagttgtgatgcagctgagttgaaaaggcttgagattggagaattaattcaggccaggcttcaagaccatcctgggcaacatagccagactaccatctataccaggggtcctcattyccccggccaccgaccggtaaccggtccctgtccatggcacgttatgaattgagccgcacagctgaggggtgagcgaacattaaccaactgagctccaccgcctgtcaggttagctgcagcattagatagatwctcataagctcaaactgtattgtgaatggcacatgcaagggatctaggtttcaggctccttgtgacaatctaatgcctgatgatctgaggttggagcagttttagtccggaaatcattgctcccagcccctgcaccccctggtccgtggtataattgtcttacacaaaacggtctcttgtgtcaaaaaggttggagactactggttttacaaaaaagtaaattagtcaagcatggttggcacgctcccttagtccctgcacccaggcgtttaaggatacagtgagctatgatggtgctacctcactccagcctgggtgacagcgagtcagacgttgtctcaaaacttaaaaaaaaaaaaagttaaaacagaaaaagggcttcttgtcagagactgccgtatatctagaggtccaggaactaaaaagtctgatgtccaatcctgaaaagctcgatggtgcactagaggaggcttttacatgtaagagcatctaagttctggaaatgccagtgtcagggaagggaagtggagagcaatttggcatccaaacataacttgctgatactttttttttttttaacacaagtactacattctagtctttctgtggtgtcattgtaactattgtttcttaatatgctatccactgacttcaagggatcaataaataggaatcaaggtgtcccagaatatggattaggggagtttttttgttgttgttgttgttgttgtttttcatctattcattatcctgtagctgaaatttagaattttcttccattgtgtgtgactgatagaaataacaaatttgtaggttatagttgttgcaagaatctggaaatcgtgcttgcttatttccgaagtactattaggtatatcaacaaaaacacacatattacggtcaagtggtttgataattattttaatattattggtctaatacaattgtaaccctatgaattactttaagtatcttatttatgaaaagaatctgtaagtttcatcagactaccagagcataccgaagactgaaaaattttaagaatccaaaccttaatggaaatgttggaggctgcccaattaggttctgaattccaccttcctgaatcacaaacttgttttaactctcagtctgaggtaaactacgtttctctttaaacagacatagtttaattttcctttgatttttgatttagtattcttactgatcatcataaataaccaatgctaatgttagtctactttggaccatggtatttcgagaaactttgaacaaagtcccctgcaaaactatgcattgcattatttcacatacatttatgttttccagacggttcaatagtacctcacttttctgaacttatttgtatagtttggcatctttttaaaaattgtgtcctataatgaaaggttgtaaacattatgttttaaatttgtatagataaaatcaaccacagacctttccttgcttggatgtaattgccattgtttcccaatgagttcggaattactaggattgtgcaaaaatatgcctcacttgcctgacatagcagagagccattttgcctaaatgctgtgcccagcaatggactgtcaccagattctcatcacatacagtgaggatgaacaactagcctctcccagcagctggccggtctctcaataatatgggactccctcaagatggcttcctgcacctttgctcctctagccttgtatgtatacaaggctagcatgcctggcatacataaggttaaaaacaaaatcaataagttatggttcttcctccagttctggggattattagaccacttttttgttttgttttgttttggatggagcctcgctctgtcacccaggctagagtgcagtggcacaatctcggttcactgcaacctctgcctcctgggttcaagcagttctctggctcagcctcccacgtagctgggattacaggtgcccgccaccacgcccggctaatttttgtatttttagtagacggggtttcaccatcttggccaggctggtcttgaacgccagacctcgtgatccacccaccttggcctaccaaactgctgggaatacaggcgtgagccaccgcgcccggacttagaccactttgttttggccaataggacaacagccatagaaccctccgcaaatgagagcttgtccctaaagatgctttatttacatagctgtgtgccgcatgagccaaaaggtgataacctttgttcaacacgcgcctccagcccttcggttaagtccaaagtaccattcttagaatgctctaaaatacataattttttttttttttttttttttttttgaggagtctctctctgtctcccaggctggaggggagtggcgcgatctcggctcactgcaatctctgcttccgggctagctgggcctacaggtgcagaccaccacgcccggctaagttttgtattttttttggtagagggggtttcaccattttggccaggctggtctcggattcttgatctcaagtgatacactagctttggcctcccaaagtgctgggattacagtcgtgagccactgcgcccagcaaaatgctttttgtggagccaatcactttattagcgcttacctctctatgcctactttatgctttgaaattttgtcacagtgtggccggtcatggcaaacacaattcattcttatgcaggmtrtcacggttatttctgtcatccaaactcattctcgcaacgcatttcagctctttaaacgactttgtgagcggccctgaaaagggcctttgggtttttttgtttttgttttttgaagttctcaggagaccgcgtattcttagattcagccgccgaagccatacagagtgcgcccctgacgttttagggcatatactacatccatggctgtgacagttttgcgcttggcgtgctccgtataggtgacggcgtctcgaataacgttctctaagaaaaccttaagcacacctcgagtctcctcatagataagaccggaaatgcgcttgacgccaccgcgccgagccaaacggcgaatagccggttttgtaatgccctggatgttatcccggagcaccttacgatggcgcttagcaccacccttccccaagccttttccgcctttgccgcgaccagacatgattcctatcgcagtggaaggtatgaactgaaacagttccttaaatacaaacttggcggacctgattgaaaacaacatgggttggcgcggtttttttttttttttcaaatttggtcaccgagtgggtggagcaagaaaaactgtttcattatggttcattgttttgattggccagtgacagcttgctctttgtgggagtggaagggtgtttgcaagttgaatgcgctgtattcctgtcagcttaatgacgctaagcatagccccattccacatttctttttatttccacttgctaactaataaattacggaatagtttattggggaacatacaaataatgtttaaaggaggtcagatttataggtcaagggatttaccctcccaatcattttaatatttttatttaaaccaggcattttgatggccttctctgtgctggacaaggtataagtttggctatgaagtttcactcctaaagaccctatgttttgggaaggcaaaaaggtagccaaataattgcaaattaaaacctcataagtgcaaacttcttcctcgtcactttccctatctcgattcaaatatttgttgaatgactcatttttctgcaaaagtctgagagagacagggaatataaacttaagtctggataatatgttttcccgggacgctcttcctggtctgctgtgcctgtttgctgtgcctgaaattccaaacactcttcccttccctccgtttttaatcccctttcaacttgctacagctttagagaaaagaacatacgttttgtacagttggggattaattgaagtgtagggctaatacttgattaaggtcattacaaaatctacagggtcttcctctgggaggtttttgtgataagattattggtgttaaaataaggctaatccccttgaaaaataaatagaatagcagaattgggtctgaatgtggtttgaagaaagggacttctcaattcaaaattttattcttagcttcctgygggagctttccagaatgcccataagatccacttttgtttaaaaaacaaaaacaaccccacccaccactctctggttaataaatgaatttctattgggaatatttagaatggggctgtggcctgtgagagacattatatagtaacctcagacttgctcacatgaagagaagaaatccaggaatggagaaaaaagacccaggaaaggccagaatgctctacatgtcatattgtttgtatcacttctgaaataattgattacattcttctgccccaaattgagttcttaggttcttccactcactgtccacatgccacaacacagaccttataactagagacttagctaggaagaaatgtcaaacattacagagaaaaaatgcagagtctgagatcataagtaaaactctgaaatctcaacatgccttttaattcatgaaaataaaaaatatagcagcatatgcaatatgacaattctctgaaaacatacatcatgtgaactaccctggaacacatctcgccaagtgccatcttcattttaaccagaggtctaggatgcctttcctttattttgcctattatatcatttataaaaccccatttttattttgatattttatttactttctatttcctgctcctaatatctcctttctaaacttttctcaatgacagtgactcaaaaacaatgaatgtcagaacaaatatttaaaggatctgtacatgtagatatatatatttaaaatggattcttccactctgggaagaattcaggcatactcaatcttatggttagggagagattaggctcactcgcctaatctgtatggcttctcgttcgctttccatttcaccttcctctcacccatcagatcaaactcattcattgaacaagagacctaagcccttcagattaaaactctgcaaacaagttgtggttgagaggatacatgaagcattcaaacaaataaatctatgatattaatcagaggttaatctatgatattaatcagaggttaatgcagtggctcacggctgtaatcccagcacttcaggaggctgagttgggagaatcgcttgagctcaggagttcaagaccattttgggcaacatagcaagtcttcatctctacttaaaaaaaaataaccagaggtgttatgaaaatataaattgtccagaactaccctccacaaactaactctctcagaatattcgatatgaggaatgaaatatggtgtgtgtgtgtgtgtgtgtgtgtgtatgtgtgtgtgtgtgtgtgtgtatgcacctatatatggcacctatatattcaacaaacaattctgataattggccagggttgagaatgactagcagcccagcatacactatcagttttaagtatataattgcgctttagtaaaatgtaaagaaatcccagagtagaaatacttttaagctatattacaggtgagaaaatgcataagtatagtctcacccaacttagactatgggggctttataatgtcacaacagttgtttccaggcatttggggacatcaccactggtcttgggcaagaaactcctctagccaatggctgatttatctcactcccatctaaggcttcactgcatttctctttttcagcaacctaacttatttaaaaatatccattttctgattcatttttttctgaattaaactgtcagtaccattggcacacctttggttccgtagcatacctgtgtctctgctgtgttttttttttacctccactccttacttttctagaaaaaaatctctgctttttcttttcagtttaaattatttcacaaaaagttttcttgacttgcacttcctaggcttgctgtccttgtgtgggcacgctcccataaacactattaatacacttcgatttgttaaaaataaagatatctggacagaaaatttcttttctttttttaagattttaaaatttttaatgtttatttttttcctagactggagtacagtggcaccatgatggctcatggtagcctacacttccccgggctcaagtgatcctcccacctcagcctcccaagtagctgggactacaggtgtgcaca

SEQ ID NO: 10569 - DNA, 35298 bp, Homo sapiens
aggtgttgatagtattctctgatggtagtttgtatttctgtgggatcggtggtgatatcccctttatcatttcttattgcgtctatttgattcttctctcttttcttctttattagtcttgctagtggtctatcaattttgttgatctttccaaaaaaccagctcctagattcactgattttttgaagggttttttgcgtctctatctccttcagttctgctctgatcttagttatttcttgccttctgctagcttttgaatgtgtttgctcttgcttctctagttcatttaattgtgatgttagggtgtcaattttagatctttcctgctttcgcttgtgggcatttagtgctataaatttccctctacacactgctttaaatgtgtcccggagattctggtacgttgtgtctttgttctcgttggtttcaaagaacatctttatttctgccttcatttcgttatgtacccagtagtcattcaggagcaggttgttcagtttccatgtagttgagcagttttgagtgagtttcttaatcctgagttctagtttgattgcactgtggtctgagagacagtttgttataatttctgttcttttacatttgccgaggagtgctttacttccaactatgtggtcaattttggaataggtgctgtgtggtgctgagaagaatgtatattctgttgatttggggtggagagttctgtagatgtctatcaggtccgcttggtgcagagctgagttcaattcctggatatccttgttaactttctgtcctgttgatctgtctaatgttgacagtggggtgttaaagtctcccattattattgtgtgggagtctaagtctgtttgtaggtctctaaggacttgctttatgaatctgtgtgctcctgtattgggtgcatatatatttaggatagttagctcttcttgttgaattgatccctttatcattatgtaatggccttctttgtctcttttgatctttgttggtttaaagtctgttttatccgagactaggattgcaacccctgcctttttttgctttccattttcttggtagatcttcctccactcttttattttgagcctatgcatgtctctgcatgtgagatgggtttcctgaatacaacacactgatgggtcttgactctttatccaatttgccagtctgtgtcttttaattggggcatttagcccatttacatttaaggttaatattgttatgtgtgaatttgatcctgtcattaggatgttagctggttattttgctcgttagttgatgcagtttcttcctggcgtcaatggtctttacaatttggtatgtttttgcagtggcttgtaccggctgttcctttccatgtttagtgcttccttcaggagctcttgtagggcaggcctggtggtgacaaaatctctcagcatttgcttgtctgtaaaggattttatttcttcttcacttatgaatgttagtttggctggatatgaaattctgggttgaaaattcttttctttaagaatgttgaatattggcccccactctcttctggcttatagagtttctgccgagtgatcagctgtcagtctgatgggcttcccttgtgggtaacccaacctttctctctggctgcccttaacattttttccttcatttcaactttggtgaatctgacaattatgtgtcttggagttgctcttctcgaggagtatctttgtggcgttctctgtatttcctgaatatgaatgttggcctgccttgctaggttggggaagttgtcctggataatatccagaagagtgttttccaacttggttccattctccccgtcactttcaggtacaccaatcagatgcagatttggtcttttcacatagtcccatatttcttggaggctttgtttctttctttttattcttttttctctaaacttctcttctcgcttcatttcattcatttgatcgtcaatcactgatactctttcttccagttgatcgaatcagctactgaagcttgtgcattcatcacatagttctcgtgccatggttttcagctccatcgggtcctttaaggacttctctgcattggttattctagttagccattcgtctaattttttttcaaggtttttaacttctttgtgatgagtttgaacttcctcctttagctcggagaagtttgatcgtctgaagccttcttctctcaactcgtcaaagtcattctccatccagctttgttccgttgctggtgaggggctgcattcctttggaggaggagaagcactctgatttttagaattttcagtttttctgttctgttttttccccatctttgtggttttatctacctttggtctttgatgatggtgacatatagatggggttttggtgtggatgtcctttctgtttgttagttttccttttaacactccggaccctcagctgcaggtctgttgcagtttgctggaggtacactccagatcctgtttgcctgggtatcagcagcggaggctgcagaacagcgaatattgctgaacagcaaatgttgctgtctgattgttcctctggaggtttcttctcagaggggtacccggccatgtgaggtggcagtctgcccctactgggggatacctcccagataggctactcgggggtcagggacccacttgaggaggcaatctgtccattctcagatctccagctgtgtgctgggagaaccactactctcttcaaagctgtcagacagggacatttaagtctgcagaggtttctgctgccttttgttcagctatgccctgcccccagaggtggagtctacagaggcaggcagccctccttgagctgtggtgggctgcacccagttcaagcttcctggccactttgtttacctactcaagcctcagcaatgacaggcgcccattccccagcctcgctgctgccttgcagttcaatctcagattgctgttctagcaataagtgaggctccatgggcgtgggaccctccgagccaggcgcgggatataatctcctggtgtgccatttgctaagaccattggaaaagcacagtattagggtgggagtgacccgattttccaggtgctgtgtgtcacagctttgcttggctatgaaagggaattccctgaccccttgtgcttcccaggtgaggcaatgcctcgccctgctttggctcatgctcggtgtgctgcacccactgtcctgcgcccactgtctgacaagccccagtgagatgaacccagtacctcagttggaaatgcagaaatcacccatcttctgcattgctcacgctgggagctgtagactggagctgttcctattcagccatcttggaaccaccctacagtttctttcaatacttttcatgttcaatgtcttacacttaaatttttcaactacatgaaatttattttgatataagaaatgaggttgggccaggcgcagtggctcacacctgttatcccaaaactttgggaggctgaagtgggcgaatcatgagatcaggagttcaaaaccagcctggccaatatagtgaaaccccacctctacagaaaatacaaaaaattagccgagcgtggtggcgggtgcctgtaatcccagctactcgggaggctgaggcaggagaatcgcttgaacctgggaggtggaggttgcagtgagcagagattgcgccactgcactccagcctgggtgacagagtgagactacatctcaaaaaataaataaaaagacaaatgaggttggacaatagcttgattttttaaaaactccaagccagttgcccaataatccattttgccattgatgtgacttgaaactaaacacccatatgtgcttttacttaattctgctcacttctcagtttcactgatgcactggtactatgccattggaggcaatacagcattctaatgcatttacagatatggaagagaaatcctccccttttattttcattcagaaattgcctggctattctcacatgtggtcttaccccagtcagacccaacacctcacttttataacaaatatttggtaatgcaccctttgttatatgaaaggagatatttgtggataatgtaaccccagtcttcatgataaacaaaaaggcccagctgatttccaaaatgcaccccagtttagaatcagtctggcaagtatcacatgaaatcctattggtatttgattgggatcacacagcatttgcaaatcaatttaagcaacatttctatttttacaatattgtggcctctagccccaataacaattatttctcttcatttacttatatctttgtgtctgggcagggtcctgccaggaaacagacggcatgttaaagtgagaaactgatgagttcagcaaagtgactatttatatatttggacaggatttaaggaagtaagaaaggatgatgcaacacttcagaggggagtctttccgacctcaggctgaaggagaaggaacgattactggaattcagggaggagagcatcaccaaacaagagcttcattagaggactgcagccaacgcagggccaggcggagggagccagagggaggcaggctctgctctccctcttcctgcccttcagtttccaaccacggcctcctattggccaaacccaaccagaagccagcgagcaaggggctactgatgaagcacatatagctcagcctccagagacacagaacaggataaaaggctgagacagtgggtctggtggggcaaagagaaagcttgcacctgccaggtaaagcattatagtccccatcctccccccaccaccttagttcttgtgcatttcccatcagttttcttccaaagcatttcagatctcactgatttgaatgggacctcttcttctattaccaatttggatcagtaattatttatgtatgagaaaactattgatttttacatatcgttgcatagcagagtggtttaataaggagacatttggtttttactgcctgtgtgggtatcacttgctatgtgacttgaggcaaatccaatatttcttctgttataaattccagtatttgtaaaaaatgggtaataagatctctattttatatagttttagtatttaatgagataatacatataaagtcattaaaacagtgtctggctcataaaaaaccctcaataaatgtcacttattactgtatctggtttttgagctgctctattgcaccattgagttttcagcccagtatatgttaaccctgatcattatctgcagaagtccccgtgccacactctacatcatccaaattctctccaggtggactaagtagattaaagaactttaaacataactaccatattttggctctatctacaaaatgtccaataatcagttaagaaaggaacaattctcttggggcccacactttgagaagcaaatgcagctgaacttttttagaggaaagtgagtgaaccaactggtagctttgccactgcttaaaaaccagcatcctttccagctgggtctaagacagaataaggtaaatttagatatgtctctaatatatctatagaacagtggttctcaacccggggtgtttttgccccttaggggataatttgcaatgtctggagacatctgtgattgtcataactggaagggggcagtgctattggcatctagtgggtatagagcaagggtgctaccaaatatcctatggtgcaacagagaattatctggtcaaaaatgtaaatagtgctgagggtgagaaaccctgctataaaaacgaaagaaatttggtctacagagttgtttggatttagacaagacgttgccccaatagtggtgatagaaataagaggaaccccgtgcttttgcaaagcccatatctggggtggcttaaataatcatgctcctccccatcccccgacctgatctttgtagttggaaactccagggctggctgcctgtagtctttgtgactacacttcctgcctcccatcacttcatctcagaagactccagatataggatcactccatgccatcaagaaaggtattttaaacattggaacacatatagataatttaagtaggtagatgtatgtgctgttataaggaagtggggaggagagaagagggaaccgaaatcatatgcacaaaaawtttttttagaatataaataaaaaatgtggtagtctaaaatgtcaattcttcaaagataaagttaggctttcagtaacgttagamatggttttctggaatatgtctccagtctacctaactttgaggaagtaaatactgtaaatagatgtttcaaacgcattttaaagcaatgatcctagcatgtctttaagctacagtattgtgctgtctttgaaatgtaaacttkgatgtcttctctttctcttagttgatgctattgggcccatctcaagctgatcttggcacctctcatgctctgctctcttcaaccagacctctacattccattttggaagaagactaaaaatggtaagaacagctcagagaaccttaaaaagtgttatctgtaatctttgtggaaacaactgaaaccagctggcaagagcaatattgaagaatctgtacttaggttatttgctgggggaaagtgcttcctgatatttcacaattggcattaatgaagggggcatgtcacaatttcagattaatcaacgcttgctctgttcaacttcctacaagaattaaatatgtgctgtggggaggaggagcagatgtttgaattggggacatagcttctatgtatctcatttcttcagcctacaattttggctttaaagccataacaaatcactgaattactgaagttactttgtgctttttccagcatatggtgttgtcttaatgactgtgtggatgaaagtgtgtgggcaggctcatagcaataaaatacgggaaatccccgggcttgagtgctgtcaaagaaaactaaatttggacagtagataaagatactatcaggactattgcaatcggcagaaagagacctcagtatagaaaggggctcaattccaaatacagccaaagaccagtaaagatttctggccaaggagtagagtgggggtcagtggatggaaaattactaagaggaaacatcaagggtaaaaggattctggctaaaccgacctgacaggattcttgctgaagacaggccagggtgatcagacctcacctgtggatggtgggagatgaggaatttgatcagatattgagggtgatcacataccaagaggagtggattatcaataaaatgacttagcaggattcctgcttgaactgggcaatgcaaagatggacatgaagccaaaggccgaagcctaggggtgtagtagagcctgattaagttgaattaaggagagtctttgtcagcgctggctctcccagtcactagttgggggggccttgtgcctgtcatcaaagtcctctgaaactcaatttctctgactatgaaataggcattagaatccctcccctgttgccttccagggccactgtgaggctcaaataatagactatttttcaagtcctttgcaagtggtatgatgcaagtgtgagttattaggtatgccaaaacttagtcggaaaaagacgtcaagggcctttttctgaaattattttgtcacttaaatcagacacattctagatccgaatgttagctcctaggctcattttgtgtcaaagttctaatgaagcattaaccatggggctattgttacaaaggaaacaactgcttacggtttcatttcctagaaacccagatgtctattttaatgcaaacctatgcccacatctgtctttgccccttgatgggtggcataatgggaatgatagtaatacagagagctcacatttcttgaccactcaactatcatgctgagggctagatagacatgattctattttggcctcaaagtagccctataaggtagagataacgaaactggggctttgagaggttaaggagcttgggtggctctgaaagctgtgctgaagactcttctgttcttcctagaccaagcccagcacacacgcaataaagatgaggttggatatgatggcttcctactcaagtacaaaggggaaatagtatatcttttctaagaaaagacgtgaaaataattttcaatataagaaattcaaaaggcaaaaaagcacagggaaaatattcaactgtattgagtcatatggcagatcctttgatctagagattacacttttagaaactcttcttaaagaagtgaccatgagactggataaaaaaatgtggcacatatacaccatggaatactatgcagccataaaaaggaatgagatcatgtcctttgcagggacattgatgaagctggaagccattatcctcagcaaactaacacaggaacaaaaaaccaaacaccgcatgttctcacttataagtgggagctgaacagtgagaacacatggacacagggaggggaacaacactcactgaggcctgtaggaggagggtggggcaggagagagcattagggtaaaaagctaatgcatgctgggcttaatacctaggtgatgggttgatctgtgcagcaaaccaccatggcacgtttaactatgtaacaaacctgcacatcctgcacatgtaccccagaacttaaaaaaacaagcaataaaataattttaaaaaaacaaaagaagtgatcgtggacatggaaaactatttaccaagatggtcagtgcagccaggcaaaaaaaaaaaaaaaaaaaaaatcatgtcccatgttgggaaggggtgaattaattgtagtagactcattaaatggaatattatgtaatcatcaaatcatgttttttaaaataatactgaatgacctaagaaagcactcatggtataatgttaaatgaaaaaagcaagctagaaatggrtaagtaccgtgtattcctcatgtttttactgcacctgctaggcaaatactagatgctcactaaatgttggataatctgtgatgatggtttacataaacacatgtgttgcatattctaatttcattcaacatccctactttataaccattttacagttggcaaatcagaggctcatgaggtcaagtgatttatgaaagtcagagagctcttacatgacagaacaaggacttaaaaccaaatttttgtactgacaaagccttggctgttactagaatgcttctcaccatgtgaaatagatgcagggatgggaaattactattagaagggaccatctcccaaaatgtcaatagtggttcagcaaatttaaaagtaaaaatattattctgctcttaacctataggaaatttctttatggctaaaaaaaggttattaagtaatcmatttattaaattaatacaatctgattatttaaaaatttggaacgctgtactaaaattaaaaatcatcattacagattaaccagccagtacctctgcaccccaagaataaataatgtatatccccgaaactcaccgaagtttagggctggggttggcaaactatggcccatgggctatatcccacctgctgtacagctcatgagctaaggggtttttttttaattgttgtttttaaaagactgaaaaatatcagagcaaaattactattttgtgacatataaaagttacattcaagtttcagtgtttacaaatggttttattgtttgagtatttgtttacttattgttgataagtgcttttgcactacgatggcaaactattcaaggagttgggtagtgtgacagagaacctgatggcctgcaaagattaaaccatttactaactggccctttacagaaaaagtacgtcaggccggggcttatagaaaacaaagggataaggtataaggtcaaataggtttgagagccctatggtctttggtgactgttgtgatgcataatagctgttgagttcctaatttatgtaagacaactttatatccttttattcttttagtttgaaaactaagtctgttgggctaaaatgataggaagtaaatgataactctctcctttttttwaaaaaaagcaagtggtttacaaccttgtacttaaacgttttggtgacataatgaaactgatattcatggtatttgtactttacagagattaaactaaaattaaaaatatttcaaaattcacaaataggggatatttgttaataaatctatttgggaaattcctagcagaggctcagtctataaaatgaatagcatttcagcaacttcccttattcacagtgcttggttattctctagggagacatacacaacacatctctagttaccaaacaattcagtgtgatataaacatggcaaaaagtcaatgaatttgagggcaaggtttccagcaatcgccccggccattgcttayttcttccatgccctttctaagttttcttcagccaggcagccatcccctctggtttctcccagaccccygctgcaggctccccgccatcacagaaagcccctcgctcacacgtcttggctcaagcaactctttgtcttagaaatgcagatcccaacatttcctttkaaactcaggcaacttggcttttttctgctctgtgatcttgaaagtcgcttggaggaacagctgagtgcatggggctgttgtcctctcagggctracatgttgtagcccagggggtgcccaggggcctttctgactggttggttagttgggtaaaagagtagagtcaggagagcaggaaatcctttcttaactcactataaaaatamaagcgttccccaggcctcaaatagtctcatctcaagataaatttccttttgccaagawtgctgctgaaaataatccattgtagccagataatagctatgcaaagaatatataatagactggcaggggcatgcctaccgattcaatacagaaaggtgagggtttcatttgctggggtgtagygggtgggagaattccttattgcaatcacactctacttctccatccagaaaactctccaaccctcctggaggactctccattttctcctctttctcctccttgtgtacctacctagaccatctgctcccatatgtcctgtctgacttcctgttccagttacctatcactgcgtaagagatcacctcaaaatgcaatggcttcaaacaacaacaatcatatactgctttctatcatgggtccaggagttgactggactcattaggcagctctcccacagggtctctcttggggtggcagtcaggyggtgactgcgactggaatcacctgaagactcactctccaggtctgatgcctgggctaggagactcaacagctaggtgccgaagcagctgcagctcctcaagtgtctctgtctccatgtggtctctctaatatggtggttgtcgtatagccaggcttcttacaagggtgatgactcaggactccaaagcaagtgggtgagagaaagggagagagggagaaacagggagagagagagagaaagtgtgtgtgtgccagtacgcgcgaggtgaaagctgtattgcctgtgaactacccaccatgtctttcgtcctcttgacaggaaacctcctagaaatgtttgctgtctccaaatccctctccttacgttcttccaagaactttgaagtcatattttatgtagctactccttcaaaacatatctggtgttcggccagttcttacgccctccagcactgctacctgggacttctgcttgaatgactgtaatagcctctcaactagtctccctgctttcacccttgcccctcactgtctattctcaacacagcagccagcagcatccttctcaaatgtaagtcagaccaactgattgtcagctcaaaaatttgcaatgcatctgcattccacccagagcagagaccgccatccatggaatggtagagaaagcccaacatgctcagggacactccctctctgacttcatctcctattgttctcctacaccccctgcttcagcaatattggccccgttgccatttttgtgaatattctagcatgttttcaccttggggcctttgctccaggctaatccatctgtctggaatgcatttcccctggatgtctgttatggatgactttgtcctttccttgaggtctttgtttagatatcaacttcttaatgatgcctatccaagctgccctatttatcgtcacaatcctaccccacattcctgatccttttcactctgccctgttttctttttcagtaacacttatcacttgacatgcaatatcatttctgacagttatatatttttgtgattatttagagaacataagctatagttgagtggaaatcttttctattttgtccactgatgtcccaaacacctagagaagtacctggcatgttgcaggcatcaataaatacttgttgaatttttcctttttcacaatttccttctacgttgttatgatgagatcttatttcctctgtaatttgattttaaaagttttaataaaaaacaatacatattatttatgataaaaagtcaaagagtagagaagggtataacataaaaatagaagtccccctcttcccagggaaggcccctttataccactgcccagaagaaattgctattaaaggtttcttgtgtattctttcctacttttctctgcaaatacaaatatatgcatatatatttatcataaatgcattatatgttatatgttattttaatgctgctttaaaaatcccctttattttttgtaacttagtagtagatcatgcatagctttttatgtcgatacccacagctctaccacattctttttaagggacatttgatattttactattggtagtttcccatttttaaccattctctcaaatcaatggattgtcatgtaattcttcctattcttactatttcagaaagctgaatcaaactagcaaaatagttttatctaaagacatataaggccgggcgtagtggctcttgcctgtaatcccagcactttgggaggctgaggcaggcagaccacctgaagtcaggagtttgagaccagcctggccaacatggtgaaaccccgtctctgctaaaaatacaaaaattagctgggagtggtggcggctgtctgtaatcccagatactcaggaggctgaggcaggagaatcacttgaaccgggtaggcagaggttgcggtgatccaagatcrggccagtgtactccagcctgggcgacagagtgagactctgtctcaaaataaataaataaataaataataaagacatataatgcttactttaaagaaaaacaaaacaaaacatgtactagttatttttttcctccctctgtggaattcttagaaggtttatggtagtttgaagctttgcatggaccattttgaaacagcagcagcctgaggttccagggggttatgaagactcccagctgaggacagaccctggcagataagtttcagggggctctacaccaaccattagagtcatagaataagcacaatagaaaaggaccattaaggtcagttagccaaactccagagtttgttgatgagaaagtcaaggttcaggataattcagttggtagccctgtagcagacagagagactgaaaacaaatctgactttcagttcacgtggtgctaacccctagaataaataaacacgaggagaaatcagactaatcccagtcttcttctaacttgtcacaagacacaaaccacttaccttcacttcctcattttttccatctaatagttcccagttatatacatgtccttctcactcctctgattgcaaccagacatctcttacaagtttacaaagttttgaagataaaaacgctatttggaaagcgtaaagttaaaaacagcttggtaaatgtttttttttttttctattagtaattcgatctctacaactgtaaatattgtggtaggaatctaatacagatctaaaatcagtaaaattcaatcttgaatatgggcttcagtcctgccatcaaaatagtgcatccaggtggataggttttgccaccttgaagagttgtttattcaaacttttgtttgaagagkaggaaagcagtgttacctttaggcctgacttagcccttgccccacaatctattgttttttctcaccatagatttccctgacagcagagagagagttctgtgctcaagagatacacacagcttctgacaatagagcagcagagtatttggttcctaattgagcaggaatggtgtttgactcatcatcatttccctactttgtctagcacagtaccttgcacagagtagattctcaataatgtttgttgaatgactgtgggagcatataattcataatggagacaaagctcaatgaggctttaaatttctaaatccacaaaatgccctcatgtaacattgctggatgatatggtttagctgtgtccccacctaaatctcaccttgaattgtagctcccataatccccacgtgttgtgggagggacccagtgggaggtaattgaatcatgggggcgggtttttcccatgctgttctcatgatagtggataagtctcacaagatctgatggtttcataaacggcmgttcccctgcacatgctctcttgcctgacgccatgtaagacgtaattttgctcctccttcaccttccaccatgattgtgaggcctcctcagtcatgtggaactgtgagtccattaaatctctttttctttataaattacccaaactcggatatgtttttattagcagcatgagaacagactaatacaatggacattggatgcaattcatttaaaaaatcatcttaaaaatatctttcttttttctccctcaagttggtcccactcaaaacataaacacaccatttttttttttttttgtcttgagacagagtcttgctctgtcacccaggctggagtgcagtggtatgatcgtggcttactgcaacctctgcctcccgagttcaagcaattctcctgcgtcagcctcctgagtagctgggattacaggtgcatgccaccatgcccggctaattttgtatttttagtagaaatagggtttcaccatgttggccatgctggtctcaaactcctcacctcaggtgatcctcccgccttggactcccaaagtgctgggatttcatgtgtgagccagtgtgcccagccaccattttttaatacttgtaaatttttcctataaaaacaaaccaatttctctatgccccaaaaccsctaagtagcacaaaatagaaacattagagtaccaagaatacttgaactgaaaaggaaattaatcaaaatgcagacacacattataccaagtgcatttgctgtagctgtgtaaggcaacttgaatagaattggtcaacaatgagtctgaatcttggtttgaaattgcctgtctgatctctgcttcctcatcagtaaaatgagaatatttatatggcctttcaacttcagtgtgagggatcaatgatgtaatataaacaacaagtctgccttagaacctggcacaccataagtaataaaaggcagccaatattttaaaaaatacacaaatcatggtctgatggctgtccaatataaattctctattttccattttaactaaagagacgatatattgagaaaatagaaacacctgtgtgtatgaaatcacccattcccatttttacaataattagtttgctaattgagcatccaaatttacccagtgtatttgcatgtgtaattagctgtgattcaataccaaagccaggcctatcatggtatactatgctattttacaagtcaaattactgaaagatgcatgtctttaggcaatcattacaaataaaaaaaaaaaaaccgaagcaaaacaaaataacatagattatttgtatcagatggacaaaacagacctggcttgatgccgaacccttaaatctcaaaataacgatagttgaagctaaggttccagcttaagtctgaagcaggtagtttccaatggcttgaaaggagaaatttctacactgaaggaaatttccattggaataaaggaatatttcacacttttaagtcatcttctctagatggtcttttgggtatactttctctttaaataacagatttagaagcactttgttcatttgtttagaattaattccattcacaagtttaacacagcctaaggtttggtctagaccaggggtctgccagctatgacctctgggctaaatctgtcccttcacctgctttttttttttttttttttccaacctgtgagctaagaatgggttttactattctaataaatagtgagttcatttttctccctcacctgcttgatcagagcccaactttctcattgcagttaatcttccttctggcatggatcttggaatgcaaacttgctgggatctccgagttccaggcttcccgtgcagccggtgtggagagccaagagatgttttgtttggcataaagcattccaagggtcagtgggcttgggctcaactattgagcataggacaagggcagccccatcctgactgtgactcttcccacaagagacaaacgagctctgtgctttcactggggtttcaggttcaaagggacagagcgtctgagaaaaaggattatgaaagagtccgtctgcagctccacttcccgtgcccttccaatgataccatcctcgtttcttctgtggcatgctccccacttcaatccttccttcagaggccccaaaccctcctggtctctccttgtcaccttgtgaaaatctgatcttcagggaaaaattccttactatttatactagtataatgtgaatcttctatgggattttaagaaagttcaaagccttggtttactcagcaaatatttagcttgcactcactatgtggcgggcatcctaatgayggagtatatgtaaagacaaaaaaagtttccggacctcaaagtgttctccatctataggggcagatgactgagttgacatctcgagaagtagaatagcagagtggctaagagtgccagctctgtctcaatcacctaggtctcacctcagcattaatttcactttcctcattgtaaatgagcatatctcttagaattgggataagcattaaataatatagacttggaatgaatttgcttagaactaattccatgcacaagtttatcacagcctaaggtttggtctagaccagaggtctgccaagtatgacctgtgggctcaatctgtcccactacctattgttgttgttgctgttgttttttaatgacctgtgagctaagaatgggttttactattctaattagttacattctcaatggttatttaagtacctccataatatcctcaattttgcctaaaatatttaccatctggccctttacagaataagtttgctgacttattggtctggaccaatgctatctaataaaactttctgcaatgatgaaaatggtctctatctgtacccttgaatacagcagccactagcctaatgtggctttttgagctcttgaaatatagttagtgtgactaagagattgaattttaattaatttaaatttatggagccacatgtgactatgacattagagcagctctagacagcctgaagtctaaagactctatgctttgtcggtgctcccctctctcaattgaatcaactaccctgaggctgcatgagtcaaggggaaggccacactcttcaatcagattttttgccctggactggctttcattgtctactagaaaatgcttaatgggaagtgcttagaaaatgtacatgggcatacacttaattaatctaagttgctgytttgtctgtatccattaaatctgctttattttggggtaaactacagtagaagttggctttttcaaccctgcaaagccttaaaattcaggatgtcttactcaacttaaagtgtagagttgcagccagagcacaactgtatttccttctagccctgcttgcagaatggctaacttcagtcctatttcatttctcttgtaagactgctaaaaacagtaagaagccaccaacatcattatgaatattgccaaatcatttcgcctaagagtaaagtcacagttggcatgtgttctgccctccaagacaagatagcataggtgacagttttatcagatatcttgtgatggcataatataggccacccagctttccagcctctgatatctgagtcttcccaatagcctgatgacatccgcatcacatattttaggttcgctcatggacagtaacttatttccaaattctatactggttaaaattaggtttgcatttgtgcaatagaaaatccaattgacattggcttagcataacaattttttgatttctcataaactcttggcagtcagcaggtccaagccattatttctgctctgctctctgaggtcatataaggaaggatctggatgctctgggtcatctacgtcatctaactggttgctgtgccatccctagctcatttttctcatgtgcattgcccaagatggctggctacaacatccacattacaagaagccaggtggaagcagacaggagaaagaggagaaaggggaactgccccaccgtttaaggacatgtcccagaaactgtacacctcacttcctcccaaatttcactggctatcacttagtcatatagccacacttagctgcaagtgtgtctgggagatataattatttttcacagtggtatatgcccaactacaaatggaggttctgtcattatgagatgagagaaaggcagaaaacatgttgagagatgtgtagcaatctctggactcyacggggataaaaaagaattgagagtatcaaaattcaggatcaaaatcaaaattaaagataaaaaatatcaataactatcacctggaataagaacaacgtacagttcagctacacatatacaagtggcagcatcttgtctggaaggaactaatggtctttctacattgtattttagatatgtatttttttttctcccttccacaggattttgagctccttaagggcagagactttgtgtctcctgctcctagtaggcatccaacacgtatctgtcaactgaaagaatgaatatgagtcagtagatacatattagaattctaatatccactggctgggtccttggtgtgtcccatattgttgtttctgtgtccatcattcttttgcagggtatcttctactgggcacagaacctgcctcagaggggcatatgggtaatgaactaccaagaaaggagtagaacccagttcttccaaccctccacccagagtgcttttcacaacctcatgtgtaataagtgcagtaggagatgagaggagggagtgattacttctgtctggtttgatcccagaaggttttttgaagaaagtgtttttgaatgagacattatgaaaacagagcttcttaaaccttttcccccaaggaatccctgggcagatagaagagacagaaatctgacctctgcttagtctgggggtatagactgaaggaacctactcaaaggagaaatttttctcatttttctttacttcacgattcatatatgcaggcattcattctttcattcatgtatctcacagacataacgaggtcctaattaagtgccaggcattgttttacatgagaccacaagaggccctaccctcttgcagcttacattcttgtacagaatagacatcatacgaataagcaacataaatcatcaagataatttctgaccgtggtaagggctatgaccgaaatcaaacagggtagtcagttacagagtgcatatacctctctgtgcctcagttgactcatctgtaaaatggagataataatagaggtctaggctaggcatggtggctcatgcctgtaatcccagcactttgggaggccgaggtgggtggttcacttggggtcaggcattccagaccagcctaaccaacatggtgaaaccccgtctctactaaaaatacaaaaattagccaggcctggtggygcatacctgtaatcccagctacttgggaggctgaagcaggagaatcgcttgaacccgggaggtggaggttgcagtgaaccgagattatgccattgcactccagcctgggcaataagagcgaaactcagtctcaaataataataataataataataataataataatagtctataattccaaaacccaaaactgaaagctttgtcctaactcagttgattgcaaacataatatgatctgaatgcatttggaggtagatcttgacctgaactgaagttatttattctttttaataaataaatgagttatttattctttttaataaataaatgagtcatttattctttttaataaatgagttattctttttaataaataataaactgagttatttattctttttaataaataataaataactgagttatttattctttttaataaataataaatgagttatttattctttttaataaataataaataactgagttatttattcttttttttttaataattccacttagagtggacaatcctatatgtcactgcrgaaattttgtgtgtttgattatggaatgctgccccaggcctcaatagttattacataatttagggtacatgtagcgtattaccttctaaaatttgaaaaattccgaattccaaaacacatgtagcaccaaaggtttcggataagggattgaagacctgtagtatccattattgtgaggattaaatgaatgaatatatggaaaacacttaaaatgatgcctggcatgtggtaagtgctacgtaagttaactactattactattattatcactattcttacatgagaagatatttagataagttggtcagggaaagcctctctgaggatgtgtcacttgaataggcaactaaggggtggtaatgaccgggctgtgggaagaggaggagaaagatgatttcaggaataggaaacagcaagtgccaagactgtggtggttacaaggctggcttgaatgcagaacagaaaacagaccagatggctgatatgtggtaaaggaggggaaagatggctcaaggtcagagaggtaggctgaagtcagaacacccttgatataagcaatggtagagactttggatttcatttaaagtgtaataggaagacattatagttgatctgattcaggtttataaagaacgctctgatgctgttggatgaatgaattatagaggagaagggggagcagggagagcaatttggagtctagcatagtggtccagatgagacctaatgactaattggagttgggaggtggtaatagtcaaagagaaaagtggacaggtgcgagaaaaaagtttagaaataagtggggggcgggggaggttttctgattaatttgcattctaatttataatatgtcactgtgtagaggctaaaaatttcacagtcattgtctcaggtgtgttaaggccagtggcgtgctggaccccacttgaaattggccatggagggaatatttacactatagaaattgacaaatgctacaaatcaagacaacaaatcaggcaaagcttcttgttaaacatttaccatcacaccactggtgaaggtgacttgatttttccacaactaaacttccttcatttcacagcctccattttccctgatcacgaaaacacttaaactaggcacatcctcggaaacgcagtatgaggactgctgtgtcaatcacttcatgtttttaactcaattcagcgatcctcccacttcttcccaggctctcatttaggtacatgggaatgggatgggaagagggacctggttcatgattgtcatttacccaccttggccccctctgaagtacaactccactctctgctttacaatatcactctgggcagcattaccaattgcctcctgatagtgggatctatgaacccattatgtctttggacaaaagcatagccaggggttgggtccagggcctgggatcctataaccgtacaaatcctattatcagggactataaaatcctattatcagggaccatagccatccctctatcttgactcaactcctcctccctgagtagtgaacatttttcctaaatctctgagaaagactggtgctctagaaagatgtaccatatttatttaagggcttcctgtacccactggcatattgccatatattctgaggtatctgagtgctccttttgagaaacatagccttaaaggataagtagaaatctggtgggtgaaaatggtagrgaagaggacttctaacggagggacttgcaagtcagggaacttgggtttatcgactagtgaggctagtagaggaattcaatcaggtaagccrgacaagtagacagggtacaaattatggaagactttggatgccatgataaaaagcttcagctcatactgtaaaaaataaaataaaataagaaggttgggtgcagtggctcatgactgtaatttcagcactttgggaggctgaggtgggacgatcgcttgagcctgggaaacaatttcaaggagttcacagcaagaaactgactgattaaggtttgggaagcttgatagatagggtagactgggaaagtgagagaggaggctttggagtggaccaaggatagagggatctcagctgatattatgtcagctaaaacctcaaagcaaggaggatgttaagaacaatgaaggaggtcagctggactctcaatgtttttaacgatagggaggaaaagatagggkggtgacaagaagaagagacaattttgtacctctaactccaacaaactttagacctgaaaaatcccttctgagccatcttgcattggagaaaaaaaattgcttatttacctccaattagaggaattaagggaagtaggatttttttgtttttcttttgagacagggtcttgctctgtcaccctggctggggtgcagtggtgtgatcacggctcactgcaacctcaaactcttgggcttaagaggtcctcccaactcaacctcccgagtagctgaactacagttgtgtgccaccatgcccagctaattttttattttctgtagagagaggggtctcacgctatgttgcccaggctagtcttgaactctggcctcaagcgatccgcctgccttgtcctcccaaagcgttggtattagaggcatgagccaccacatctggtggaagtaggcatttggtttcttagataacaacatgattggttgattcagtcacttgggaagataaaagcattaactgagctagatccctatggtagagacacaggctggaccactccatgcgtaagtactaaactaaaaccagtgttctggagtagacattgctagaaatcctgaaacttgagagccagtccacggttaaagcattctgtaaggcagagccagtggaaggtaataaggtgatttttaaagctcttctgcacttcccatattcccttttagggcctttctccctagggtcccagtgtctgtcatgctaaacctagatgcacaacaatcatctttatgggtagtttcccatatgtcccagtttgcctgacagactcttggtttatgcctatagtcttggtgtaattattaccagccccacttcattcttgtaagtatactaatggatcagttatacggttcctctgattatgtatcaccyaggcagtgccctgactctactactatctcctctccaaatttatgtaatgtaaacccaatgtgtagggaaaatgctcatcctaaaatctccttggaggggataatttgcaagattctttgcaaaaacaatccaagacaagagccagattayggaatgtcagtgccagaatggcaggaatgtatgttttctaatcaaatgccacttactactgggtaaccttgggctaatcagttaatattgctgagcgatgtcttcatttgtaaaacgggaatcttagaatattctgagactcaaatactatgaaagactcatgtaatgtgtaccagggcaggtttagcaggccgacataaattgcactaaagtcttcatgtgttatttttcatgggtgtatccatattctaacatttcttcaccctccaaatttcagactttggcagtgaatctatggctctgcaattttagtgttccatgtaacaacgaataggaaaatgctgcttctaccctctcgaaagctattttgctaaagagctaagatgctaaaagctaaatatgtaactaaatagttgcaaatctcagtaactgacaaatacagtcrtggggttggggatgctgtttagacagctgaaaataagacctgaattgtttatttttaaaatgttgcaaaagagaggcagcaaatgggaatttttaattctgattcttggtatgttttagaacaatgatttgttctttcttatactttcaggtgtttccaatgtggacactgaagagacwaattcttatcctttttaacataatcctaatttccaaactccttggggctagatggtttcctaaaactctgccctgtgatgtcactctggatgttccaaagaaccatgtgatcgtggactgcacagacaagcatttgacagaaattcctggaggtattcccacgaacaccacgaacctcaccctcaccattaaccacataccagacatctccccagcgtcctttcacagactggaccatctggtagagatcgatttcagatgcaactgtgtacctattccactggggtcaaaaaacaacatgtgcatcaagaggctgcagattaaacccagaagctttagtggactcacttatttaaaatccctttacctggatggaaaccagctactagagataccgcagggcctcccgcctagcttacagcttctcagccttgaggccaacaacatcttttccatcagaaaagagaatctaacagaactggccaacatagaaatactctacctgggccaaaactgttattatcgaaatccttgttatgtttcatattcaatagagaaagatgccttcctaaacttgacaaagttaaaagtgctctccctgaaagataacaatgtcacagccgtccctactgttttgccatctactttaacagaactatatctctacaacaacatgattgcaaaaatccaagaagatgattttaataacctcaaccaattacaaattcttgacctaagtggaaattgccctcgttgttataatgccccatttccttgtgcgccgtgtaaaaataattctcccctacagatccctgtaaatgcttttgatgcgctgacagaattaaaagttttacgtctacacagtaactctcttcagcatgtgcccccaagatggtttaagaacatcaacaaactccaggaactggatctgtcccaaaacttcttggccaaagaaattggggatgctaaatttctgcattttctccccagcctcatccaattrgatctgtctttcaattttgaacttcaggtctatcgtgcatctatgaatctatcacaagcattttcttcactgaaaagcctgaaaattctgcggatcagaggatatgtctttaaagagttgaaaagctttaacctctcgccattacataatcttcaaaatcttgaagttcttgatcttggcactaactttataaaaattgctaacctcagcatgtttaaacaatttaaaagactgaaagtcatagatctttcagtgaataaaatatcaccttcaggagattcaagtgaagttggcttctgctcaaatgycagaacttctgtagaaagttatgaaccccaggtcctggaacaattacattatttcagatatgataagtatgcaaggagttgcagattcaaaaacaaagaggcttctttcatgtctgttaatgaaagctgctacaagtatgggcagaccttggatctaagtaaaaatagtatattttttgtcaagtcctctgattttcagcatctttctttcctcaaatgcctgaatctgtcaggaaatctcattagccaaactcttaatggcagtgaattccaacctttagcagagctgagatatttggacttctccaacaaccggcttgatttactccattcaacagcatttgaagagcttcacaaactggaagttctggatataagcagtaatagccattattttcaatcagaaggaattactcatatgctaaactttaccaagaacctaaaggttctgcagaaactgatgatgaacgacaatgacatctcttcctccaccagcaggaccatggagagtgagtctcttagaactctggaattcagaggaaatcacttagatgttttatggagagaaggtgataacagatacttacaattattcaagaatctrctaaaattagaggaattagacatctctaaaaattccctaagtttcttgccttctggagtttttgatggtatgcctccaaatctaaagaatctctctttggccaaaaatgggctcaaatctttcagttggaagaaactccagtgtctaaagaacctggaaactttggacctcagccacaaccaactgaccactgtccctgagagattatccaactgttccagaagcctcaagaatctgattcttaagaataatcaaatcaggagtctgacgaagtattttctacaagatgccttccagttgcgatatctggatctcagctcaaataaaatccagatgatccaaaagaccagcttcccagaaaatgtcctcaacaatctgaagatgttgcttttgcatcataatcggtttctgtgcacctgtgatgctgtgtggtttgtctggtgggttaaccatacrgaggtgactattccttacctggccacagatgtgacttgtgtggggccaggagcacacaagggccaaagtgtgatctccctggatctgtacacctgtgagttagatctgactaacctrattctgttctcactttccatatctgtatctctctttctcatggtgatgatgacagcaagtcacctctatttctgggatgtgtggtatatttaccatttctgtaaggccaagataaaggggtatcagcgtctaatatcaccagactgttgctatgatgcttttattgtgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctaaagaacgccctggccacagacaatcatgtggcctatagtcaggtgttcaaggaaacggtctagcccttctttgcaaaacacaactgcctagtttaccaaggagaggcctggctgtttaaattgttttcatatatatcacaccaaaagcgtgttttgaaattcttcaagaaatgagattgcccatatttcaggggagccaccaacgtctgtcacaggagttggaaagatggggtttatataatgcatcaagtcttctttcttatctctctgtgtctctatttgcacttgagtctctcacctcagctcctgtaaaagagtggcaagtaaaaaacatggggctctgattctcctgtaattgtgataattaaatatacacacaatcatgacattgagaagaactgcatttctacccttaaaaagtactggtatatacagaaatagggttaaaaaaaactcaagctctctctatatgagaccaaaatgtactagagttagtttagtgaaataaaaaaccagtcagctggccgggcatggtggctcatgcttgtaatcccagcactttgggaggccgaggcaggtggatcacgaggtcaggagtttgagaccagtctggccaacatggtgaaaccccgtctgtactaaaaatacaaaaattagctgggcgtggtggtgggtgcctgtaatcccagctacttgggaggctgaggcaggagaatcgcttgaacccgggaggtggaggtggcagtgagccgagatcacgccactgcaatgcagcccgggcaacagagctagactgtctcaaaagaacaaaaaaaaaaaaacacaaaaaaactcagtcagcttcttaaccaattgcttccgtgtcatccagggccccattctgtgcagattgagtgtgggcaccacacaggtggttgctgcttcagtgcttcctgctctttttscttgggcctgcttctgggttccatagggaaacagtaagaaagaaagacacatccttaccataaatgcatatggtccacctacaaatagaaaaatatttaaatgatctgcctttatacaaagtgatattctctacctttgataatttacctgcttaaatgtttttatctgcactgcaaagtactgtatccaaagtaaaatttcctcatccaatatctttcaaactgttttgttaactaatgccatatatttgtaagtatctgcacacttgatacagcaacgttagatggttttgatggtaaaccctaaaggaggactccaagagtgtgtatttatttatagttttatcagagatgacaattatttgaatgccaattatatggattcctttcattttttgctggaggatgggagaagaaaccaaagtttatagaccttcacattgagaaagcttcagttttgaacttcagctatcagattcaaaaacaacagaaagaaccaagacattcttaagatgcctgtactttcagctgggtataaattcatgagttcaaagattgaaacctgaccaatttgctttatttcatggaagaagtgatctacaaaggtgtttgtgccatttggaaaacagcgtgcatgtgttcaagccttagattggcgatgtcgtattttcctcacgtgtggcaatgccaaaggctttactttacctgtgagtacacactatatgaattatttccaacgtacatttaatcaataagggtcacaaattcccaaatcaatctctggaataaatagagaggtaattaaattgctggagccaactatttcacaacttctgtaagctttattgtgtttcatagtttccgttcttcttctgtgagaacaaggataatggcattaaaaaatcagcttttggtcattataaattgtcttctattaaaacacatatacacataaaatcacttgaagacaatttaaacatcttctgaaatggatcaagaggaagggaaactgaaaataatgcaactcagaaaccacagagtattttgacatgaggttaagcaccgtggtttgttgtaggaaaataacagcacaccaacagatggtttttatctgaattctttggtaatcttgacatgtcattcttctaactttctgagggccctcagtgcagttttgtaggactggagctgttcacagacggtccccacaaagctctgaacgtggggcttctctgctgactggcctctggttggctccaccccggaaggaactcccagattctccatgaattccgcttccaccatcaagccttggtccaagcccctttcaaccttgacttggccaggaagtgtcctttctcttcagatagatactacaccttagcaagacttggcatttttagaatccaagccaagggaggcacttggcaaggcaaatgttatggatgagaaaaaggcaaaacaagtgtctgcagtttgtagaggagagagaggatgagtctgattgtagccctgaccctgagtcaggatctctcggccccatttgcaggtctacttccagctccatctgtctggacactcttttaggtccagatcatctcttacatgtggccaaggaatatagagtatgcaaggggatgtagcgacctgagagtgtgagtaacttgtgcccatctccaaggaagctgtgatggggatagcaaggacacacactcttcttatttataatgcctttccccctcccatgagatatgctttttatttacttcctccttctcatcctaagtcgggtgaacaagaggaccaggttgcacatcctactacttatttatggcccaattttaacatgggggtggagttgaggttggaattgttcctccgcctctgctgcacatgctcagtaagcaagaacactgttgatgggaaaggcttagtcacagacagtgggagcacatccctccttggagctttgggtcgctgtgctccagaaacagttagttatagcacaccctgctcctggcatctactggaaggtgaagcccttgaccctaagaaacattgggaatgatttgtaccctccaaagtccaatagctatgtcggagggaaacgatcaaagaacatgattgaggagactcaaacagagatgtgcttcagacaacaccaagacagaaaattaatccattttaccaagttaacaatgtactgaaggcgaacaagagaccaacccacctgccaaccaacgctatgaagaaggagggttgatcagtctggctaacatggtgaaaccccatctctactaaatatacaaaattagctgggcgtggtggcacactcctgtaatcccagctactcgggaggctgaggcaggagaatcgcttgaacctgggaggcagaggttgcagtgagctaggatcaagccactgcactccagcctgggtgagagagtgagacttggtctccaaaaaaaaaaaaaaaaaaaaaaagaaggagggttaaaaagagaataagtcccaaactcataagatggtgtggaaagggccctggtgacataggggccacccatgccagtgagaatgaaatcacaacagggcagtttcacactgtttcaggtttttattttttcttcttcttctttccctcctttcttcttttgcctccccctccctctcagtttcctttttggctctagacacccacagcaagtgtcaagcaatgtacaagaatgaaaagaagacagccgttgttgcaggtggatgcttctgtttggaaggtgtggttttgtgtgcacttttggttggaaacctatgtctctctcacacacatgtcccccacctgcttcagtgagcatgatcttctaaaattggctccgtggaatcttccctaggtgacactggctggactctgacacattcaaattcattctttctacttatctcaactttcaagcactaattcagtctttaagattcccctaatctcaggttgtaattcatttctaacatgtttgtcatgacatcagtggttgcatgtcttcatatgtttatcactgccccctcttgggaatttatattaattaaacattttggaaaagctcagacttaaaatgactgagaaggttcatgttacagtgtctcacactgaacactcactaaaaatagtctggtaaaatccagaaggaaatgggaagtcctgggggcctcatggcagttttcagacttccctagagcaaagatgagccagacagcggctcccacaaacagaaaatggctctcaatattcttctggccagtggcaactactgagggtaaaactagacagagacggctaactaggaagccatattgctcttgtatgacacatggctgctttacttctcactggccaaggcaaaaccatgaggcattgattccaggggatttcataacagtgaattgcatgagttgacttgagcaaaagaagtttgtagtaacatctccatgaaccatatctgaggcccattatccagggggaccacactgctgagaagattgcttgggctgttttgggagccagaactaggttgttgtcctgctatcaccctgggatggtggttacatccctgcaccaggtccagatggaggcccaccaaacagaacttagtaacaggtgacatgcattaaataaaacagtttatagctcccatctctcttctgggcctacttttctcatgattgatttctttgcctttggattgaggcattgtaactaaaattcccagttaatttacaacgttccaagggttgtttcaacacatcactcctgtccattaacacattgtgatggattaatttgtgagatgatcaactctccagaacaggccacctaagaaaacagaacacaggaagcatgttctgaatggagaagatgcattttaaagtaatcccaactttggctcctgctcatgagggcaggcccacaaagggaatgacaggcaaggagggagtgaggaggatcttaggaagaagggctcaagatgaagtcactggtatcccgacaatgtcattcagtaaggggtggaggggaaggaggaagggaagtcacatctattaagcagcaaatgcaaattaaatgcttcctttattcccttgaatcttcacatcacctctatgaggctagtattagcagctccatcttaaagatgatgggttaactcagagataaaggtgagatcagagaggcaaagtcaactgctcaatctctgggacccaggagtccgcatccctggaatacttttgaagcaactggcttgcagagcagtttgggaagcaccacatcttcctttgtgacaccagggactgttattacagggatcactttagtaaggaaagcccagacccccaagctgtgctcaatttccttccttttgtgtataaactttggtgctctcaacctacttcccgggagtggagctgcacttaaactcaaattgcttcccgctgggcactgtttttggacaggtataatttaactatataggactggcatttctgtttagggcccaaaggtgaagacaatttgaacaagaacactagggcagaattagatagacaggggcaggtggttaatggaattgaagtctcgtaagtcctgatagagttgctgattacatttgtgggtaaaaggatgtctttaccgtaacttccataacatcttactgatagacgctgtggttctacttatgtggcgccaagcgccacctagtggggtgggaaatccctcctggatgctgatgttctgcttctgagacccttagacgggcttccaaagggggatgtgggaagaaaatgtaagaacagatatagtcatgtttttaaaagtatgtctgtggctatttttatcatatacccagtgtattaatacagaaatatgtagggctgtgtgttgaatgtttactgatgggagggcagtttacaaagaagttgaaggccacagactattgaatatttgtttctatcatttatttccattgtttttgctttaagtctcaaaatggggccagtcatgaatttccttttgcccatgcagatgtagatgtatagccttgagttaactgggtgaccgatcctctttttcctacatttccattttttatagactgtggcccccattttaaaactgtatttgagtatcagtaatctttcttgcacattctagctgaacattctctctctctcatatttccgagcaatccaaccactaaccattcccttctgtcaccaccccccgccctataaatagcattttgaagcatgcagtaacttgccagtttgaggatttaggtctttttcatcctgcttgcctacttgactgtcagttcatgaagacagttggtgaacaggcatgatgcttgggtgtttcacgcccgttaattaagtcaaagatgatggggcgcttacttgctaagatatatatacatgtacacacctacctatgtattctgtatgcacatatatatagctgtccatatatgtttgtgtatatgcacacatatacatgcaagcatgtatatatttgtgtgtattagaattactgataattagaattactgaattactgatggccatgttttgcatagattaattgtaaacctaagtaagataaaccataaaaagtactcagcacagggtctgacatctatcaaacactccataaataactttttaaattctttttattactttttaaattctttttattactttttaaattctttttattgctttggatatctaatcaagtatataatcttttttttttttttttttttgagacagagtctcactctgtcacccaggctggagtgcaatggtgcgatctcagctcactgcaacctccacctccgagttcaagcgattctcctgcctcagcctctccagtagctgggactacaggcacacaccaccacacctggctagtttttgtatttttagtagagacggggttttgccatgttggccaggctgttctcgaactcctgacctcaggtgatccacctgcctcagscccccaaaatgctgggattataggcatgagtcaccgcgcctggctaatcaattacataatctcaagaggctaattctatattcttcatacagtgaaaatttttaacatttttcttttagtatacagtatctgggaaattttttctactcatcacttactctgtacataaagtttatgttcaacatttcatgtactatattcatacattatttaacaatttttttaatttaaagggtgacactcaacttattgcttttccatttgttacatattctcaatcaaaattcgttttctctagatttaaatccatcaaaatttccagaaatgtcccagatacccagacgtcctgtaggctttaaatataatttttcatcttcaataatcttctatttaccataagaatgctgaccacttcctgcttgtagcttatctgaggaaagtcccttttagttgatccaagttcccagatttccccaattctgctttttcctgtgatcccacaagaagttccaaaagtatgaagtagcgccaaatgttaacttgcataaaaccctgtgatgatacttgtaagcatcagcattgagttcttcctgttcctacccacccctactcctgatttcctcctgactctgggtataattggtgttctccatggtcacatgtgagtttaaattcttccagatgttttgataaaacttcattttaaaagccatgttgaaggagaccatagcagagtttgtatgcaaaggtatggagtggtttcttctgagaatgggcccagcagggcttacctgcctat

SEQ ID NO: 10570 - DNA, 30135 bp, Homo sapiens
  misc_feature (1)...(30135): n = A,T,C or G, or insertion/deletion polymorphism (see Tables 1-2)
ttttaggaaaggaaagaccttacagcccccagacccacacctgtgaagggtctgtgctgaggaggagtagtgaaagagggaggcctctgtgtggttgagacaagaggaaggtttctatctcctgctcatccctgggaatggaatgtcttggtgtaaagccgaccatttgttctattctgagataggagaaactgccctgtggctggaggcgagatatgctggcagcaatactgctctgttactctttgctacactgaaatatttatgtaaagtgaaacataaatctagcctacgtgcacatccagacacagtacctttccttgaacttattcatgttacagattgctttgttcacatgtttccctgctgaacttctccccaccatcaccctgttgccctgccacactccgttcaccaagatagtaaaaatagtgatcaataaatactgagggaactgagagaccagtgccggtgcaggtcctcgtacattgagtgccggtcccctgggctcactgttctttctctatattttgtctctgtgtcttatctcttttctcagtctcttgtctccacctgatgagaaatacccacagatgtggaggggcagacctccttcattaactccaaaaggagctctcaaaaccatgcaaatatataaaaattaaataacctgctcctgaatgatcattgggtcaacaacaccgtcaagacggaaatttaaaaaattctttgaactgaatgataatagtgacacaacctatcaaaacctctgggacagagcaaaagtggttctaagaggaaagttcagagcattaaatgcctacatcaaaaagtctgagagagcacatatagataatctaagtcacacctcacagaactggagaaacaaaaacaatccaaactcaaactcagcagaataaaagaaaatagaagatgagagcagaactaaataaaattgaaacaaaaaaagaaaaatacaaaagataaatgagacaaaaatctggttctttgaaaagataaataaaatcgatagaccattagtaagattaaccaagaaaagaagagaaaagatccaatttagttcaattagaaatgaaatgggagatactacaactgataccacagaaatacaaaagacttttcaaggctactatgagcatctttactcatataaactagaaaacctagaggagatgggtaaattcctggaaatatacaacctcccagattaaaccaggaagaaatagaatcttggaacagaccagtaacaagcagcaagattgaaatggtaatttaaaaattgtcgaaaaaaaaagtccaagaccagacgaattcacagctgaattctatcacacattcaaagaattggtaccaatcctattgacactattccacaagatagagaaagagggaatcctccctaaatcattctatgaagccagtatcaccctaatagtaaaaccaggcaaggacataacaaaaaaagaaaactacagaccaatattcctgatgaacatagatgcaaaaatcctgaaaaaaaaaaaaactaacaaaccaaattcaacaacatgtcaaaaagataatccaccacgatcaagtgggtttcataccagggaagcaggaatggtttaacatatgtaagtcagtaaatgtgatatgccacataaacagaattaaaaacaaaaatcacacgattatctcgatagacacagaaaaagcatttgacaaaatccagcatccttttatgattaaaacccccagcaaaattggcctagaagggacatagcttagttgtctaaaaattgcttgccttttcatatttttgacctatttgtatttcttccttttctttttttctatatctgtcacatatatatttacaatacaggtttttatttgtctcttactgatattttaaaatgccatggttattaaatctttgctttttgtcttataaatatttcccacattttaaaatttgtgtttaatatttgaaatacagttgaaaatttgctttcgtaggggaggagaagttatttttatctacctttcttaggtttactggtggggctgactccggtaacaaaagaaaaattcacaagagaaacatgaacaagtttattaaaatgtatactgcagtatacacgagagatgctcagtatacacgagagatgtatacacgagagatgtatacacgagagatgctcagggaatgagtaattcccaaagaggtaacctaggcctccagcttatggagcagcttcaaagaagaatggtaaatttttagaggataacaagacaaaggaaaaggacaagacaaaggaaaaggacaagacaaaggaaaaggacaagacaaaggaaaagtttctggggacagcaaattgtgggaaggctaataaatggcagataaaagctagttgggaggggttgtttcatagattcctctgatgccatctcctggctgttaatttttgtctttcttggtgtggggaggaggacacaattgtcttttgtacatctatctcctgcttttaggcaaattgaggaaaggcaggtaacgttttctttatctgcctcctcccagttgcactcagttcaaaacaatttttatgttaaagagatatatttttgtaagcaatgagaaaaggactccctattttataaatggtgctgggatagctgactagccatgtgtagaagaataaaactggactcctacatttcaccatacacaagaaattaactcaagatgaattatttacatggaagatgccaaactgtaagaatcctacaagaaaacctagggaatattattctggacatcagccttgggaaggaattgatgactcagtcctccaaagcaattgcaacaaaaccaaaaattacctaattaaattaaagagcttctgtaaagcaaaaggaacaatcaacagagaaaacagacaacctacaaaatgggagaaaatgttcacaaactatgcatctgacaaaggtctaatatacagaatccataagaaatttaactcaaaaagcaaaaaacaaataaccccatataaaaatgggcaaacgacatgagcagacacttctcaaaagaaaacacacaagtagccaacgaatgtgaaaaaatgctcatcatcactaatcatcagagaaatgcaaatcaaaatcacagtgaaataccagaatggctattattaaaaagtaaaaaaaaaaacaaaaaaaccagatgctggcaaggctgtggagaaaacagaatgctgttggtgggaatgtcaattggttctgccactgtgaaaagcaggttagagatttctcaaagaacttaaacagagctaccatttgacccagcaatcccattgctgggtatatatccagaggaaaagaaatcattctaccaaaaagatacatgcactcatatattcattgcagcactattcaccatagcaaagaaatggaatggtagactgaataaagaaactgtggttcctatatgccatggaatactatgcagccataaaaaataatgaagtcgtgttcctttgcagcaagatggatgcaactgggggcctttaattaatgcaggcacagaaaactaaacactgcatgttcttacttataagtgggagctaaacaatatgtacacatgaacataaagatgggaacaacagatgcagggactgctagagggcagagaaagggagaagggaaaggactgaaaaactaactgctgggtactatgctgtgtctgggtgacaggatcaatcatacaccaaacctcagcatcatgcaatatacccaggtaagaaacctgcacatgtacaccctgaaactaaaattaatgtttaaactatttttaaaaagagacttctttttggatggcatattttggttttttccactttcagtttctttttaaaaaacatgttttaatttttatgcaattggtcctaacagtttttgatttacacaatttgttgcctgcttgggacataacattttagtacatccatatgttcattgtagattcaatctttaatcaataaaattgtcctgttttgtcagttttgttgttatctcaaaattaaattatattgaatttttctaatttaatttttaaaaatgttttcttttctttctttaattgactgtattgtttgtttcaaacaggctgtataaatttgagtttagtttttttttaccctagcctatgacatgcctttttctattaattggagcactcatcccttaagtgattgatgtatttatttcactcatatttataatcatctatgagcaatcattgtgtgcctatactgacatgatttgtcttaattctttaactttattttcattattttactatttattcctttatttgttacttgaatttacttttttttaagagatagggtcttactctgttgcccaggctgaaatgcagtggcatgatcatagctcactgcaacctcgaactcctgtgaagcgacacttctgcctcagtctcttgagtagctgggactacaggtgcgtgggaccatgaccagccaatttttaaattttttttggagagtcagtgtcttgctatgttgcaagggctggtctcaaactcctggcctcaagctgtcctcccaccttggcctcccaagtcgctgggatttcttttattatttaagtgccattgttgttctttcttctttgcccttttcttcataaactattttcttttagccttttagggatccagtatttgagaagtaatttaggctgcacattagttctttttttttttttatcactgttagtaactgatggagtgacatatttaatacccatttttaaaattttgattcctttccaatgtacacaaataggtcttgtgattattaaaacctttttctttttttaattattattatactttaagttttagggtacatgtgcacaatgtgcaggttcgttacatttgtatacatgtgtcatgttggtgtgctgcacccattaactcgtcacttagcgttaggtatatctcctaatgctatccctcccccgtccccccaccccacaacagtccccggtgtgtgatgttccccttcctgtgtccatgtgttctcattgttcaattcccacctatgagtgggaatatgcggtgtttggttttttgtccttgagatagtttgctgagaatgatgatttccagcttcatccacgtccctacaaaggacatgaactcatccttttttatggctgcatagtattccatggtgtctatgtgccacattttcttaatccagtctaacattgttggacatttgggttggttccaagtctttgctattgtgaatagtgccccaataaacatacgtgtgcatgtgtctttatagcagcatgatttataatcctttgggtatataccctgtaatgggatggctgggtcagatggtatttctagttctagatccctgaggaatcgccacaccaacttccacaatggttgaactagtttacagtcccaccaacagtgtaaaagtgttcctatttctccacatcctttccagcacctgttgtttcctgactttcaatgatcgccattctaactggtgtgagatggtatctcgagactccctttttctgtaacttgaaatacattaatataaaaggggaaatttattttaaaggaagggtcaaatttatttcctgcaaaagatgatgatgtttcctaatgtctgctcttgctcttctctgcttcggaaagcattgaagaacagctaagatatttgaaggatgtgtattgcatttatttataatgcacatattcggaaaataaatagatctaagtcactggatgtaaagacatagcttctaagcatttaacatacaatacttttttgggtaggcaggtgacattgtcactcatttaaccctatgtgatgtgttatctttctcagctatgcctcagccttggggaacacactttacatatggggatggtgagacataccaatgagagcaacctagcaggtttcatccttttagggttttctgattatsctcagttacagaaggttctatttgtgctcatattgattctgtatttactaactattttggggaataccaccatcattctggtttctcgtctggaacccaagcttcatatgccgatgtatttcttcctttctcatctctccttcctgtaccgctgcttcaccagcagtgttattccccagctcctggtaaacctgtgggaacccatgaaaactatcgcctatggtggctgtttggttcacctttacaactcccatgccctgggatccactgagtgcgtcctcccggctstgatgtcctgtgaccgctatgtggctgtctgccgtcctctccattacactgtcttaatgcatatccatctctgcatggccttggcatctrtggcatggctcagtggaatagccaccaccctggtacagtccaccctcacccygcagctgcccttctgtgggcatcgccaagtggatcatttcatctgcgaggtccctgtgctcatcaagctggcttgtgtgggcaccacgtttamcgaggctgagctttttgtggctagtatccttttccttatagtgcctgtctcattcatcctggtctcctctggctacattgcccacgcagtgttgaggattaagtcagctaccrggagacagaaagcattcgggacctgcttctcccacctgacagtggtcaccatcttttatggaaccatcatcttcatgtatctgcagccagccaagagtagatccagggaccagggcaagtttgtttctctcttctacactgtggtaacccgcatgcttaaccctcttatttataccttgaggatcaaggaggtgaaaggggcattaaagaaagttctagcaaaggctctgggagtaaatattttatgattattaaaaaamaatttaagtgacactgtgatgaattttttttttggtaaaaagtagcatcttttaataagaggattttttatgggctcttctcacattttcttttrattaaatatttgtacgacattttgcattatgtaaaatactatggaatatatgtctacatacatacatgaaacatatgtctataaagtcgcaacttggccattacccagtagcagtataaggtgagtcctttagtcaatctatgcttcagtgcctttgctgcagaatatatcatttgtgtagtacatttgaaactacttttaaataaatactttactggattaagataggcatgaacatattcaagaaatgtttatgtcagccagcttttttttttggttgctaataacgcattaatctctgagccttcctgtagatggacacatagcttattcccttccaagaatgtagctgagatgcatgcgtgttgatcaagctgtaatgaggcaaatttttaaattgcaccctatatgccatcctcttaacatgtggaagagatgtgtagacatgcaaatacaacacaaagacaaagggcacactttaaagntgatgtggaaagtagatgaaagcccagttctctggttgtgtagttgcatcaagaaatagtttgaactgcctaacactggagtctcagtctacagaaaaaacacagctgtaaaattttctatggctcrcatggatacacaaataataacacattgttattatatctgcwtttctgtatatgaaacattttcataattttgagatatatcttccagataaaaccttaaccaaattgtttaaattatttgcactaaaatactgaacttcatttcccatggcttcactctaaatggcccataccattctttttctggaaataaggaatttttgcattttgagtctagaaaacgttgtgtgaactcatggtattatacttcctatttcactgcattatagcaggcattgggttgtatactctgtagtaggaaactatgtcctctgttcaaacttacatcaaaataaataaatgaattcagtgagatgaggaaggatattgtagaagggtcttttaagtccaaatgtggtgatcattttaaatatagtattaaacgttagagaatgagttgttgtttataactcttcagaagcagaggcataattagtaagataatgcactgtatgtcttctgtcctttgagtgtctatcctttcagtgtccctcagttgtttatttaccagtttgttacatttttgatgtgcaagtactgaatatcacatgcagtgctagttgctaagtatagggagaaaactagaaataaacggtatatacccaccctgaactcattgctgttagaaaagatgaacctaaaaaacaaaaatacaaaaattagctgggcatggtgacacgtgcctgtaatgccagctattcgggaggctgaggcaggagaatcgcttgaactcgggaggcggagtttgcagtgagctgaaatcgcgccactgcactccagcctggcaacagagtaacactccgtctcaaamacaaaacaaacaaacaaacaaaccccccaaaacaaaacaaaacaaactgcaaggtaaccatgaaaatgaaactggaataaggtctatgaaaaaaatagtgtgttatgcaattgattatcaaggagctaactgaaggcttccwgggaaagtggcatttaatttgccacctcagtaaagctaagaagcaaccctggaggactaaaggggagaggatgggtaaggaaaggaaagagtttcctgtagaagactttgcctaaggcaatgctgtcaagatatcagctggagctttatcttgaccttccaaatctggttaatatggttctgtatccaaccaattatagtgcctgctgttttccaaactctcccaaacttcccaraattttctgagggcttttatttttagagtaactatgatcttttgctctttataaaactctcatgagtttagaacactttaaataagattatgttttaagcagagataacacagatgtgacagagcatgcactgaaagcatttgaatcttccttatcrttcttttttctttatgctggcccttcaatccctttccaggaacaccacattcttctccaatattagaagcaacaatctctcttcctgcaatattttgacaccaacaagtaccctgactttgaaaaatccaatttgtaagctgacaaacttcaaaaatatgcttacaaacataggcagatttctcttgagtactaccaaatggtactatggtactatggtactttgtcaagtgacaaagttcctccttatgttgccaaaataaaaataatgctctatcattgtttgctgtggatttttagtaaattatgcctaatgcttttaaactatattggataaaatatttgtagagtaagtaggatctgtagctataaaaattttatattggaacttcactttctaatcaatgatactttttcaaaagaagacttgcataaagtgggatttctatttatgtttattttgtcacctttcatggrgacatatacttcatacattaataagtttgcttatcaaatgtaaattaagcttgccctgggaactgggatcggaatattggaatcgtagattatagtgcaacaaggatgcaattaaacaggcactaacaataaaatgagttaagacttgggttaggaaaggaacagtgatggtgaagtacatgcaatataagaatatcccccatttttggagatgaaaatttttttttctttttttaaaaattttactttaagttctgggataggtgtacagaacatgcaggtttgttacataggtatacatgtgccatggtggtttgctgcacgcatcaacccgtcagctaggttttaagcttcacatgcattaggtatttgtcytaatgctctccctcccctttcccccaatcccctgacaggccctggtgtatgatgttcccctcctagagtccatgtgttctcactgttcaactcccacttaagagtgagaacatgtggtgttcggttttctgttcctgtgttagtttgctgaggatgatggtttccagcttcatccatgtcaaaggacatgaactcatccttttttattgctgcatagtattccatggtgtatatgtgcgacattctctttatccagtgtttcattgatgggcatttgggttggttccaagtctttgctattgtaaatagtgctgcaatagacatatatgtgcatgtgtctttatagtagaatgatttataatcatttgggtatatatccagtaatgggattgctgggtcgagtggtatttctggttctagatccttgaggaattgccacactgtcttccacaatggttgaagtaatttacactcccaccaacagtgcaaaagcattcctatttcttcacatcctctccagcatctgctgtttcctttttttttttttatttttgagacagagtcttgctgtgtcgcccagcatgtagtgcagtggtgcgatcttggctcactgcaatctccacctcccgggttcacgccattctcctgcctcagcctcccaagtagctgggactacaggcacctgccaccacgcctggctaatgtttcgtatttttagtagagatggggtttcaccgtgttagccaggatggtcttgatctcccgacctcatgatctgcctgacttggcctcccaaagtgctgggattacaggcatgagctaccacacctggcctgtttcctgactttttaatgattgtcattctaactggcatgagatggtgtctcatcgtggttttgatttgcatttctctaacgaccagtgatgatgaactttttttcctatgtttgttggctgcataaatgtcttcttttgatggggttgtttgtttttttcttgtaaatttaagttctttgtagattctgggtattagacctttgtcagatggatagattgcaaaaattttctcccattctgtaggttgcctgttcactctgatgatagtttcctttgctgtacagaagctctttagtttaattagattccatttgtcaattttggcttttcttgcaattgcttttggtgttttagttatgaagtctttgcccatgcctatgtcctgaatggtattgcctaggttttattctagggtttttatggttttaggttttaggtttaactctttaatccatcttgagttaatctttgtataagatgtaaggaaggggtccagtttctgttttctgcatatggttaagccaattttcccagcaccatttattaaatagggaatcctttactcattgtttgtttttgtcaggtttgtcgaagatcagatggttgtagatgtgtggtgttaattctgaagcctctgttctttttcactggtctatatatctgttttggtaccagtaccatgctgttttggtaactgtagccttgtagtatagttggaagtcaagtagcatgatgcctccagctttgttcttttggcttaggattgtgttggctatatgaactcttgtttggttccatatgaaatttaacatagtttttttctaattctgtaaagaagtcaatggtagcctgatgggaatagcattgaatttataaattactttggatagtatggccgttttcacaatattgattgtttctgtacatgagtatgaaatttttttccatttctttgtgtcctctctgatttccttgagcagtggtttgtagttctccttgaagaagtccttcatgtcccttggaaattgtattcctaggtatttcattctctttgtatcaattttgaatgggagttcactcatgatgtggctctctgcctgtctattgttggtgtataagaatgcttgtgatttttacacattgattttgtatcctgagactttgctgaagttgcttatcagcttaaggagtttttgggctgagatgatggggttttctaaatatacaatcatgtcatctgcaaatgtagacagtttaacttcctctcttcgtatttgaatatcccttattttcttatcttgcctgataaccctgaccagaacctccaataccatgctgaataggagtggtgaggggggcatccttgtcttgtgccagttttctaggtgaatgtttccagcttttgcccattcagtatgatattggctatggatttgtcataaatagctcttattagtttgagatatgttccatcaatgccgagtttattgagagtttttagcatgaagtggtgttgagttttatcaaagtccttttctgcatctactgagataatcatgtggtttttgtcattggttctgtttatgtgataaattatgtttattgatttgcatatgttgaaccagtcttggatcccagggatgaagcygacttggttgtggtggataagctttgtgatgtgctgctgtatttggtttgccagcattttattggggatttttgcatcaatgttcatcagggatattggcctgaaattttctttttatgttgtgtctctgtcagattttagtaccaggatgatgctggcctcataaaatgaattagggaggagtctctctttttctgtggtttggaatagtttcagcaggaatggtactggctcctctttgtacctctggtagaattcagctgtgaatctgtctggtcctgggctttttatggttggtaggctattaattactatctcaatttcagaactcattattggtctattcaggaattcgacttctccctggtttagtcctgggaaggtgtatgtgtccaggaatttttccatttttaaaaaattttctagtttatttgcatagaggtgtttatactattctctggtggtagtttgtatttctgtgggatcagtggtgatatcacctttatcattttttattatgtcatattacctaacttcaaactatactataaggctacagtaaccaaaatggcatggtactggtacataaacagacacataggccagtgggacagaatagagaacctagaaataaattcacgaacctgcaactatctgatcttcaacaaaatcaataaaaataagcagtgggaaaaggactccctagtcaataaatggtgctggtataactggctaaccacatgcagaagaaggaaactgtacccctacgtttcaccacatacaaaaattaaatcaagattaaagacttaaatgtaagttcaaactatagaaatcctagaaaaaaccctaaagaacaccattctgtacatcagtcttggcaaagaatttatcactaagttcccaagagcaattgcaacaaaacaaaacatttacaagctgaacctaactatactaaagagcttctgaacagcaaaaaaaaaaaaaaaaaaaaaaaattaccaacagggtgaacagacaatctacagagtgagagaaaatattcacaaactgtgcatttgacaaaggtcttatatccagaatctacaaggaacttaaatcaacaagcaaaccacccccccaaaaaaatccaattagaaatgggcaaaggacatgaacagacatgtctcaaaagaagacatatgagcagccaataaacatgaaaatgtggtcaacattactaattatcagagaaatgtaaatcaaaaccacagtgaggtaccatcttataccagtcagaatactgattattaaaaagtcaaaaaacagcagatgctggtgaggctgtggagaaaagggaacgcttatacactgttagtgggaatgcaaactagttcagccacttcgaaagcagtttggagatttctcaaagaacttaaaatagagccactatttgacccagcaattccactcctgggtatatacccaaaggaagataattcattctatccaaaagacacatgcacctgtatgttgcaacgctatttatactagcaaagacatggaatcaacctaggtgctcaagcagaggattggataaagaaaatgtggtagacatgtgatatacaatgaaatactaggtagttacaaaaaataataaaaatgtgtactttacagcaacatagttggagctagaggccattatcctaagtgagctaatgcaagaacagaaaaccaaagattgcatgttctcacttataagtgggagctaaacactgaatacacatgaggtaggaattgaacaatgagaacacatggacacaggaaggggaacatcacactctggggactgttgtggggtggggggaggggggagggatagcattgggagatatacttaatgctagatgacgagttagwgggtgcagcgcaccagcatggcacatgtatacatatgtaactaacctgcacattgtgcacatgtaccctaaaacttaaagtrtaataataataataaataaataaataaataaagttaggaacaatggatactggggaccaacagatgtggagggaggragtgggctattggctgaagaaccacctgttgtatatcatgctcacttcctgggatggaatcactgggaccccaagccttagtgtcatgcattttacacgtcatgccttttacccatgtaacaaacctgtacttgttccctttaatgtatrataaaagttgaaatgattagttattaraatggtgagttttttgttgtgtatattttatcactttatattttattttacatatatgcttatatacatataatttaataaatattttaccactacatatacttttttttttttgatatggagtctccctctgtcacccaggctggagtgcaatggcacaatcttggctcactgcaarctccgcctcccgggttcacgccattctgctgcctcagcctccagagtagctggaactacaggcgcctgccaccacgccccgctaatttttttgtattttttagtaaagacaggtttccatgttagccaggatgctctcaatctcctgacctcatgatccacccactttggcctccaagagtgttgggattacaggcgtgagccaccgcgtccggcctacatatacgttttaaaaattaaaaacaggctatgaattcagaggggaaagagttcaggaaggaagtctaaaaaatacagtgattatacaagaggttgaacatatgaaaaactaacaatttcaatatgtcraataacctcccaagtgactgtagtacaaagatcaccagactcagaagaatagttttgaatttcagtcctaactcttttatacctagtagataaagttattgacagttacatcaaagatgggcctaaatttctagcttgcataattggataatagtgacattattcacttttacagcaaacaaaatggagagagcaagggtttagatttgaacacagtgcatttgaggtgtctcacctagtggagatggtagtttcaaaataggatacatgaatctagtcctcagtagagaaatctacacataattaacatagcaataagcatatagtttccgatangagaaaatttaatttgttagaagatcagtcccgctggactgggactgatgaatccaaccattaagggcttaagagagtaagaagagattgcaaaagagacagttattctaggcatttgttatgatagctttaatataaagtatctcagttctaagagaangatgctcaaggttagaaatccaaagtacgggcaaagagattctctttaaaggggatgacgaagatcttctctrtggtaactagagtgaaggaggagggacacagaagacttaagtgggttttcttttcgctctttcacgttggacaagtttgatggcttctatttcctatgtgaagtacgaggtgccagaataatactgaagaaaggaatacttcacactggggaaatatgtgtattattgttccttgatgatcmaaagaagctagtcagttcctccactaattgcctactggggatgcaggtttttcccagaagacgtggtaaaaacaaatcatggcaattttgtaaayttgcaaaattcactgtttctgcttccctttttctccaagttttcattgccactaacataatttcctcaggataaactcaggcgagaaatataaatcttgaacagattgttttttgaagccagttgtcttgtgggtcaacagcaggctggacacaaaataacaaagctaagaaaatgttatatgacttgcatcctgaagatgtgaaaaacaccgacacctttaaatattcctgagtgtaagtaagaattcaatctggtgtaatctaaattgaatgcaatcatttcttaaagaagttcataaaagttaataggtagaaactttattgctttcattactgttggatttgctgtatcgttaaagtaataatgttgcgtgacacaggtaaactatctggacttctgctttcatttatcgaatataaagatagggcaatttcttgttagtcttcgtaagtacaagttagtatcatgcaattaattagtataattagcattttggggataaattttacttatagaaacaacttagttgatagatttagcacacactcaattccacaaaaacacaactataacacaagtggaacactcaaktcgaggtaatttcagccttctgtaaaaaaatcactcaagagaagtactgcagaggaagcttcctcaagtagtgcaccaytgctaacctttgaaattgtaagctcttcgccagctgaaacagagggatagttgaattacaatttaaccaaaatgattgagggtttaaattattgggttggatttcattgagtagaaataaaatgttttccagaggaccactgtttctcgactctattaacactgctgtaatttctgtgtttccttctcatgaagtaattgtattttagtaaaatttgatggttagcaagaataygtatgggtagaggacacttacttaaacagactgagtgctttactgatcaggtgggcaacttccaatctggtcttaaaacacgtgaacagacactaggaaatctgtagccattggtctcatattttcaccaactggtcaagtaactatggaagaccagagcatctggaagatggactagaccagaaacgcatcggtcttaagttggattctccagattgagagaggacacgattatgatttttcagtcgtctgtcttaaagctttattcaggcagatggttagaataatgaacaagggctgagtggcatggcagcacacaggtatttaaggggttggcttgtggttaaaaacctgttttggggggaattgcaaggacttggcatgcaatggtgcttggtgaaagctgaggtaaatcagcacagatgtgagctcatatcgctgttgagggttccatgaacaaaaggctcctgcagttttatggatccagggaccatgagaaagggtaagggctagatgtggaaaagtacggataggggaaagctgcctccccacctcagtgttcggcacagccagcgcgttgaagactctggagggagttgcagtcaagggttcgctctgacctctctggcttgtcatgttcttttgcataatcacatttatatcttaagcgtctttattccttgctcatctttattccttgcactttgtctggtgctgtaggcagagccttcttgtaaggcaggagaaggggagaaacttaaagacaactttcctatctttgactcagtattcagtactttaccacatgtagccctttccctttctcacgctccctggtttggggatccataaaattgcaggggcctttcgttcatggaaccctcgacagtgacatgaccttcgcatctgtgctgatttaccttcaccaagcaccactgcatgagaggtgaggtagcgggatgggaagggattaggaggagctgatgcttcttccagtgttatacactggaatgcattatcatagtcagtgattagaggcttcacggtaactttcattttggttccttgctgctttagggtcctctgacaccttatagctcagctctctccccaggtcagctgatccaccaatattaaccacttcttttcccagtatcttccgtccaggaagattcaacagagtctgactgggaaataggacacatgaaaaatgcattcatttcttcatcaagcatttattgacacattagtatgcatttgatatcatataaattccataaagtatcagtagaacmtgacccctcagtttaagaagtaggttatggtttagtagatacatacggtcataaaacattaggtcagtatggtattggagttttttattgtagaggtaagtttagggtacggaatgaacacaaaataagcctcaccaaggttgggtggagggatgtatgagagaggagtgctaatcagagtcaaagaggactttgtatgttcgtgagaaatactgagtcttaaaagtgtgtagataactgcctggtgaagggggttggagaagattatcattgtcatgggaagcagcataagaaaagccatagctccattatgcttagcaaactaacgcaggagcagaaaaccaaataccacatgtcatcacttataagtgggaggtaaatgatgagaacacatggacacatagaggggaacaacacacactggggcctcccagagagtggagggtgaaaggagggaaaggaacaggaaaaatataactaattagtactaggcttgatacctgggtgacaaaataatattacaacaaagccccataacaaaagttcacctatgtaacaaacctgcacatgtatgcctgaaattaaaaggtaaacacacacacacacacacacacacacacacacacacacacacacggcatagctgaatgtaagggctcagcttgctttctgccatcttctctaaatgtgtttgtgatcattctcttctctatacttgtactaatatgtatatttttctatttattatttattttgccatacttaatgtaaagattctcaattatagggagaatataaattagaaatgtctaaaatggtaaaaaaaaaaagtgtctgagtttagcacaaactaacatttctacaggcattctgcaaacattccatctggctctggtgcgaggaaagaacccacagctggctctgaagggaatgtaaatatgcacattagacacaatcaccttactcaaatgttatgctaacattttacaacaagcaggaagaataaccttggctgatgagattctgaaacacattttgatttgggagtcttggtaagttatacaacaattagtgagaataggaattgtcctgtgatttcacgtatccctactttcctcattctgaaagaaaagcacgaaatcatcttatatcctcagtttacctccctttccatttaaaagtcagtattaggttaattttgtcattttcattccattaattttcttcccattgactttcattcagttaatgttgtcattttggtaattctcaggctattcacatgacaygaacctagttaatatcatgagaactattgaactatccctacctgaactccctcacatcaatatcttccctacccatcttcctatcaatgcaccaatatttccaaaatggaaacagaaaatattactctcttgtgtgctcagagcctttaacaacatcttactgcctgcacagcaaagctaagaactttatttcacccagtgatttctacagtttgactccaagtattttattttctaagcataccttyagcactcacctttttgaatcttttttaaaaaaaaactatacttaaataaaacagtatttatcgtgttgtacatgataaatatatacaattttaatttgtcagttaaaaataaatgaataaagaaataaaaacaaagtaagtaaagaaataagaacaaaacaaacaaaaaactgttttaaaatttcaatagctttgagggtacaagttttgaggattataaatcatgctactataaagacacatgcacacgtatgtttattgtggcactactcacacttggaaccaacccaaatgtccatcaacaatagactggataaaaaaattgtggcacatatacaccatagaatactaagcagctataaaaaaggatgagttcatgtcctttgcagggacatggatgaagctggaaaccatcattctcagcaaactatcacaaggtcagaaaaccaaacaccgcatgttctcactcataagtgggaattgaacaatgagaacacatggacacagagaagggaacatcacacacaggggcctgttgtgggatgggggactgggggagggatagcgttaggagaaatacctaatgtaaatgacgagttgataggtgcagcaaaccaacatggcacatgtatacctatgtaacaaacctgcactttgtgcacatgtaccctagaacttaaagaataataaaaaaatccataataatagtggtattatgtgatcagcttttgattaaatactgactcattcattccatagtattcactgagcccagctgtgggtcaggccctttgataggtcctgaggacacagcagtaactttagctggctgaagtggtggaaagacagttggagtggccacaggtaactccatttacccttttgcacaagaaaattaaatacacgtgtcctaggtgccaaaggtgcttatggagtcaagtatatgagctgcctttagggaaatattaagcctaactctgggttgggctttatccagccccataaacttaaaattgagtaatttggggcacgtattttaaacatttttcatctgtagaattagaacactactacctacctcatattttggagcatattatgtgaaaaaggcccagaaaaaaactatatttttttaaaaaacagtatttatcttgttgtacatgatcattatatacaattttaatttgtcgattaaaaataaatgaataagtaaagaaataaaaacaaaacaaacaaaaaactatattttaaaatttcaatagctttgagggtacaagtagtttttggttacctggatgaactgcctagtggtgaagtctgagattttagcgcacctatcacctgagtagtgtacactgcacctaatatgtagttttttaaatcccctactcccctcccactctctcaccttttcagttcccaatgtccattataccactgtgtgtgcctgtgcatacccatagcttagctcccacctgtaagtgagcacatacaatatttgccatttctgagttacttcacttagaatagtgacctccagctccatccaagttgctgagaggcattatttcatttttttcatggtttagtagtattccatgatgtataacccatttactttatcctctcatcggtttatgggcacttaggttggttacagatccttgcaattgtgaattgagctgcgataaacatacacatgtgcatgtctttttgatataatgacttcttttcctttgggtagatacccagtagtgggattgctggattgaattttagatctacttttgtttttttgaaaaatctccatactgttttctatagaggttatactaatttacattcccaccagcagtggataagcattccctttttaccacatccacgccaacatctattgttttttgactttataatartggccattctggctggggtagggtagaatctcattgtggttttaatttgcatttccctgattattagtgatgttaaacatttaaaaaatttgtttgttggtcatttgtatatcttcttttgagaaatgtctattcatgtcatttgcccactttttgataggattatttgttttttcttgctgatttgcttgagttccttgtagattctggatattagtcctttgtcagatgcataatttgcaaaatatttctttttgaatcttcttacaaagacaagtgaatcattcacacattctcttccgacattctccagatgactttgagttttcttcaacagtctcataaattactttcatttttgtttataatttgttttgtgtttttgacattttgaaagttaaggaattttatttatttttatttttattttttgagatggaatctcactcactttgtctcccaggctggagtgcagtggtgcgatcttgactcactgcaaccgtccacctcccaggttcaagcaattctcctgtctcggcctcctgagtagctgggactacaggtgtacaccaccacacttggctaatttttgtattttattacagatggggtttcaccaagttggtcaggctggtctcgaactcctgacctcaagtgatccacgtgactcagcctgtcaaagtgctgggattaaaggggtgagccacagcatctggccaaaacgttagggagttttaatatatttatctcagggttccttcaaacaaattttatatttataagaatactgcaatgcatctttaactcttataattatatatattcctttgagtatatgtatttttcttcactagtaaggactattagccaacttggttaaataatgcctaaataaataaaaaattttaaaactaatttttattttttggcagttcaatcattgawtaaacttttatgagatgatttgaatttatatcatatattttggttccttaaatatgtcttttcattttccaccagttagtaccaatgtgacacatatcaaaaatgattttctatctccttcataccaatcatacccattttaaaggttttaaagtctttgttttaattagttttatctaaaaagtcttccccatctgattgtgcttacaatcaaatctgagtaaggtatttcatatgcagataatttattgacagttgaaaatcagggagatactgttcaccgtattttgagagaaatttatttttagtggtaggtcattgtggattttttgatatgcatgtaaatatgcactttgattggctttaataatcaatccccagacaactccaaagttgwaatcattcataatttttaaagatgagcctttgaactggaatgaagaaacatggattgatgttccaagtcagcagcacattagtgaaaaatgaatagtttagggtgaaaaatgaatagtttgggaaagttggtctccatgatcctctcagctcrtgtrttctgttattctaaatttaattgttttggatgtacccattccattcctgccttaggtgcggatccccctggagggatgggattgggcaatgagagttccctaatggatttcatccttctaggcttctcagaccacyctcgtctggaggctgttctctttgtatttgtccttttcttctacctcctgacccttgtgggaaacttcaccataatcatcatctcatatctggatccccctcttcataccccartgtacttttttctcagcaacctctctttactggacatctgcttcactactagccttgctcctcagaccttagttaacttgcaaagaccaaagaagacgatcacttacggtggttgtgtggcgcaactctatatttctctggcactgggctccackgaatgtatcctcttggctgacatggccttggatcggtacattgctgtctgcaaacccctccactatgtagtcatcatgaacccacggctttgccaacagctggcatctatctcctggctcagtggtttggctagttccctaatccatgcaacttttaccttgcaattgcctctctgtggcaaccataggctggaccattttrtttgcraagtwccagctcttctcaagttggcttgtgtggacaccactgtcaatgaattggtgctttttgttgttagtgttctgtttgttgtcattccaccagcactcatctccatctcctatggcttcataactcaagctgtgctgaggatcawatcagtagaggcaaggcayaaagccttcagcacctgctcctcccaccttacagtggtgattatattctatggcaccataatctacrtgtacctgcaacctagtgacagctatgcccaggaccaagggaagtttatctccctcttctacaccatggtgacccccactttaaatcctatcrtctatactttaaggaacaaggatatgaaagaggmtctgaggaaacttctctcgggaaaattgtgattcctatggacatgatttgcaaggaattcattataagccaggtagcttattcagcttctatttagtcaaacccatagttctaaatttcacatgaactatattactgctcacttattttctcttcataagggactttttccttttttatgtgtaactaagtaaaatgtttatatgtttatttgagagcataaactattgaaaagagagctgtggatggttgtaaattgtgatcctcaccacaaagcctctattttatgtctgatacttattcccagggattcagaaaaataaattattaagtatttaccatgtatttatctaggttaggagacttttcttcagttttaataaaatgttcagtttcctgccaaacactttacatttacatcgtaatgtccttcattatagctttatgttgaaaataagcaattcctgcatgtgctcgtagttcaaatttattggtcagtaggatattgcataagctatttttaaataaccgttccaaatacattttaagaatttataaggggtaacaagaacaaaatacgctaaacacattatttttcataacttagagtgtgcatctctttttgtgttctgaggccactttatccttgtgcaggagccatgctcatcttctctgtattatttcaatgttagtatatgagttgcagaagtgagaactgaggtcactttatacatggtaggtacaagacttttgaaagaataaaataatcaaataattttcttctataccttttcatacattcaatcaatgagaataattggacttcaaaagacattattattttctttttttaaaaatacagcttcattgaggtataattgatatacatatttaatgtataaaatttgaggagtatgggctaggcgcggtggctcacacctgtaatcccagcactttgggaggctgaggcgggcggatcacgaggtcaggagatcgagaccatcctgactaacacggtgaaaccccgtctctactaaaaaaaaaataaaaaaaaattagctgggcttggtggcaggtgcctgtagtcccagctactcgggaggctgagacagaagaatggcgtgaacccgggatgcagagctttcagtaagccaagatcgcgcactgcactccagcctgggcgacagagcgagactctgtctcaaaaaaaaaaaaaaaaaaagaaaaaaaaagaaaaaaaatttgatgagtatgatatatacatacacccttgaaaatatcaccacaaagtaatacacataaccattacatctagaagtttccttgtgcttcttatttgtgcttgttataacacaacatatgatcaacacttttaacaaatttttcagtgcacaatactgcactgtaaactataagcactatgctttataatagatctcttataacttattcatcttgcataaatgaaactttgtacttattgaacaaaaactccccatgttcttgtctctcatcccctagtaaccatcattctattctctacttctatgatggtaactattttaaatatttaatataagtgaaaccacacactacttgcccttctctgactagcttttttatttagcataatgtcctccaggttcattcatattgttgcaaaggggtcaattcagcaagagtatataacaattgtaaacatatatgtacctgacattgaagcacacagattatataaagcaactattattagagttaaagagagagataggtaggctccaatacaacaatagctggagacttcaacaccccactttcagcattggacagatattccagacagaaaatcaacaaacaaacattggacttaatctgcactacagaccaaatgtacctaatagacatttacagaacatttcatccaagagctgcagaatacacatgcttttcctcagcacatggatcattctcaaggatagaccatatgttaggtcacaaaacaagtcttaaaacaccccaaaaattgaaataatatcaagcatcttctctgaccacagtggaatgaaactagaaattaataacaagaggaattttggaaactataaaaacacatggaaattaaataatatgctcctgaatgaccagtggatcaatgaagaaattaagatggaaattgaaaagtttcttgaaataaatgataatgaaaacacaacatatcaaaacctatgggatacagcaaaaccagtactaagaggaaagtttatatccataaaagcctacatcaaaaaagaggaaaactttcaaataaacaatctaatgatgcattttgaagaactagaaaagcaagagcaaaccaaacctaaaatctgtagaagaaaagaaataaaaagatcagagcagaaataaatgaaattgaaattaaaaaggtcaataaaagaaagttggttttttgaaaagttagacaaaatttatgaaactttagccagactgagaaaaaaaggagaatgtctgaataaacaaaatcagaataaaaagagacattataattgatgctgcagaaattcaaaggttcattagtggctacaatgagcaactatatgctattaaattggaaaatctagaagaaatgaacaaatttctagacacctaaacaacctaccaagattgaaccctaaggaaattcaaaacctgaacaagccaataaccagtaacgaggtcaaagctgtaataaacagtctcccagtgtagaaaagctttaggacccagtggcttcattgctgaattctaccaaacatttaaagaaggactaacagcaatcctactcaaactattccaacaaatagaggaggagggagtacttccaaacttattccatgaggccagtattacactgataccaaaaccagacaaagacacatcagaaaaggaacaccacaggccaatatctcttatgttattgatgcaaaagtcctaacaaaattctagcaaacaaaattcaacaatacattagaaagaaagattattaatcatgaccaagtggggtttatccaagggatgcaaggatggttcagcatatgcaaataaatcactgtgatatatcgtatcagtagaatgaagaacaaaaacccatgtgatcacttcaaatgatgctgaataaacatttgataaaattcaataatccttcatggtaagagccctcaaaaaactgggtatagcaccatggaatactatgtagccataaaaaagaaggacttcatgtcctttgcagggacaagggggaagctggaagccatcattctcagcaaactaacacaggaacagaaaaccaaacaccacatgttctcactcataagtgggagttgagcaatgagaacacatgaacacagggaggggaacatcacacaacggggcctgtcggaggcatggagggtaaggggaaggagagcattaagacaaatacataatgcatgtggggcttaaaacctagatgatgggttgataggcacagcaaaccaccaggcacatgtatacctatgtaacaaacctgcatgctctgcacatgtatctcagaacttaatgtaaaatttaaaaaaactgggtatagaatgaacatacttcaacataataaaagtcatgcaaaatggacccacagctagtatcatcatgaatggggaaaaactgaaagcctttcttccaagatctggatcacaacacagatgcccaccttccccactgttattcaacatagtagtggaaaacctagctagagcaatcagacaagagaaagaaataaagtgtgtcaaattggaaagggagaagtcaaataattatccttgtttacagaagatatgatctcatatttggaaaaacctaaaggccccaccagaaagctattagaactgataaactcagtaaagttgcagaacacaagagtacaaaataagtagcattctacatgacaacagtgaacaatatggaaaagaaatttttaaaatcccattttatgtgtagtgtcacataaaattaaatacctaggaattaagcttagccaaagaagtgaaaaagctctgtaatgaaaactgtaaaacactaatgaaggcaattaaagaggacaacaaaaagtggaaaaatatttcatgttcatggattggaagaatcgatattgttaaaatgttcttactactcagaggaatctacagattcaaagcaatccctatgaaaataccaatgacattcttcacagaaatagaaaaaaaattataaaacttatatggacccacaaaagacccagaataaccaaagctatattaagcacaaagaataaaactggaggaatcatattacctgacttcaaattatactatagtgctatagtaaccaaaacagcatggtactggcacaaaaactgacacaaaaatcagtggaacagaatagagaacacagaaacaaattcacacatgtacagtgaactcattttcaacaaagatgccaagaacattcactggaaaaagacaatctcttcaataaatggccctgggaaaactggatatctacattcagaaaatgaaactagacccccatctctcatcatatacaaaaatcaaatcataatcaagacttaaatttaagacgtcaaactataaaactactacaagaaaacattgaggaaaatctgtaggacatttgttgggcaaagatttctctagcagtaacatcccacaagcgcaggcaaccaaagcaaatgtggacaaatgggatcacagaaagtcaaaatgcttctgcacagcaaaggatgcaatcaacaaactaaagagacaacccacagaatgggagaaaatatttgcaaactacccactgacaaagggttaataatcagaatacataagaagctcaaacacctctatagggaaaaatttaataatctgatcaaaagatgggcaaaagatttcaatagatatttctcagaagaagacatacaaatggcagacaggtatatgaaaaggtgttcatcagagaaatgcagatcaaacaggcatatgaaaaggtgcttatcagagaaatgcagatcaaaactgcaatgagatatcatctcaccccagttaaaatggctcatatccaaaagtcaggcaataacaaatgttggtgaggatgtggagaaaagggagcctttgtacactgttggtgggagtgtcaattgctacaaccactatgaacaacagtttggagtttcctcaaaaaaacaaaaattgagctacaatatgatccagcaatcctgttgctgagtatatacccaaaagaaagaaaatcagtatatcaaagagatatctgcacacctatgtttgttgcagctgtctacaatagctaagatgtggaagtcacctaaatgtccatcaacagacgaatggattaagaaaatgtggtacatatatataatggagtactattcacccatagaaaagaatgagatcctgtcatttgcaacaacatggatggaactggagatcattatgttaagtaaaataagtaaggcacagaaaggcaaattatagcatgctctcacttaattttagatgtggaatctaaaaaattccagcacatagaagcagagtgcaggattgtggttacctggagctggggactgtggggaatgggcaatggtggtaagaggatataatgcttcagctagacaggaaggataaataataagtatttgaggtgatagatatgttaattagcttgattcaattattccataatgtgtatatatgtgtatactacatatatggtagcaacaattttatattgtatacaattgtaatttgtcattatctgacaaaaataaataaaaatttaaaaaggatagtgttaaactttgcactataacaatagcttaaaacatgaaaaaattatataattgaatgttgataagtcatgtttacattattaaaaagcagtgatgtgcagagaaaataacttctggctcatgtctggtttgcattagatacaagttgaattaacctgtattttccttac

SEQ ID NO: 10571 - DNA, 30231 bp, Homo sapiens
  misc_feature (1)...(30231): n = A,T,C or G, or insertion/deletion polymorphism (see Tables 1-2)
gctaataacactgataaatgtagatgcaaaaatcctgaacaaaatactagcaaactgaattcaacaacagattaaaaagatcattcaccatggtcaagtgggattcatcccagaaatgcaaagatggttcaacatacataaatcaagaaatattaagcatttattgatttatgttatacattatttaataaacatttattgatttacatgatacattaatgtgatacattgcatttacagaaccaagaacagaagccatataatttcaatagatgctgagaaagcattcaataaaatttaacatccctttatgataaaaatgctcgacaaactgggggtatcccatacctcaaagtaatacaagccatatattagacaaacccaaagccaacatcatacttaatggggaaaaattgaaaatcctttctctaacatctggagccagacaaagatccccactttcaccacttttattcaatataattctggaagtcctggctagagcaattagctgagagaaaaaataaagggcatctgaactagaaaggaagaagtcaagttagacttgttggcagacaatgtgatcttatatttagaaaatcctaaaaactctaccaaaaaactctttgaactgacaaattcagtaaagttccaggatacaaaatcaacatacaaaaatcagtagcatttatatacatcaacagcaaacaatctgaaaaagaaatcaaaaagcatttttttatttacaatttgtccccatttacaatagctacaaagaatataaaatacataggaaccaatttaaccaaagaagtaaaagatcgatacaaggaaaactataaaacactgatgaaaaaaattgaagaggacaccaaaatatggaaagatagtccatgctcatggactggaagaactggtattgttaaaaagacaatactactggccgggtgtggttgctcacgcctgtaatcctagtactttgggaggccgaggcaggtggattgcctgagctcaggagttcaagaccagcctaggcaacacggtgaaactctgtctctactaaaatacaaaaaattagccaggtgtggcagcgggcgcctgtagcccctgctactcaggaggctgaggcaggagaatcacttgaacccaggaggcagaagttgcagtgagctgagatcacaccactgcactccagcttgggtgacaaagagagactctgtctcaaaaaaaaaaaaaaaaaaagacaatacaactcaaagcaatttgtacattcaatgcaattcctaacaaaataccaataacattcttcacagaaaacattcttcacagaaataggaaaaaaatcctaaaatttatgtggaaccacaaaagaccccaaatagccaatgcaatcctgagcaaaaagaacaaagctgaagatagcataatacctgatttcaaaatatagtatgaagctatagtaaccaaatcagtacgggactggcataaaaacagacaaacagtcgaatggaacagaatagagaacccagatacaaatccatgcacttacagccaactcattttcaacaaaggaaccaataacatacgttggagaaagggacagtcttttcaataaatgatgctgggaaactgaataaccatatgcagaagaatgaaacgagacccctatctctcaccataaacaaaaatcaaataaaatggattaaagacttaaatctaaatcctgaaactatgaatctactagaagaaaacattgaggaaacactctagggcattggtctgggcaaaaaattttttgtgtaagacctcaaaagcataggcaacaaaggcaaaaatagacaaatggaattacatcaaactaaaaagcttccgcacagcaaaggaaacaaccaacaaagtgaacagacaaccccacagaataggagaaaataccacaacctatccacctgacaagggattaataaccagaatatacaaggagctccaacaactttatagtaaaaacacaaataatccagtttaaaaatggacaaaagagatccgaataaacatttctcaaaagaagacataaaattgctaacaggtatataaaagaatgttaaacatcactaatcatgagaaaaatgcaaatcaaaagcacaatgagctatcttctcaccacagttaaaatgacttttatctgaaaaacagggaataacagatgctggcgaggatttggagaaaggggaatcattgtacactgttgatgggaatgtaaattagtacaaccactatggagaacagtatggaggctcctcagaaaactaaaaatagaattaccatatgatccagcaattccactactgggtatatatcccaaagaaaaggaatcaatatactaaagagctatctgcattcccatgtttactgcaacaatattcacaatatccaaaatatggaatcaacctaagtggccatcaatggatgaatggataaagaaatgtggtgtatgtacataacggaatattattcagtcataaacaagaatgaaatcctgtcatttgcagcaatatgggtggaactagaggccatgatgttaagtaaataagccaagcacaaaaagacaaatattgcatattctcactcatacgtgggagctaaacaaaaaaacaagtggatttcatgaagatagagagtagattggtggtaaccagagttcagaaagagtagaggtaggggtctgaatagaggctggttaaggggtatgtattagtcttttttcacactgctataaaaaaatgcctgagactgggtaatttataaagaaaagaggtttaattgactcacacttccacatggctggggaggcctcaggaaacttacaatcatgttggaagaagaagcagtcaccttcttcacaaggtggcaggagagagaagaacaaaggaggaacttccaaacatatctcacaaaccatcagatcttgtgagagctcactcactgtcatgagaacaccatgggggaaactgccccttgtgatccaatcacctccctccctccacttgtgggaattacaggtccctccctcaacacgtgggaattacaattcaagatgagatttgggtggggacacagagccaaaacataccaaggtgtaatacacagttagacagaaaaaataagacctggtgttcaataaaccagtaggttagctatggttaacattaacctactgtacatttcaaaatagccagaagagaatcatttgaatatttccggcatacagaaaagacaaatacttggcgatagatatcccaatttccctgctttgatctttacacataatattaatcaaattatcacatgtacccccaaaatatgtgcatctattatataccaatttttaaaattaagttaaaaattaaattttgggttttgcatgtgaaaaaagagagaatatgggagaaaagaaattggaaacatcccttagggacaatttttttaggagttttgctgtaaagcaaagcagagaaatgaggtagtggctggagagaaatagggtgcaaggtaaggggttttatttattttatggacaatattacagtgtattcattagtatgctgataattcagtacagaatgaaaatcttgaaatacagaagagagagaaggacctcattcatgagaaagcatttaacatccagggtgcaaaagaattttctcatataggaactagggccagtgactcagaatgaaaagtagagcatacagtttctaatgcagagaggagggcagatgtgcctgtgaggcggtatagaagttctctttactcagtaacagaaagcaaagtcatcagcactcagtgagatgggaggagttgttggcggcttgaaaagagagtagaagaccaggcatggtggctcagcctgtaatcccagcactttgggaggctgaggtgggaggatcgcttgatcccaggaggtggagaccagcccgaacaacatggtgaaacttcatctcttaaaaaaaaaaatacaaaaattagcctggtgtggtggcgcaagcctatagtcccagctacttaggaggctgaggtgggagggttgcttgtgcccaggaagcagagattgcagtcagccaagatcgcactactgaactccagcctggctcaaaaaaataaataaataaataatgaaaagagagtagaacctgtgaaatagtcatttaggagaatggatggactaagaaatgtagaaggatagccaggcagcgtgaagggcccacttgaacttaatggttataaactgaaaatgaaaccaatcatcccagccatgtggttttctcaaacaacctctgccgtacaggcgcaggccaggaactggattcaagcagatttgggtttccatcaagagaataaaaccaagaaagactgggacaagagagttaagggtaacggcacatacacaggactggccataaccatgctccatggcctcttaaattgagtgaggagagaagtgagcacatgaggaagtgaaggtcagggccagggtggtaaatctaaatagggaaaagctctgtggttttccaatgaagaatgaggagaggagtaaggtccaagggagacattttgtgttccccaggcaaaaggtaagacagcatctctgaggaggagaccgaaggggacgtgggcctctccaagcatcgcaggctgaaaataatagtcccccaaatatgtccatgtcctaacccccagaagctgtggatgttaatttctatggcaagagggattttttttgaaatgtgattaaattaaggatcttgacgtcaagagattatcccagattagccagctgggcctgatgtaatcacaacagtcgttattagaaggacccacgaggagccagtgcctgagcatgtgatgtgatgatgaaggcagaggttgcagtcatgcactttgaagataaaggagcgagccataagccaaggaatgcaaacagtcactgggaactggaaaaggcaaagaaatattctcatctagaacctccaggaggaactagccccaccaacactgactttataaagcccagtaaaacttgatttcagacttggcacctccagaagtttaagagaatacatgtttgttatactactaagtttgtgttaatttgttgtgacagcaattggaaactaatacaccaaggaagggggaggatgtagaagagaggtccaggcaacatctctttcctctccaaaataaatctgaaagaaaggaattgggaaaagaccaaacgggtagctctgtgtcactcggtgagaagtgaaataaacgtaaaatcctggtatcaacaacccttgtgtgcgtttaggagagttctgactgctgggagccacttgtctaattccctcacctcctgtgtttgttccaagatcccctatttaaaattgcaaagtacacccccagtcctacacacccacaaacgcacctcgccacaccccgcccagctctatgctttcagtaccacctcatgacacacacgacgccatatatttactatatttatggattgcttgtttccccaactagaatagggcagtgacttttgtgcaagcatcttgaacagctcctggtacacagttggctctcaattaatatctgttaaatggatgaacttcagaggtgagatggaagatgccgaatggcaaatattcacttcagaatgttttgaaaggtaaagatgaaattatgggtatttacatccttttcccccaatagtattttaacaaatgaaaatcaccttaacaggtattcctaaaataattcttatttgtttgtaataaaaaacgaggaggaggacttgaatacacgcgtcgctgactcaaagatggtcccctccgcccaagaatcccgctccgcacagcgcagagttcaggggcccgcgccggaagtgggcgtggttcgcccgcggcttgctgggacttgtatttcggggccctaggcgcgcgagcggtcagcatccggaatctggcccctgcaggcgtggggttccacgtgggaggtgagactggccgggcttccccagccgctggcagaggcgttcaggggtcaggaaatgggtgtgccgcgggtaaggcgctgggccgccgagctgcggaagccgggagggcggcgatggtagggcaygcgaccagcggaggcgcggcccgcggcggcacgtgtgtcccggcgccgcatttccgagctgctgcgcccccggggccgggctgcggccacaccgaagcctgtggggccctgcagctgagcggccgcgcctccgatggcccctcctccctcctggccgagctctggcctgggccggctgggggcttcgtggttggccacgccggccttttcctcgcctgtgacgggcgttattgcaggggggttttcggtggacgttaggcgacggacgggggctcctgtaagagactgaggtttctgtccgcagcactgccttcgctgaaaagagcttgcatctgagcycccgcaccgcaggaacgagccaggctcctgagaatgaggtcggggaaggcgtcttgggcaaccgaaatccatcccgagaagcttctcctcttaactagaactttaggacagagatcgggaaagtcagaggaaatgggcacggcttcgagctgccggcggctgcggaatttacctagcctcttggttttggggggaaaacttggcttgtttaatcgaaagccctgtggagagagatgaaggtggtgacagaaaatgcttcacctctcacctgatggagggagtgtgggtggaagtgactgaagaagcgtcagaggcaggagcggagtaactttttccccgcagtcttgctggacttgattttcatggctttttctctttccctaactctgcctttccaggaatccatcccctctgggagtaagaaatgaccagggtccgggtgagttggcgttccatttctcctaaaatgccatctccctgaaatgtccctgtgccatgtgttgttttctttattgtcaggcccccagtacggtattttatagctatggatgtagggacattaagatactaaggacatgtagctagcagatgatgtcaccagggtctgcacagagagttttcactggcccatcctgcctccaagaatttattccactcctcagagcagtgggctgtgccctcctggggagcctctcaaagcctgccttttcctgccagacatttcactcacattgaaagtcattccaagctattccatactcatcccagtgctaagtggtctcagcaaaacagatagaatgataaaccacggtgcttttcttcaaggagcttaccatcttgatgaacatattatattacctgtacacaaaaaaatgcatattaatagtgataatttattaactatgagtcaaaaacgaggaaattcgttaaatggcagcacagtggttacaaaatcactctagaaatgcttttcaactaggctatgcatcagaactctctgtggtgttttttaagaactaagcttccttctctcttccagacctagtgaaaggagagtttcactccttttttattctgttgatctttgtacatccaaaggtttattgtgaaatatctctctatacactataagtgtctctagggtaggtaaaatgagttattcatcctttatactcaggttgatttgttctctttcactagcatgtctacatatttaactgttccagtaaattttaaattaccaagtcgtacttttttaaagagagttttcagttgtccccataaaaccatctgtaggaggttacctcaaaattaacccttagactcccagggtatttgagatggtcagcccccacttagaatcccatggtgtttgagatggtcggccccctctttgccctgtcctggcgttttatggtggagagctctaactcggctaactctgagagagccgaaggaaagtgccttgtcctttgtttcagagagcagaaggccagaaataaaccccgtgttttcttccttcaggctgttctttctccattaactaaacaggtcatcacatcagaagttgtttgaataaaatatcagactgcgttttaagggaaaaaaaatgttttttaacactaccagcaaaggccatctttttgcttggcaaatacagccctcacacacatgagctcttagaaaaaatctgtttagaggacagtaagctgacttgaggtactgagagcatggcttctctgtgccctgaaaagtrattgaggacttcaagggagattaaccttagtagaatcaatacattttccttccttcgcttctgcctgctccctaatgattaagtattcactgccgctgcaactggggattgccagtttagtaaattttgagattctggtgtgtgttacacaacaacttttttaatttaaaggaaggacttcattccaagcattgtgtgttttctatgtaccacacattgtccttaggtctgctgaaaggcgggagtcttagttaaccctgcttttcctctgtgacattgggtaagtcacttcgcccttatgaactgtggtttttttctctgtaaactgagggtcttgggcttgactatctttatgttttcttttagttgtattattattcatttaaattgaatgtgaatttatatttatctttcagattccaagtcaattgtggtagttgctggggatttaaagatgagttgaggccagacatggtggctcacacctgtaatcccagtactttgggagactgagtggggaggatcacctgaggtcaggagttgagaccagcctggccaacatagtgaaacctcatctctactaaaaatacaaaaattagctggtcatgttgatgcctgttgtaatcccagctactcgggaggctgaggcaggagaatctcttgaacccgggaggtggaggttgtagtgagctgagatcatgccactgcactccagcctgggcaacagagtgagactctgtntcaaacaacaaagatgagttgagtgtagcccctatccttcagaatcttccagccaacttgggagagacttaatagctatagtagagggatgtgaaagatgctatgagatctcagaggaggagaattctaactcatcctcatgcttcagaaagaggctattgtcctgagactgaaagctccaaaatggatgggagaactcaataagttagggcttactatagaaaggactgtgctagactcaagtgtaatgtgttgaatgactccaggtaatctagtgtgcctcttcctgcttttccacttcaaagtaaattgttagatacagcagagatgggctctagaaagaagtggaaggccacatgatggcatgtatgtagttctgaggaggtcgacatttgtctgatagaaacaggaaacaattgaacttgtgaccttcctctttggttggcctttagaatatcaagtctgctctcccaactgtaagcaggagcacagccttggagtgactccttagtgccactgatacctgggaagactgttgattattcagtgtttcagtcccacctttgtcttgctttaacaggagcactaatttcctttccttttctcctttcccttgtcacaatgattcttttcatttggtctactcctgtcattttttttacctaccacaaagttagtagtccaccaacatatcctttcccttctcagaatggagtcccgcctgccattttatcttgaggaccttaaaaaattaataactctggttgtctaacctagggactggaagatgacaaaaattgtactacaaagaattggtaaggagttattgtagcctaggtaagaaaaaaaataagggtcttactaagactggcagtggaaatggaaaagaggtaacacattggagggaaatttaggaggcagaattgacaggatctgaaatggtttgaatattgttgaggtagagaaggaggattagacaatccagacaactgaatggaagacggataaaaaaataagggagagaaaagataattggtgggcttgcatctctgaagatagaagaagggatttgatctagaatgcacaggaagagattagccttaaacagaaagaaatttttttttctctgtggtctgaagagaaggtctggttgggaagagcagccagtccacttgcttttaatatgccatgggtcatgccttgctaaaggatgtggtgatggagcttgaaggcagcaacctttgcttctgtttgtttgtcccacctttactccggggcttgagcctccttttccagccctcttcctcagaatggagaccagtgaccttgaacagaaagcttgggagacagcacccatccttaccttcatctttaccctcatccttccccactggtgacaagttgggtaagtcatgtcactcctgcagggcaggcccaaggaaggagggagtggtgcctctttagcctcaggccaaagctggcttagctgatcaaatttatgagacagcctttatgactttttatatattctatcactttacttttgaaattgtgccttagagagtggtgccagcccatgcactgtgcagatataagtactgaaattgagagtttcaaaaacaaaaaaaaactggttcttcaccacaggtagtttaagaagcattgcttcatcagacagagccctgaagggaaccagatttgctgacattgactgagtaaatatttggactccctttatgtgccaggccctgcttgaggtcttggggatgcagtcatgaacaaatgaggcagcctctctattcttggggaatttaaatctcagcagggaaagacagtaaataagaaagcaagtgaataagaaaataaggtaaggcataagttataagaagaaattaattaaattaaaccaggaaaatgatatatacaggatgctccagtggattagatggtcagtgacatgctttctgaagaggcaacagttggactgagagctgaatcatgaggaatggagagggcagctagtgcagaagctacaatgagtttgatgcagttcaagggcctgctgggtcactggtgctgaatatgatcataagagaggcctaggttggggaggtgacaggagagcctcatgggccaggatgaagagtctggattttactggatggccactgaaaagcctttggagggtttcatgcttggccttgtttttgttttaaaagatcaccttggctgtcatgtggaaaactcaygtttgggggagcaggagtagagtcagaccaaccaggaggttgatgtgggtgagagcaagtgctgcctaggcctagagaggtgacagtgcagggcaggggagctgggtggatgccgatatgctttagcggtaaaggaggtgggtgataggtgagatgtgaggatgagaatgaaatgacatcggggattttggtttgagcaattgagtggttcrtgtggctgtttactaaaatggggatgactggggaagagcagatgctgatggatattgctggagcaggagttctgttggggcctgttaagtgttttgttttgttttttgtttgtttgttcaactcactgcaacctccgcctcccgggttcaagagatccttccacctcagcctcctgagtagctgggactacaggcacacatcaccacgcctggctaatttttgtattttcagtagagacgaggtttcaccatgttggccaggctggtctcgaactcctgacctcaagtgatccgcccacctcggcctccccaaatgctgggattacagccgtgagccatcgtgcccagctagggcctgttaagttttaagcactttagacgtcccagtgtagatgttaaaaggtagaaaggtggagtctggaggtgaggtaagaggttagggctggaaataaatatttggcagtgaatggtattttaagtcaagggatccctcaggagagtgttttatggctgtgtgtatatgtgctattttattttcccagtaatgttcaattacttagtttagaagaggaagaacagaaagcataggaagtgatttttaacttgtaggatattagagagattcatattttaagagtagaggggtccaggtagtggactagtcccgattatggttattacagtttgatgaaatgtggctgagatcattggcactgtggagattaagaaatgtgaggtcagagtgttgggtaarttgttcctgcgagtgttaaggttgtcaggataatggtgggaatggggtgaagatgacaactcagcaatgacacaagaagagagtgacacagaaagattcagtagctgagaacttgagcgtagatatgttgtgggcaggagggaaatgatttggatggaagtagccaagtaagtgagaaaggaaagactttccaacaaaacttggcttagctcactcagatccctgagctgcaaacttcttctatacctttcttaccttttccagtgctgctgacttcaccccacttgcagggcatttgtgcagatggttgtttgttgaggaggaatgtgcttaatgttttaggaaccagttacattcaaggatgcctctgtggccttcaccgaggaggagtgaggtcacctggactctgctcccaggaagctgtgcggagctgtgatgctgggcaactacagaaacttggtcttggtgggtaaggacatgtgaacttggacacctgcccattggcttctttgtttcctacttcctttttgacacaaaaggatgttttctgactattctaagcagctaaagaacttggtaaaaattggagaatggtagttttactgggttgtctcaaaaaccataccttttccatcctttataagccagaggtgggactgattttgctttctgcacaatcacccaatccctgtgagtttctgaaatgtgatctctcagatggagcaagataaagatcattatataatagcaagtgaacctcaaagagcaccaggcatcatggcaagttataagccaggctaatccacagcagaggaatccctttttcaacgttccaggagttatctggtatcttgcagtctgtgtcgaaagcagggacttccaggatgtttcctatgtgctactgttttacctgatctattcacttactgcccttctacctctgcaggaggttgtggtctttcccagtaatggtcacttgcttctctgtactcctgcctttccccacatttccccaacattggtcatgtgccatctttgcttggactttatttttcattgaatgtcctccccctgcctggcaatatccagtttccattatttcttttcttacacattcaggaattcatccctctcccctcccaaaaataatcgaaattcatggtgagacactctcataccctacaaatagataaaacacttttttgttttctttttttgagacggagtctttttgttttgtttgtttgtttgttttgagacggagtctccctctttcatccaggctggagtctggagtgcagtggcacgatctcggctcactgcaacctccacctcccaggttcaagtgattctcctgcctcggcctctggagtggctgggattacaggcatgagccaccacacccggccagataaaacactttttgactacctgaatcaaggagccttaaacattttcaaatgcagtaattcattttttagatatctagtctaaggcaataattagtaattttaactgaaaattgtgaacaaagatattcattatagaattatttaaaatagtgaaaaaattatttacccactagatgtatcacaggggattggtcaggcaaattatcatggatcacagaaaagtatgtagccattaaaaaatatgttcatgaagaacttaaattagatggggaaatgaatgtatacctactaggttgaaccatatgaacttgccattttatagccaaaagcagccattctacaaaaaacactgaaaagtggctgggcacagtggctcatgcctataatcccagcactttgggaggctaaggcgggcagatggcttgagctcatgagtttgagaccagcctgggcaacacagcgaaaccctgtctctacaaaatatacaaaaattagcaggacatggcggcagttacatgtaatcccagctactcaggaggctgaggtgggaggaccccttgagccaggaaggcagagttgcagtgagccgagatgacactactgcactcctgccctggtgaccgtgagaccctgtcaaaaaaaaaaaacactgaaaaatgtgtcatcatgttagctttcagggtttttgcctccctcagtccacagtgggaccctggttctcttccctcagtaactgtggcctttcagtttctattttcagctaatcctggggagtaaagagaatgctacagggcaaagtggttacctccaggtagtgaaccaggcctttccacgttctttatataaacccagtgcctgtgctctgttcttgtaccaaaattgcccacttggaagtcactactgaacttttgtctctttcagagtttgttccttttttaatttttatttcagcatatttaccattatcagttttattgatggtttctatagtgttgaccttctcttgaaattctttgtcatgcatgaaatcayagtttttctgtttcctccagcttctctcttagtcctttgctctgcagattctctggcttctttttctttttttttttttttttttttttttttcttgagatggagtcttgttctgtcgcccaggctggagtgcagtggcgtgatctgggctcactgcaacctccgcctcctgggttcaagcaattctcctgcctcagactcctgagtagctgggactacaggcgcgtgccaccatgcccggctaatgttttgtatttttagtagagacagggtttcaccatgttagccaggctggtcttgatctcctggcttctgtcttttttctaacttgaaatctcaaagggctctttggttttaagttacatcatcagtgtttctcggcctttttctttatcattactctctccctgccaaaaggagacaaattaaatttctcctgtagaaaaattaagtatgaaggaataaggttttgtcaggtaggattgtttttatgagtcccaaaccagcataatatgtaagatttgtttggccaggtgtggtggctcacacctataatcccagcactttgggaggccgaggtgggcggatcacctgaggtcaggagttcgagaccagcctggccaacatggcaaaatcctgtctctactaaaaatacaaaaattagctgggcgtggtggcgggtgcctttaatcccagctgctcaggaggctgaggcaggagaattgcttaaacccggaaggtggaggttgcagtgagccgagatcgtgccactgcactccagcctggttgacagagtgagactctgtcccaaaaaataaaataaaataaaaagatttgttgtgtcccctatgaaccaattctcaccccttggggacattattgcccctgagaatgcatggtatgtccacttataggaggagctgttacacatttaatggtgttcaactctcctttctattttgataagcctaaaattattttcctttttaagttcccttcttatagtcccacttttgtcagtattaaagttgttccagtctcctagtttagaaataggccatgactatattcggtttctcttgggccaggcgtggtggctcatgcctgtaatcccagcactttgggaggcagaagcaggaggatcacttgagcccaggagttggagaccagcctgggcaacatggcaaaaccccttctacaaaaaatataaaaaattagccgggcctggtggcatacacctgtagtcccagctacttgggaggctgaggtgggaggatcacctaagccagagaggttgaggcttcagagagcaaaattctccagcctgggcaacagagtgagaccctgtctcaaaataaaaaaattttttaaaaaaaatttctctcttctcgtcctcagtatctaaaatctcccaccaattcttttttaactttaacttcttttaagtttattaacactcctagatcccacagatgttgccctaaagtcattctgtttaacgcttaaaatagggtaaaaattagtcagattgttgccatcgtttttcaagctcaagttagatgttgcaggtacactwgtctcctttaaacatcatttatgatgtcattctttggagtgttactatacggtcagtaagtcctgtgaagaatggaacaccgctctgagagaacaaagacgtgatgkaatgcgggttgtgtatgtgtcttacggagagcctctgaagtgacattaaactgggagctaagggatcaatagtttaaacaggtggctagggaggggaagaacattccaggcaaagagaaccatgcaagaagagacccaaagacctggaaggaggagtgtggtagaccacagggtgcatctaagaaggactgagaagaggtggtgaacatggcctggctcagttatggcgttgaaggccctggtaaaaagtagatttatgacaaaaaattagccaggcatggtggtacatgcctgtaatcccagcttcttgggaggctgaggtgggagaatcgcttgagcccaggaggtggaggttgcagtgagctgagatagtgccagtgcactccagcctgggagacactgtgtgaccccatctcaaaaaaaaaagtagatttatcttcagtgggcagccattgtatcaaggaatggtgtgctctgattgacccagtatcactgtgactgctctgtagagagtgatttacaagtagacaaaaatgaaataggagatgggcttccaatttcaagctctgctctaggttttcattgttattaacataaaatggaacatacttgttcaacatttttcttttatgcaagtaagacataaaagtctcaaaaactcaaacaacacagtataatatgaaatcaaatcactttctatggactctgtacttatgtatgtacattacaagtatatgtattaaaattttatgagattacactgtgtatttttaatgtgctgttttatgcagtatgtgttagagcttttttctgccatgttaaatccctataaaaggaccccttttctcatgtcagtattttctcctaatgttatacactcattcttcatatttttttttcttcttcttcttttagacgaaggctcactctgtcgcccaggctggagtgcagtggcacaatctcggctcactgtaagctccacctcccgggttcaagtgatttctcctgactcagcctcctgagtagctgggactacaggtgcccactaccacaccctgctattttttgtatattcagaggagactgggtttcaccgtgttggtcaggctgatctcgaactcctgacctcaagtaatccacccacctcggcctcccaaagtgctgggattacaggcatgagccaccgtgcccagcctcattcttcatattattttaaacatttttttaaaagctaacatcacactttcattaaaatgcacctttcataaaattcctcccccattcattttcatatacctataatttctataaccactagccatttccaagtattgtatgatatggctgttgaagcaatatcctttaaaatccatttaatcatttcagcccatttcatgatttaacgctacaaactgccctgtttttcttttgtcatttttctttttcatttttgccattacttttgaaatttataaataaagtgatacactcacctgggtaaaacaagttgtgtggacagctcatagtaaaaacattcctgtttcctgactctgctgctccatcagccacagtgtggcttccaaaggcactcagttttcacctttctagctgttccatattgggtttgtcttcctactccagacaatatgtttacatattgttatttttctctctcatgtaaacaataaatgcattcacatggttaaaaaataaatataaaacgtgcacagtgaaaagtttctttcatgtctgtagctcttgtctatccaggttctggtcattggcctttaaaaagtgagctgtctcatgtaaatgtcatttcacaaattatgcctgaaaatctgaagagtaaaactctaagttggaatgctgagtgcatatatttatgacattgattgataattgtcaaaatgtctgtccttcgtatcagtttacattcacaagtaatgtgtgtcttcagacttcgggtttgtgctagtgtaacaggtggaaaatggtacctcagtatcctttaaatttagtgtattgtgatatactgttatttctcagtttatcaatattttgtaatttctattgacttccctatattatagatgaggatgtagcttttttatattacctccccaaatgcctagcttcccaagaatttatgttagagtcatgtcagtgatgaatgcttacattgctttgactttgtaattagttgttcactgtagagtcaagtagtacagtatgattatagttctttttaatttttttatttttcctctgaagctaatacttgctttttaaaaatatattttatttggggggttttgactccgtgctgttattgtagagttttgtttatttttttcttttatttttcaactatggttttggggtttgggggtttttgttttgtattttgtagagagagttttgccgtgttgcacacactggtctcgaactcctgagctcaagcaatcacctcacctcaacctcccaaaatgctgggattacagacatgaaccaccatgcctggcctaattatgtattgtattgacttcttggcttactgctatttcttgcagcatgtatcctttttcttaaattttaaaaaattttgctatagtatattcctgaatgattgttttagtaattgaatcttttcgtgtctgaaagagtgtctattttttcctcccactgaaatggttaattggctgggtaaaaattataatttcacaatgacttttaacccaaaatttgaagatattgaagatttgcaatattgccaattagttgttcagtgtcaatataattctcatttatttgcacataacctggcttttctgtttggaagcttttagcattttctgtttctttgtttgtttgtttgtttgtttgtttgtttgttttttccttgaagtcctgaggtttaaaagagtatgtttagtttggggtctttttacataccattttttagcatttattgggccctgaatcttgaattctaggaaacatttttttgttattatttctttgatcattttctctccctgtgttccatcttcactgtcctcatgcagctccttgaagatgggcttttacttttatctttctatttgtctgtcttttcatttgcattcttggagaattcctcaatcttccatcttagccatgtgttcattttactatttaactcatctagattgcaggcgtttgactaaaacagcctgacacatatctaggaaacaagtgacataacctatcatcatcttcagtcattttatttagaattattatttttcatagcaatatgtttatattttattattagattgtgtttaaatgtgatatcctctccagtttttctgggwttttaattatgtaccttttaaattctgttggtctccttatatattttttcaaaattcttgtgttctcagcatgatattrgagtgtgtcctcaacccatgcttgacccactttggcatgcatatgtgttttactttaggggacacttctgctgattgggctagggagggaggtaataagaatccagatggtggatattataggcctttttttttttttttttttttttgacagttggcagagctagctgaggttttattttgggaaaaagaaaaaatttgaattgttttgtagctggatacatgggcaaggggactacccaggcagtaaactggccccacggatgggctaagggctaagggctagggctgagcctcaggtgggcctcctattccctgtactcccctgcacagtggtgtaggccattttttaagtccacctcttttgccactgagttatctggggcatgccctgcttctttatttccagcgctgggctatcttccttgtcagaactcccattaaaaagtttagcttgaagttttatcctgggcacttatgttgtcaattacttcttttttgtaccttaatccattggtcattgtgtacgttcaacattacctcaacctctgcttctctcttcagtccagttaatattattagcagtctttctttggcagatcatttattttattcttgaggctttatatgagggcactgctgctagccatccaatatttctatttctaagaggaagagggtgggctgggagagtgctgctaacagcaaaaactagcacagctgttaggaatgcctaagttgaattaggaaatgtcttactttatcattgtttattattttctgagacatagactccagagaaatggggtcagtgctcccttactttgtaattattgattctgagtttggtaattgaatttctatgatttcttaggatgttttacccacgaagaagccttctgttatacataatttgagctgtacatttttttcccctagttcctccatcactcctaatccatctgctccttatcatttaggagttcctcaatgtttttattctgatgatatcagcctttctgttttcccaagagtattatggatttcttgtcatttcagtgtaatattaggctattcactctaattgtttaagtctcggggagggttttgtttttgtttttgttttttaatataccagtaagtctaaactctgtattcctagcacagttctctcacaggagttccagacctatatatatctcacagcttackgaccagtactgcaagaatgttccaccaacaccacagattatacaaggcagttctgctgccttccctayttcagcctcttcctgttgcatttcctatctgattatatagcaccaccataccgtcactcaggcaggaatcccaaggaacaggcttggtgcctcctttctcttctaggtttagtttatcatcacatgatctagaatgaatttctcctattctctccacaactatcatccttaccgtttttcttctgatttgctatggcagccgtctcgctacctaaagtcttgctttccagtggtgtttattgtcacaaagtcagtcatttcactctgaattaaaattctttaatagttttcaatcccttcagggtttagccccarggtccttattattagacactaagccctttgctctgtcctcttacttcccctccgtggcacattcttcaccactcttactgtttttatctccttcgtaagaagccgcttgtagttttctttaacatgtcatattttctctccacatttcacttccttttttttgtttgttttttgtttttcctgtcattttctcccagaaatcttcctaaacaccagggtctgagttgagtgttcctctgctgtgctttcgtggctggttaggcatacatctcttgtactgtattgtactatacattcatctacaccactcacttagtattatcattatttggtgtatttgtcttcccaggaagctttagcttgttaagcaaaaggatttatattttcttccttgtattccccacacctatgaaagcagaataccaattaaatgcaaatttacttaaaggaaagtaggcygggtgtggtgactcatgcctgtaatcccagcactttgggaggctgacgcggatggatcacttgaggccaggagttggaggccagcctggtcaacatggaaaaaccacacctctactaaaaatacaaaaattagctgggcatgatggcatgtgcctataatcccagctacttgggaggctgaggtgggaaaattgcttgaacctgggaggtggaggctacagtgagaccagatcacaccacggcactccagcctgggcagcagagtgaaactccgtctcaaaaaaaaaaatgaagtgagatgagatgaaatgttattgttagcaaggatataggacttacagccttctataggattagttagggaagactttccttggctatgcttaaaagccaagagaaaatttctgtcttgtacccagatacaaatgtacctgaccttaacccaaaggacatgactataaagacaagctgaactttttcctagttactaagacttcaggccttaggcactctcactctgaaatcttgaagtctaccctttgttcttaccactgaattgtctttgttccctaggagacttgaatgaaaattctgtggagaatcttcarcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcraaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagstcatacagaggagaaaccctgtgaccataataactgtgggaaaatacttaacaccagcccagatggtcatccatatgagaaaatccacactgcagagaaacaatacgaakgtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccytatgagtgtgaggagtgtggtatgagcttcagtcagcgctcaaacctgcacatccaccagcgagtacacacaggagagaggccctacaagtgwggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacwtgttctacccagcattttaacggcaagaactttatatttattctcaagcagggcatgtttccctttgttcacattctctgakaaattgaaactctggtttctcttcaaattttgtgccttgtgtttttcatacttctttccagtcctgattagccccctctaaactatgattgtacactgcgtccattttaggccaagagggcagttggaaatacaatggacatggaaattattgtgtttattgcaaaaagatataatagtttgtagccacacaacaaaaagctggaagagagttactcatgtagtacattcccatataccattttgataggaagttgaacagcccctcccaggcaactattcaggaacataagtagtcctttttggtgagtacagctagtttattgggatacttccagagtgaatgtgaggaagggtccaaagtaacatgcctggcactttgggaggctgaagagggtgcatcacttgagcctaggagttcgtgaccagcctgggcaacatggcaaaatcttgtctctataaaaaagtgcaaaaattagctggtgtgctggcacagacctgcagacccagctactcaggaggggtacctgagagcaggtgataataacaaataggttccagaggcagagctggaaaaatgaatacataaggagcagggggcagcttagaggctgcagaaatcatgttggggcttgataagctaaaaatggctagcacagaaagtattcgagaatgcacttttgttaaacatgtctcatcacattggacaacattaagatgcgaggaaaatttaatttatcaaactacagcaataaggagaataggagaaagactatcagcaaatgaaaatttgaaagatggaaagatagccagtagagcagaagcaggcacagttatgctgcttgcatatggggataaggaaaagaaggaaccaatttggcaccaggctcagaaatgcttagtaccttggaagatgggagtgagatgtgaagagaaagcaatgaaactaatggccatttgtatatggaacatacctcctcattacataaacacacactgctccccaactcctgtacgtggctgaccagaggtttaacgtccagcaagaaatgggaagtttcttctctgcagaagttgaatggccccaagggaaagacctctgtattatgggaattcgggaatcctacagcaaagctactttctagcttaagtacacataaacagagcttcaaaattcatgaaataaaaactggcaaaattgaaagaggcacaatttcaattataattagatagttaaataagtaattgatagcacaagtcacttaggaggtataagccttgaacagcactatcaactaacttgactaattggcatttgtagaacactcattagcatgatatattaatatatttttattttttagggacagtgtgtcactctttcacccaggctgaagtgcagtggtgcaatgagttaattgcaaccttgaattcctgggttcaatcaatcctcctgtctcagcctccagagtagctaggactataggcatgtgccaccacacccagctattttttatttttgtagggatggagtctagctctgttgcctaggctggtctcgaactcacaggctcaagcaatcctccctccaggacctcccaaagcactgggattacatatgtgagccactgtgcccaacctgtatacattcttttcaagtgtgcctactatggactgtaataaaacagtcttaaaattttttaaagaatgaaaaccatacaaggtatattctctcaccaggacagaattaagtaagagaccaataacaaagatgtctgaacaatctcttagtatttggaaattaaacaacatactcctaaatgagcaataaagagaaagtaagaaaaatttgaaaatattttgaactgaatgaatatgtcagaatttgtgaaatgtagctaaagcagtgcttagaggtgaaatcagagataaagatttcaattcgatagtctaaacttccaccttacgaaatgagaaaaagaacagaaatcatccaaagcaagtagaacaggagatgatacagagctaaaagtcacaaaaatcacaagtggacaaacaatagagaaaatttaatggaaccaaaacctaactctttgaaagggttgaaaggattcctgtatcaggaatgaaagagtaaatatcactataggtcctatacaccaagaaggtaatacaggaattttattagtaacttaattccaataaattcagcaacttaaatgaattggaaaattttatcctaaggactatagaaccaaagcccacttgagagaacttgaatagtcctattaaattgaatttttagctgataaccttcccccaaagaaaagtcatgagaccaacattacccagataccaaagccaaaaaggacatcataggaaaaactcatagatcaatatctcttaatatagatgtaaaaatcctttttaaaataccaagttgaacacagcaatctataaaaggaaacacatatggccaagtagggtttatcctagaaatgcaagctttaacattcaaaaagcaatgtttcatattaatattaaaaagaaaaaccacataatttttttaatgtaggaaaacatttgaaaaaatttaacacccattcatgataaaaccgctcagttgattaggaattaaattgagtttcaagaatctaagaaagagcatctatgggagaacctacatctgacatcgtacttactggtgaagtaaaaagcacttttctcctaagattggaaacaagagaaagatgtctagtcaccacttccagtcaaccttgtagtggatgtcctagccagtacaataagccaataaaaaagaggctgggtgtggtagctcatgcctaaaatcctggcatttttgggaggccaaggtgggaagattgcttgagcttaggagttcaagactaacctggacaatatagtgagacctcatttctaccaaaacttaaataaaaattagccaggcatagtggcatgtgcctgtagtgccacctactcaggaggctgaacaggaggatcactggaggcccaggagatcaaggctgcagggagctgtgatcgcaccactgcactccagcctgggcgacagagtgagaccctgtctcaaagaaaagggatacagaatgtgaaagaaggcatgagactgctgtgacatgattgtctatatggaaaagcataaagtgtctgaaaatgtttttaaaactagtaagtatgtttagcaaggtcacaggatacaagctcaatatttttaaaaagttgaaagtatgaaaacggcatcaaaattatgaaatgtagggacaaagttactagacctgtactaaagctacaaaacatgtactaatgctagaagaaagtaaataagtcctaaaaataaatagatacactgtatgcatgagttataaacctcaaggacctacaaagtcaaaacaattttttaagatttttttcttcttctttgagatggagtctccctctgtcacccaggctggagtgcagtggcacgatctcggctcactgcaacctctgcctcccgggttcaagtgattctcctccctcagcctcccaagtagctgggattacgggcgtgtgccaccacatccagctaatttttttttgtatttttagtagagacgaggtttcaccatgttgaccaggctgatcttgaactcctgacctcaggtgatccacctgccccagcctcccaaagtgctgggattacagacttttttcaaaactaaagatatagtgatcaagatagtatggtactggatctaggctacacatacaggtaaacagaattggactcacccatatattttcaagtggttttcaacaaagatgcaaagataaagggaaaagatagagttttcaacacagttctgtaacaattgaatctttgtataggggaaaaatgagtaatataagcatgaaaaccataaagtgcctagaagaaaatcttcattaaagaggacatgaaaaacgtaaatcttagaagaaaaaattaagttgggtttcatcagttttaaaacttatgttgtttgaaacttcatatcaagaaacgaaagttatggagtggggggaaatatttataggacaaatatgtgatgaagaaggacttatatacagaatatattaaagactcttacaacccagtaattcagaaaaacattcaaaactggacaaaaggccaggcacggtatctcacgcctgtaatcccagtactgtgggaggctgaggtgggcggatcacctgaggtcaagagtttgagaccagcctgatcaacatggtgaaaccccgtctctactaaaaatacaaaaaaaaaaaaaaaaaaaaaaaaaaaaaaaaaaaaaaaaaaaagctgggtgtggtggcggtcgtctgcaatctcagctactcaggaggctgaggcaggagaatcacttgaacccaggaggcagaggttgcagtgagccaagatcgcaccactgccctccagcctggacaacaagagcaaaattctgcctaaaaaaaaaaaaaaagaaaaagaaaaagaaaaaaaactagacaaaagaatgggcattttatgaaggaacatatgcaaatggtcagtaagcacctgaaaggatggtcaatatcattaatcatcagagaagtacaaattcattttatgatgccaatattttcctaataccaaagttgtcagacagtagtactaagaaaactgggattacagttttcattacattacattacataccatacccagcccaatatccttaatattgaaggatacaggatacagatcaatacccttcatatcctgcatacacaaagtcctcaaaaaacattagcaaattgaggctgggcatggtggctcatgcctgtaatcccagcactttgggaggccgaggtgggtggatcacctgaggtcaggagctcgagaccagcctggccaacatggagaaaccccatctcttttaaaaatacagaattaaccaggcatggtggcacatgcctgtaattccagctactcgggaggctgaggcaggagaatcgcttgaacgtgggacgtggaggttgcagtgagccgagatcgcaacattgcactccagcctgggcaacaagagcaaaactccatctcaaaaaaaaaaaaattagcaaactgaacccaaaaatatatcaacagaatcatgcactacaactaagtgaggcttattccacgaaggcaagaatagttcaatatattaatccaccatattaataggccaatgaagcaaaagcacatatcaaataatgtaggaaaaaatgtgacaaaattcaacacccattcatagtaacctcaccaagctaggaaaagagagaaacctcctcagctttacacagagcacctaaaaatatgtacagttactatcatacttaatggtaaaaaaaaaaaaaaaaaaaaaagcagtgctttcttcataagattgggaacaaggcagggattccactcccacagctcttattcagcatagtacacgaagtcctagtcagtgcaataaggcaataaaaaggaaaaagacatatagatttttaaaaactgtcactgtttgcaaatgacacaattatctacacagaaaattcaaagggatacatgcatacacacacgacgagaataaatgagttcatcaagatcacagaatacaagatcagcataccaatatcaactgcatttctgtgtgctagcaatgattatgtgaaaactgaggttaaaggctgaataccatttacaatcactcaacaataaaaaaattacttaggtataaatctaataaaacatgtataggacttgtatgctgaaaattacaaaacactaataaaagaaatcgaagaagatctaaataagtcgagacatacatattcattgatatttgagatgtcagttctcttcaaactgatctgtagttttaacataattcctatcaaaatctcagcaagatttttttgttgatgtatgcaggcttactctgaaatttatatggcagggcaaaggaactgcaaccactg

SEQ ID NO: 10572 - DNA, 13132 bp, Homo sapiens
  misc_feature (1)...(13132): n = A,T,C or G, or insertion/deletion polymorphism (see Tables 1-2)
cttgaaatggagtaatgttaaactaaaaggagatctccagcaacatgccaatatgaatgatataaatagcaagttggtagataccacaaatctgggttggggggtgatggtttggctttgtgtcctcacccaaatatcatctcgaattgtaatccccacatgtcaaggaagggttctggtgggaggtcactggatcatgggggcagtttctcccatgctgttcttgtgacagtaagggagttctcatgagatctgatgtgttttaaaagtagcagtttcccctgcattctctctcttttctgctgccatgtaagacgtgccttgcttccccttcaccttcctccatgattgttaagtttcctgaggcctccccagccatatggaactgtgggtcaattaaacctcctttctttataaattacccagtcttaggtagtatctttatagcagtgtgaaaacaaactaatactgggagaaaatgttttaaatgacaaaatcagaatccctatgaattatcacagactggtacaaaggacaagtgaaatctaacaagataaattataatagggataagtataaggtctggtattcagatccaaaaagccaactatacaagtacagcaagggaaagacatgacttagcaacaatgcatatatttttaaaaggaaaaaagaaaaagcaaaaaaaagaaaagaagaagacttgaatattttagcttaaaatgaattcaaaatgagtccacacttaaaatttgaattataattaggttataattaatactgggttatagtttatgttaatacaaccatagtattttaaataaaggagttgacaatctttcacagaccataactgagtatagtgctcagttccatgagccataacttaaaagtttgtttgtatgaaagcagtcaactgaagaaagaatttgaaaccattttatatgaagaacaggtaaaggaactagaaatgttcaatctgaaaaagaggagccaatggatgaatacttaaattccttatgtaaaactctcgaagaagaaattggaacagttgggtgaaagttaccacacgtcagctttcaccttggtgaaggttaccaaatatagggaaaagttttgctgcctctggaggttgtaagttcctgggtaaaaagaaagagtgaagtattcacttggaaacaaaacaatcactttgcaggaatgtcgcaaattggattaaactgtcagaatgttttagtacacaatgaccttcaaggtccttttcaaccttcaaagtaaataattttagaaataattactgtatatactatatattattttatgactttaggattgtccctaaatttttttttaaggaggaatgtaaaaactccacaggattacaaatccttacattaaacattttaaattatatatattagctgacactgctttggcatcaagcaaacttaaaacttatagtagtataaatgtgtattttaaaggaataagtataacaaaccccagataagtgtcaagtacttacatgaatactaatatgtctctggtccctaagagatttagagggacaaattcagtctgagtattttcaaaatatctgtatagtttttttcatacatataaaacactaaaggtatgacagattattttttcactttttattttggttttggctaaatgcaacctgaatccccaacttcagactgatctactgggagcaaatttgagatggctgcagacatccagatgttctgtttgtttggtggctggcaaacagcccctttacttcaaatactgcccactttggcagactggtttgttgattacaaagaaaaatcccattaggaccacccctaataagatgatagtctttagattattcaatcattaaaacaacaaaaataatatgtaaatcaccaaaaagttgaattaccaaagcactgctgaatttttgtcatttatttacaaattcccctgtgaacaggctctttcttgtcatttatttgctttggcaggccacttatcaaaacagagagtctaaaaaagcatcccaaataaaatgactggttccactaatcatgtcatcaatggtattattcattcttacatttctaaccacctttatcactgcttctgggaaagcaactatacagcatttaggcagtaagggatcctttaatgtatcatagcacagtttggcacaccaaacaatagcataacatccaatcatcatgaaacattaatccttaaaatattaggtggtcaaaataaaatatttatccacaacagtgtacatacaaatacatgaattaatgatttccagaagctatgtgttttgtgcagtctaaagtcacagctataaatatcaaaaggcaacagaaaatggtgtcaataagtgaacacaaatgccccaatatattgcttttattttagtaatttcatgcacatctgcatttaaataattttttaaaggtaaaaagagataatcctaccacatcatatgttgtttgttatgctatagaagacaaccatattttcaaatactccttcagtcactttttcatcattactagtggacagtattgattctattttgaccatataatgtatcacagaatatcacaagtgcaaacaaagatgaagagaaaatgaatgctatgtgcatttgtaaaatgccacagcaattattcatttgtttacttggtcaccttttctctggccaggagaagctagggccttaagcttcacagaaaagttggtctgtcttccattttacatatatgagagaccctatgcacacacacacagacacacataagcacattcataaattattttaatcaaacataaagcattcaacctgtaaaagcaaactgtaggcaaaacaaaaggtgagttactcattccaatctagtaaagaatgtcatatctttctttgaaaagtgaggaatataacaaagggccatagagtgagtttttttttttccaaataaaaatatgtttgtgggttctttaaatataatcttagctcaaagtagctctataaagcattcaagtattccccggggtggaatatgataatatgtgaattctttaacaatgttttagctggtcatgtaattcattattatgatgaggaaattaaatcaacatattcatgctgtttttcttataaagataaaaggatgtccagtttgaatcattgtcaagttgtcatttttgaggaaaaatctcattacataatcttcactttcagtgcttgcaatcaatcttttacttataacaaattaggggagaagtggcttttctcagttgagacttgtttctacatgtctaaatattgagctattcagggtcatgataaactccacgaaaaagagctgaaggccttagacacatgtaagacctttgtgtacatggttttcaagaatcagcttatttaatttaaagctctgtttctgtgtctctgataagagattaggagaggtttctgtattttgtaataatctataatttaagtcctttagttacttttcctatgaaatccttgatcaatttaattctgcaatgaaaaatgttagggtatgtggttcactgaatacaggatatgacctgcagtcgacacaaagtaagttaagaactcaatacccctatcaaaattagtacggaacattcataagtgtatgaatatctttctcacattgcatcactctcatactgactactcttctgcctctcacttccaccttttataccccttattatgacattgcaccaacccagattatccaggataatctccctattttaaggatagttgattagcaatcttaattctcctttgccatgtgaaataacatattcatgttttccaaggattaggacacatacatcttcagtgaccattattctgtctaccgcacctgccaataactacatgagtgagcttggaaatggatcttttcacagtggcgacttcagatgagctcccagccctggcttacaactttagtgcagctttgtgggagaccctaaagcagaggtcccagctgagctatacccagattcctgacccacagaaactgagataataaatgtgcattactttaactgctaaattctggtaatttgttacacagcaatagataaccaatacagtacttaaaactattgtttttatttgcacattttagctaggttttatttttgcatccatttaattagaaataaatgtaccttcttgatttcaggttgtggaaattacaggttacatttaagttattcaaaccaatagttggaatgatcaattaccatagtgtttataatgaaaagctccaatgtactaccctcacatattaattatatgaaatcaacaataaaaatcactcttattttagctacagactgatccttagaatctgattacagtataggaagatgatcagtcagagaaaaaggcatggtagcctagccacaccacaatgcttgcaattataaagaaattgtagtgcattcaactgaaattttagctgctggaatcaaattaatgtgttgctagttacattttcacttcctccaaaatcaaggatgttttctcttctttatagaacagggagcaccaagagatgaaattaccataaaaactaaaaagctgatttatcttgcaatgtttttcggtatattcaatgggtgatatgtgtaccaattggtctgtaactgactcacttaattggttaaaccatggaaataatgagtgaagttaattgccctcgatagaacggaactcaagactctttagcactatgttcctctctgccaaatgaatactgtttttttaaatgaatcatggatattaacaagctttgccattcactagtgagaaactataaatttgtacatgtccatatatatgtattttttgatagctattcagagagactgcctgtttaatgccaatcagttgggtttcactgttacttctgggtaaggaagaataatcatacaaatggttttataaactgaaactagtacgtgctaagcatgttttcatatattaattaacacctgtattctgtaggtataattattcccattttatagatggggaaattgagtcagagaaagaataagcaacttgcttaatatcacatagctagcaattgccggtgctaggatccaaaatctgtttatccactatactacacaagagttccaagagttttaatagtcttaattgttctaaaattcagatgtctaagtagaaaaactatatttattagtgttatggattgaattgtgtccccccgaaaaattcatgttgaagttctaaactccagtacttttgaatgtgaccttatttaattagttacaatgagctcactagggaggcccctaatccaatatgactgctgttcttataaacagcagaattttggacaaaggcagacacacacagaggggaaacaatgtgaagagacacagggacaagacagacattcacacccccaggagaaaggcctagaacagagtatccccccatagccctcagaaagaaccagccctgccaatatcttcgtttcgggcttctagccttcaaacctgtgaggctaaatttctgttgtttaagccatccagtctgtggtactttgttaaggcagccctagcaaactaatacgatgagtattacttttttctagatggtaataaaaatatggaaatttctctgagaaaactctatctggctgtcaaatgctgagcctacactgttttctagtgaatttttaagttttattccagttggtggtttcatgcattactttatcgaagcacatgaggcaacggttcaagcaagcaacctccagttaaccaagtcaaggtggtcgaatcctatggatgagggcatcggatggcagcccccgggcgcgggctgacaagtggagctggcctgaacttccgggccttcggaccttccaggagaattggatcccagccacaccaggagctgaagccatggcctcaaagcctgagaagagtgtggcatcrtctgtctttatcacccttgcacccctgtgccacgatttagctgtggttgaggaagggggcaggcggtttgtgaggcctgatgtggcctcccctgggaggctcctgcccccatgaaggcacccggagctggcttagcgggaaagcccagcccctgggcaccccctggcagggctgcagccacagtgccagctgcacctctgcagctctccaatggaggatgctcaccccctcctcctgtcctggatggtraggacgcacttcctgacctggacctcgtcccaccccctccactgccccctccggtgctcctgtcttctgaagaagaggctcctgctccaatgggggcctcactcattgcagacttagagcrgttgcacctgccctcgcccccaccccgaccacaggccccagtggagggaccttcagtccagcctgggcccagtcccctcgggcctggggaggaagagcttccgccttccccagcagagcctgttgagagagagtcgtccacagacatctgtgccttctgccacaaaaccgtgtcccccgcaagagctggctgtggaggccataaagaggcagtaccatgcccagtgcttcacgtggcacacctgccaccgccagctagctgggcagagcttctaccaggatgggcgacccctctgcraaccctgctaccwggacacrctggagaagtgcggcaagtgtggccaggtggtccgggagcacatcatcagggccctgggccaggycttccacccctyctgcttcatgtgtgtgacctgtgcccggtgcatccaggatgagagctctgccctgggcagccaaaacgagatgtactgcctagacgaattctacaagaaattygctcccgyatgcagcatctgtgagaatcccattattcctcgggatgggaaagatgccttcaaaatcaagtgcatgggaagaaacttccatgtaaattgctacaggtgtgaggactgcaggatcctcctgtctgtggagcccaggaaccaaggctgntaccccctggacaaccatctcttytgcaagcagtgccacgysaagcagagtgctgctgggtgctgctgagagcaccgctgggtgttaggcagtgagcggaccactaggtcccttcctgacctgctcttgcacactttccttctgagcttccatggggaccagcctgtccaggacacagcagggctgagcacccccagaccttccactctaccctctgggcaccagaaggctcctggaccatgagtgtcaaccccagaattccctgctggccccaaccctcttccaggagaaagctggggggagtctgctgggggcacttggacccctagcattgactgtagctctctggtaggggtgctgggaccagtccggcttgcagggttgagccatttgaggaaaaactccaaggtcccttaaaaagtgctttttaggctggccatggtggctcacgcctataatccaggcacttcgggagtctgaggcgggcggagaagcattttccacattcgatcctgccaactgatgtcccacacacaggacatgcccttattcaagctgcttcttttgattctgcttttatattaaagggtagaaatggaaatgggagtgtgaaggcaatgctgctcctgcctaggctcactagcagggtatgaagaagtgtaggaatgggtgagcagtaagagaaaatattgcttctcttgttctgaggccctcaaagactctaataggcctcttcccacttcccctgcattcacttgctcagagcaatacccatgttcctcatccatcaccaccacctccgtaagtgcttgcaaggcagcagcaccaggcccactcctaccatcactactggcagcacctggagtccttcccctcttcctccaccactacaatttctactcttcctcctgtatcatatcagctctagatttagacccagtaggaaaaaaaaaatacctgcacatacccatattcccaaacatacaggagccattaggatatacaaaatattatagtatctgtccctctccccaacaaaagttaaggtgtttgttccccaacagcccccttcttttcttgtactcttgtcccaggtaaacaaagcccttactgtttgtcacatctctgagaaaaatttctggtatggtaagattatttttgttgttcaccctttatctcaccatactcattccaagaagatgcccagatctttcccctgccttatcttaggggaggtttatgcttccagcctgtatttggttttctttaatcctgaacatcttgaaagaattatgctgacagaagagtgacttagagaacagaaagaaaagaaggagatttctgctcatgataactaagcaccccttactctatgcaaagaccccagaaagaaagcagggccccaaaggagaatgggtacatggtgcatgtaaggaggctggaccctaggcatcaaggcttccaccatcagcagacatttccatctcccactggccccacagcagcagaaatgcccaccttcaaggtactatgtggacttagacaatgagtgtaggggggaatcattgtctaagtccacatagtaccttgcccccattcttgggtaactccttagaagaggaggggccctccaatagtgaatgagattgaacttttcttcacttcagtgggatgaagggcagatgcggatttaagctgccacctctgagcaaacctgccctgagatacacactacacagaagacacagcagtcaaatgcacattctttattactagttaggcccagaaaatccctgacaaacattgattttggtgagctgggtgggatctcattgggaaactcaaggacatctttagcttggattgaaggcagatctaaccaaccacccctgggctccaccctggctccttccttgccttgcagcagttgccttgggtaagcctgcagagaacacaccaaagagggagaggtgggggtcctggggtattcccaaaagtgcttgccccagtctagctctatttttaacccaatttatcctcccaagagaaacaccatccataacctggtgcccccaatgtttgtccttggaatccattttgttcttcatccactgctgactgaaaagggacttgggatgggggcagcctgaggctgaaagctagcgtgtgtagtgaacactccccaaagcactgtttttcttcaagacaccccaggtctttcaggcaggctggtgggcaaccaggaaaatagctatccttctcaaaggaggaaatcagcagaggaattcagaaaagctctgcctgcatttttgtgaggacactttcccaaactttgtcactgctcatttatctcacctgagaccaatgagacaagcagtttggttactcaagacctttcataagggctgggcatggtggctcacagccactcgggaggctgaggcagaggatcacttgagcccaggagtttgaggctgcagtgagctatgatgatcatgccactgcactccagcctgggcgacaaaatgagacctcatttctccaaaaaattaaaaaaaacaaaaacaaaacaaaaaacctttcatgaaagtctctttcgcattggccccagaaccacagaaatggatctggatgttacttcaattggttttatccaaggtcacgctatatgcaaggcaaagaatacatccctgatctaatgtgtatgccaaattatgctctttcctatcttctaaccgaattcacaataaaagattatgctgtgtgtactagataataacatacaagtctagctcccaaaacatactaggcaataactatttctttaatgaattaaatgaaattaattaaagttgctatcagctatagaatttaacactacaaccccctaaactctttccctaaacttctcatttaatgaattaagtgaaattcatcaaagttgctaccatctatagaatttaacactacaactccccaaacttttctaagttaattcccataccaatgaaaaaattcaactctacaaaaacaattttgttctcccttttccccctaatgagtgtcaaatgatctcttcttccctgacttcctttcactcttcttgactgcagccagttggggtctcagtgaggtgtgggtccatcagaattgaggtgttacttcttgtggctttggcagatcttctaatgtcacaggttcagcttcttcagaaacaagcaagtttggtggagctaagacacaaaaacaggacttcacctgtaaaactaataaaacaaaaataagcaaaaatcaacactgcagtaatttcaaaaggaatgatagcacttgcaaggaaaagcagtgtttctagaatacaatatagcctggaactctaaaatcacatggctgctcccagccaaatacatggcattttcaggaaaaggaggttaagagaaaaaaaaaaaacagaaaatggttgatttaaaacaggctttataactataacttcagcttctccagggtgtcaaccaattagtatcagccaaccacaatctactacctgaaaaagttgacagcaattaggagaaatcccctaattaaagactgagtgttatactcagaagtagtctctctttattcaaataaatgaataaaataagaaaataaatacatacgtatttgtgtgtatgtatactcacaatgataaaaagtacttaatttgggtaataggataatggattattttatctaattttctctacaattttggtttcaaattttctgttaagtaaataagttacttttttatcagaagggggtcctgggaaattggtttctctttggagtgcttccatcttacttaccttcctgaaatcaatgagtttacgctgggtcaacgctgccattctcaactggcatacggactctcttgcatttagagcacaccttgttccgtggaaaattcatggcattacaccatgggcaggcccaattcactgggctggagcatgaggcaggcttctgttgctgggattctgaggcctttttccttttttgttccttgaccttctgcccctgaggctggtgtttccatgggctatttttcacaccatggctcttgctatcctccagaggggttacctggggcctctcctgatcttccttctggctgtggctcttgctaaacctcagtgaggctgtgccctggggaatcactggatgtttcttcaggctgtggctgttgctgtcccccaaggagaccacctcctggtgcaccactggatctttcttcaggctgtgactgttgctgtcccctagggggaccatctccttgggcatcactagatctttcttcatgctgtggctgttgctgtcccccagggggaccatctcctcgggcatcactaactctttcttcaggctgtggattctgctgaaccccagggaggctgtcccctggggcaccactggcactttcttcaggctgtgtctcctgctaaacgtcaggggagctgtgccctggggcaccactggatctttcttcaggctatggctgttgctgtcctccagggggaccatgttctggggcatcactggatctttcttcaggctgtggctgtcccccagggggaccatctccttgggcatcactggcactttcttcaggctgtgtctcctgctaaacatcaggggagctgtgccctggggcaccactggatctttcttcaggctatggctgttgctgtcccccagggggaccatctccttgggcatcactggcactttcttcaggctgtgtctcctgctaaacatcaggggagctgtgccctggggcaccactggatctttcttcaggctatggctgttgctgtcctccagggggaccatgttctggggcatcactggatctttcttcaggctgtggctgtcccccagggggaccatctccttgggcatcactggcactttcttcaggctgtgtctcctgctaaacatcaggggagctgtgtcctggggcaccactggatctttcttcaggctatggctgttgctgtcccccagggggaccatctcctggtgcatcattggatctttcttcagactgtggctgttgctgtcctccagggggatcatgttctggggcatcactggatctttcttcaggctgtggctgttgctgtcctccagggggatcatgttctggggcatcactggatctttcttcaggctgtggcttctgctgtcccccagggggaccatcttctggggcatcactggatctttcttcatcctgtgactcttgctgtcccccagggggaccagctccttgggcacaactagatctttcttcaggctgtggctgtggctttcccccagggggaccatctccttgggcatcattggcactttcttctggctgtgcctcctgctatacatcaggggagctgtgccctgggccaccactggatctttcttcaggctatggctgttgctgtcccccagggggaccatctcctggcacatcattggatctttcttcagactgtggctgttgctgtcccccagggggaccatcttctggggcatcactggatctttcttcatgctgtggctgttgctgtcccccagggagaccatctccttgtgcacaactggatttttcgtcaggctgtggctgttgctgtcccctatggggacaatctccttgggcacaactggatctttcttcaggctgtggctgttgctgtcccctagggggaccatctccttgggcatcactggttttttctccaggctgtggctcctgctaaactctgggggagctgtgccctcttgcatcactggatctttcttcaggctgtggctgctgctgtccccttgggaagtcattccttggggacactcagaaccttccttttggttgcagcttctgttatctcctgggtgatatactccctggaaattctcaggatatccatcctggccatggcacttctggtcccacggaggggccgtctcctcctgggatcccactgtggcccaaagaccaggtggatagatccctgcaggaggcatctgtggtgca

SEQ ID NO: 10573 - DNA, 12936 bp, Homo sapiens
taaggggcagtgattttaccattaaagatgaaacattactgagactcagggttatagaaaatttgaagtgaaacatgatttgttccaaaccaatctccaaataggccagtgtatctgggcgttactggctttgtacatatgtttaagtgaacccttctaatctctttgaacttcaattaccctgtctgtgaaagagaagggtaaagaatacctcctcgcagctcaaagagtcattaggaagaccaaatgagataatgtatgtaaaaatacttagtacatcatccagcatgagttagcaaaatctccaaatgttctttattattcattctttggttacttctgtttttctaacagctttgggaccccagaacagaacaatgcattttgtgactgagtttgtcctcctgggtttccatggtcaaagggagatgcagagctgcttcttctcattcatcctggttctctatctcctgacactgctagggaatggagctattgtctgtgcagtgaaattggacaggcggctccacacacccatgtacatccttctgggaaactttgcctttctagagatctggtacatttcctccactgtcccaaacatgctagtcaatatcctctctgagattaaaaccatctccttctctggttgcttcctgcaattctatttctttttttcactgggtacaacagagtgtttctttttatcagttatggcttatgatcggtacctggccatctgtcgtccattacactacccctccatcatgactgggaagttctgtataattctggtctgtgtatgctgggtaggcggatttctctgctatccagtccctattgttcttatctcccaacttcccttctgtgggcccaacatcattgaccacttggtgtgtgacccaggcccattgtttgcactggcctgcatctctgctccttccactgagcttatctgttacaccttcaactcgatgattatctttgggcccttcctctccatcttgggatcttacactctggtcatcagagctgtgctttgtattccctctggtgctggtcgaactaaagctttctccacatgtgggtcccacctaatggtggtgtctctattctatggaacccttatggtgatgtatgtgagcccaacatcagggaacccagcaggaatgcagaagatcatcactctggtatacacagcaatgactccattcttaaatccccttatctatagtcttcgaaacaaagacatgaaagatgctctaaagagagtcctggggttaacagttagccaaaactgagatatctttgaaaaagaagccaaattggccacttctgaccttaattttttataactatagagagtagcttcagtagtatgttctggctcacactcaggtagacagacttatctttcacagttccttagcagttaaatgcagctcattaatgataaatgccaatgctcaataaaacattttaaacatatgtggcctcactgagtagttatgtggtgggtgggtgtatatatacgtatattatttttctgtgatgtatctttgctagttttaatcttagctgacagaagaaatcaattgcatgtgtactgaaacctttcaaaagagtgagatctggctgggcacggtggctcacgactgtaatcccagcactttgggaggccaaagcgggaggatcacctgagatcaggaattcgagaccagcctgggcaatatgatgaaaccctgtctctactaaaaatacaaaaattagctgggcgtgatggcacacacctgtaatcccagctactcaggaggctgaggaatgagaattgcttgaacctgggaggctaagcttgcagtgagctgatatcacgccactgccccctagcctgcatgatagagcaagactgcatcttaaaaaaaaaaaaaaaaaaaaaaaaaaaaaaagtgagatattttcaattcagaaaatatacatatttttgtttgtttgtttgtttgtttgtttctgagacgaagtttcgctcttgttgcccaggctggagtgcagtggcacagtcttggctcactgcaacctccgcctcccggcttcaagtgatcctcctgcctcagcctcccaagtagctgggattacaggtgcccaccgccatacctggctaattgtatttttagtagagatggggtcatttttgtatttttagtagagatggggtttcaccatgttggccaagctggtctcgaactcctgacctcaagtgatccaccccccctacccttgacctcctaaagtgctgggattacaggcgcgagccaccacacccggccagaaaataaatattcttaaagaatatttgtgtgtcaagaggccaccagaaaaaaacatagtaatagacatcttccattatttgaggttgtgtttcacaccaaaaacagagtatgctttaaacctctatgcttcatacctctatcccttagacataaaaaccaaactctttgccattcaaggccttcactcaacacgctgctcccttcagttttctctcctagtgatccactgtacaagtcttgcatttcatgatgatcagtcctcaaacatatttagtcccaactgggtatctttactcacagtacttcctctctaaattagtcatgacaaccccaatattacttatactaggaatgatgccctaaacatatttttatttgtacccagcagttttcatgtcaaccacagagcaacaggtgcctctcagaggctgtagggcaaagtctaagttagaaaaatattcagagaaaattatgtcaagaacaaatttcattttagtatccaaactctatgctgaaacaaaaaggcaatcaactaagagtcgaatctacttaaaatgaaaacacaccttttagttatggctaccccacaatgaaatcaggtggggcaaggaagatgggcctgccggtgctaggtgatgtaatgctcccaaaccgtgtttgtcaaatctttccaccaaagcatgtttagcaagagtggtcagagaacatggggtattgggggataatatttctttaaattcaaaattgtatctcaaaaattgtcataaattatacttcctaattcatagtacatacatatttggtgtgatataaaattatctttctaggtaaaattggcccctcaggaagacatttaatctggggcttttacgtatcctatagcgcatgctgtttgagcacaactcaaggagaccatggggtttcctcagagttaatataacatgttatttttaataatccctacaggaaatgttaacaaaaatatcaattaaacccccaggcaagatgtatgaagatccctagggacagcacagaaagttacagaatcacaagaacatgaagggagacctgagaattctcaacagtgcctcaaatgaggcataaattaagaccaacacatagttcaacaccctcagtgagaaacaagccactagactcttagggtacaagagaagtgaaataagccactggtgaagctctgacacaggacttccatattggagccagtgaaggagagaatccgtgtggcctccctgcaggctttctcagggatgacctaggaaagcttcctggtatgtaggagaggtattcttcgttgagcgttgctgctgttatacacgacagatggactactcacctatacatttcttcattcaacatgcttcagagattgagtatcaaagaatattggtctatctttcagytcaaaaaccaaaagaaaaaaaatccctcagagtgttgagatcaccatgcaattcacactttccaaaagaagtacactaatcatccacaggtcttctccttctcaggaagtgcctgaggcaccaggaatgctatgacgtttgtagagattttgagcttaacagtatggaactagctttatccactgggactaaaaccaaaagaaaattggaattttttttaatcttctctctgttttcctctctctgtccctttcattactcactttgcaccttcaggagaagtgacatttaaaaaaaaagaaaagataaaaataaaatcaatgtttttgtggactaagaactcacatagatttagtggtgaatatattaggaactgtttcttacaaatatgttggaaattatctgtgaaatttatttaccatgctttccctgtggctaattgtttttctgcaaggtttttgtttgtttgttgtttttaatgtcaatgaaagtagtctaagctcaaagaagcagctcggtcttgtgcattttgattttgggtcaaagtctgtgaatctgagttcaaaatcattgttgctccttctctgttccaagcataagtggctgctccctgcatcactgctttctcatcttgttgaggagagaggtttcttgctcggaaaggagaatgtatagaggacccatagtggggagccattcttttatgatatcttacaaaaatgaccatcgatgcaggtttagtttagttcttcataatcatcctagtttaaaaaattaaaaatcactgatccccatcttgcagtttctttctctttttggcttcttgtccaccaaaccacaaccttttgcaaaaccagctctatgaaaaggtctatgtttccttctagatgggtagattcatagttcaccttgtgcattactaactgcaacagctgcatgatcataaatatatttcttatttaatataacctcactgaataggagggttttttctatttgattatgttcagtgagtactgtaaatatatatgcatacagacaaacacactatgtatatatgtgtgtgtgtacatatatgtatataccaccttgatcaaatactatatatgtgctactttaattgaaaaaaatataaggcaaattatcctcttaacaatcaaaaaagttaaaggtatcttgttaaaatttttctgaagagtcccatatgttaaagctatcatttactcttttcttggagttgtatttgattcttgaaaatatatcttctttggtgatggtgttctaaaggaaacaaaccaactctcggaaaatgggtaaataattatgtttgaaataacacctttgattctcttgtatcttgtttttttgaatatttggaggctattattttacatggactaaagaaagatcttacaaacagtgaattttagagaaaattctggcaaaagtaataagaggagctttagaagaaaatatcccagtaactgtagttatcttcgctatcttatatgttatctttaatgaaatatttctttttaaaggtatatggagcatgataaattataatgtgaaattaatcaccaggaaatgaataattatgacattttattgctaaaagcaaatgattaaataccaaattgtaaataagctgtagtacaatataaatgtctctaaataggaaaaagcaaaatatataaagaattttattatctaaatatccttgttgactttctcctggtatcactaaaaaaattggaagaaaataaatactcttaacagaaatagctccggaaagaaagaatctgaaataatgtcaaaagtacaaactactcaaagctgtaaaaagtctcagacttgaatatattaaaaatgatggcatatgtcttcataatttgaagtgaacagcaataagtaattgctatatatgaacatctttcactgaaaaacaaattagatataaaacaaaccatttttgcctctatttcaagaatttctttatatcaaaagaagatgaaatgttgatttttgtccattgccacagaaaattcaaacaacctgaagtttacaagaatcagacccacaggactcatttgagaaagataaaccaggtgtgcttaagaattcttttagaatatccaatatattcacctgcaagagtcaaactccttatcccaaaaaaagcttcaagatgcttcatcagcaaagcaaattgtcattgaccatcggtgttctctccacagtctgggaagcatgaataactcacagatatctactgtgacgcagtttgtgktgttggggtttcctggtccctggaaaattcagatcatctttttctcaatgattttgttggtctacatcttcactctgactgggaatatggccatcatctgtgcagtgaggtgggaccatcgactccatacccctatgtacgtgctcctagccaacttctccttcctagagatctggtatgtgacctgcacagtccccaacatgctggtaaattttttctccaaaactaagaccatatcattctctggatgtttcactcagttccacttcttcttttccctgggcacaactgaatgcttcttcctctgtgtcatggcttatgatcggtacctggccatctgccacccactgcactatccctccattatgactggccagctctgtggcatcttggtgtctctttgttggctcattggtttccttggacattcaatttccattttcttcatttttcaactacctttctgtkgtcccaacatcattgatcattttctgtgtgatgtagacccactgatggcattgtcctctgcccctactcacatcatagggcatgtgttccattctgtgagctctcttttcatcaacctcaccatggtgtacatccttgggtcctataccttggtgctcagaactgtgcttyaggttccttcttcagctggatggcaaaaggccatctctacctgtgggtcacacttggtkgttgtgtctctgttctatggagccataatgctgatgtatgtgagtcccacacctggcaactcagttgctatgcataagctcatcacactgatatattctgtggtaacacctgtcttaaaccccctcatctacagcctacgcaacaaggacrtgaaatatgccctccatcatgtcttctgtggaatgagaattatccagagatcatraatagggttttttataacccaatgactcttaatgcgattggaagaataatcctcttcttttaacactaactgacttgattttattcatggtcatcgccatccttttgtacaagcaaaactcttcatgtatctgatcatattttgacgagcttctagtttcagaaatgtgctccatgggagcaggttggccccaatatatggtaaaaataacacataaaaatcttaatatcttcatccatgtccctacaaaggacatgaagccatcatttttatggctgcatagtattccatggtgtatatatgccacattttcttaatccagtctatcattgttggacatttgggttggttctaagtctttgctatcgtgaataatgccgcaataaacatacgtgtgcatgtctctttatagcagcatgatttataatcctttgggtatatacccagtaatggggtggctgggtcaaatggtaattccagttctagatccctgaggaatcgccacactgacttctacaatggttgaactagtttacagtcccaccaacagtgtaaaagtgttcctatttctccacatcctctccagcacctgttgtttcttgactttttaatgattgccattctaactggtgtgagatgggatctcattttggttttgatttgcatttctctgatggccagtgatgatgagcattttttcatgtgtcttttggctgcataaatgtcttcttttgagaagtgtctgttcatgtccttcacccactttttgatggggttgtttgtttttttcttgtaaatttgtttaagttcattgtagattctggatattagccctttgtcagatgagtaggttgcgaaaattttctcccattttgtaggttgcctgttcattctgagggtagtttcttctgctgtgcaggagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaatttatttttgtataagatgtaaggaagggatccagtttcagctttctccatatggctacccagttttcccagcaccatttattaaatagggaatcctttccccattgcttgtttttctcaggtttgtcaaagatcagatagttgtagatatgcggcgttatttctgagggctctgttctgttccattgatctatatccctgttttggtaccagtaccatgctgttttggttactgtaggcttgtagtatagtttgaggtcaggtagtgtgatgcctccagctttgttcttttagcttaggattgacttggcaatgtgggctcttttttggttccatgtgaactttaaagtagttttttccaattctgtgaagaaagtcattggtatcttgatggggatggcattgaatctgtaaattaccttgggcagtatggccattttcacgatattgattcttcctatccataagcatggaatgttcttccatttgtttctatcctcttttgtttcattgagcagtggtttcttgttctccttgaagaggtccttcacgtcccttgtaaggtggattcctaggtattttattctcttagcagcaattgtgaatgggagttcactcatgatttggctctctgtttgtctgttgttggtgtataagaatacttgtgatttttgtacattgattttgtatcctgagactttgctgaagttgcttatcagcttaaggagattttgggctgagacaatggggttttctagatatacagtcatgttgtctgcaaacagggacaatttgacttcctcttttcctaattgaataccctttatttccttctcctgtgtaattgccctggccagaactttcaacactatgttaaacaggagtggcgacagagggcatccctgtcttgtgccagttttcaaagggaatgcttccagtttttgtccattcagtatgatattggctgtggttttgtcatagatagctcttattattttgaaatacgtcccatcaatacctaatttattgagagtttttagcatgaagtgttgttgaattttgtcaaaggctttttctgcatctattgagataatcatgtggtttttgtctttggttctgtttatatgctggattacatttattgatttgcatatattgaaccagccttgcatcccagagatgaagcccacttgatcatggtggataagctttttgatgtgctgctggatttgttttgccagtattttattgaggatttttgcatcaatgttcatcaaggatattggtctaaaattctctttttttgttgtgtctctccctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattattgccacaatttcagctcctgttattggtctattcagagattcaacttcttcctggtttagtcttggaagagtgtatgtgtccaggaatttatccatttcttctagattttctagcttatttgcgtagaggtgtttgtagtattctctgatggtagtttgtacttctgtgggatcggcggtgatatcccctttatcattttttattgcgtctatttgattcttctctctttttttctttattagtcttgctagcggtctatcaattttgttgatcctttcaaaaaaccagctcctggattcattaattttttgaagagttttttgtgtctctatttccttcagttctgctctgattttagttatttcttgccttctgctagcttttgaatgtgtttgctcttgcttttctagttctttaattgtgatgttagggtgtcaattttggatctttcctcctttttcttgtgggcatttagtgctgtaaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccgtgtagttgagcagttttgagtgagattcttaatcctgagttctagtttgattgcactgtggtctgagagatagtttgttataatttctgttcttttacatttgctgaggagagctttatttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccattcttttattttgagcctatgtgtgactctgcacgtgagatgggtttcctgaatacagcacactgataggtcttgactctttatccaatttgccagtctgtgtcttttaattggagcatttagtccattgacatttaaagttaacattgttatgtgtgaatttgatcctgtcattatgatgttagctggttattttgctcgttagttgatgcagtttcttcctagtctcgatggtctttacattttggcatgattttgcagcggctggtaccagttgttcctttccatgtttagtgcttccttcaggagctgttgtaaggcaggcctggtggtgacaaaatctctcagcatttgcttgtctgtaaagtattttatttctccttcacttatgaagcttagtttggctggatatgaaattctgggttgaaaattattttctttaagaatgttgaatattggccccaactctcttctgcttgtagggtttctgccgagagatctgctgttagtctgatgggcttccctttgagggtaacccgacctttctctctggctgcccttaacattttttccttcatttcaactttggtgaatctgacaattatgtgtcttggggttgctcttctcgaggagtatctttgtggtgttctctgtatttcctgaatctgaacgttggcctgccttgctagattggggaagttctcctggataatatcctgcagagtgttttccaacttggttccattctccccatcactttcaggtacaccaatcagacatagatttggtcttttcacatagtcccatatttcttggaggctttgctcatttctttttattcttttttctctaaacttcccttctcgcttcatttcattcatttcatcttccatcactgataccctttcttccagttgatcacatcggctcctgaggcttctgcattcttcacgtagttctcgagccttggttttcagctccatcagctcctttaagcacttctctgtattggttattctagttatacattcttctaaatttttttcaaaggtttcaacttctttgcctttggtttgaatgtcctcccgtagctcagagtaatttgatcatctgaagccttcttctctcagctcgtcaaagtcattctccatccagctttgttccgttgctggtgaggaactgcattcctttggaggaggagaggcactctgctttttagagtttccagtttttccattctgttttttccccatctttgtggttttatctacttttggtctttgatgatggtgatgtacagatgggtttttggtgtggatgtcctttctgtttgttttccttctaacagagaggaacctcagctgcaggtctgttggaataccctgccgtgtgaggtgtcagtgtgcccctgctgggaggtgcctcccagttaggctgctcaggggtcaggggtcaggggtragggacccacttaaagaggcagtctgcccgttctcagatctccagctccgtgctgggagagccactgctctcttcaaagctgtcagacagggacatttaagtrtgccgaggttactgctgtctttttgtttgtctgtgccctgcccccagaggtggagcctacagaggcaggcaggcctccttgagctgtggtgggctccacccagttcgagcttcccggctgttttgtttagctaagcaagcctgggcaatggcgggcgcccctcccccagcctcgctgccgccttgcagtttgatcacagactgctgtgctagcaatcagcgagacaccgtgggcgtaggaccctccgagccaggtgcgggatataatctcgtggtgtgccattttttaagcctgtcggaaaaacgcagtattcgggtgggagtgacccaattttccaggtgccgtccgtcacccctttctttgacttagggaactccctgaccccttgcgctttccaagtgaggcaatgcctctccctgcttcggctcacgcacggtgcgcgcacccactgacctgcacccactgtctggcactccctagtgagatgaacccggtacctcagatgaaaatgcagaaatggcccgtcttccgcgtcgctcacgctgggagctctagaccggagctgttcctattcggccatcttggctcctcaagctatatatttatatattatatataaatatatag

SEQ ID NO: 10574 - DNA, 18802 bp, Homo sapiens
  misc_feature (1)...(18802): n = A,T,C or G, or insertion/deletion polymorphism (see Tables 1-2)
tcacgcctgtaatcccagcactttgggaggccgaggcaggcagatcacgaggtcaggagatcgagaccatcctggctaacacagtgaaaccccacctctactaaaaatacaaaaattaactgggcatggtggtatgagccttgtagtcccagctactcaggagtctgaggcaggagaatcgcttgaacccaggaggcagaggttgcagtgagccaagatcgcgccactgcactccagcctaggcgacagagcaagactccgtctcaaaaaaaaaaaaaaaaaaaaagatctcaaatctgcaacctaactttacatcatacgaaactagaaagagaagaacaaatacacccaaagctagcagaaggaaggaaataataaacatgtgagcacagaaaaatggaataggaaatagaaaaccaataaaaagaatcaacaagaccaaagcttggtttttttaaaagatcaataaaattgaaaatctttagctagattgactaagaagaaaagagaaaagacacaaataactaatatcagaaattagagtgggacatcaccaccaaccttacagaactaaaaaaattataagagaatactatgaacaattttacaccaacaaattagataaccttggatgaaatggacaaattcctagaaactcacaaatcaccaaaactgacttgagaaggaatagaaaatattaacagacctataacaaataaagagatagaatcagtaatttttgaaaaatacacatgactctcttcaacaaaaagaatgcctagggctagatgacttcactgataaaatctataccaaacatttttttattaacaccaatccttctcaaagttttccaatcttaactgatacagaaaaagcatttcacaaaattcaccacccttctataattaaaaaaaattcagaaaactaggaaataaaggacttccttaacatgattaaaggtacctataaaaaactatatacaatgatcattatactcaattgcaaaagatcaaaatctttctcccaagatcagaaataagacaaggatgcatctttcaccactgctagtcaacattgtaatggagttctaaccaaagcaatcaagtaataaaaagaaataaaagtcatccaaattgggaagaaagtaaaactatctcagctgtttttgtaaacaccagcaatgagcaatccaaaaaggaaattaaggaaacaatttgatttacaacaggctatgaaaggataaaatacctagaaataaatttaaccatggaggtaaaagacttgtataccacaaaatacagaacattgctgaaagaaattatagaagacctcaagaaatagaaagacatcccatcatttttttttttttttttttttttgagacagcgtctggctctgtcacccaggctggagtgcagtggcatgatcttggctcactgtaacctccatctcccaggtgctgggactataggcgcatgccactacgcccagctaatttttgtattttctgtagagacagggttttgccatgttgcccaggctgatctcgaactcctgagctcaagcaaaccacctgccttggcctctcaaagtgctgagattataggcgtgagccaccacacctagctgacatcctatattctatattggaagacttaaaattattaagacggcattacaatgcaattccaatcaagttccaacaggtatttctttttctttttttttttttttttttgagatggagtctcgttccgtcacccaggctggagtgcagtggcgcgagctcagctcactgcaacctccgcctcccaggttcaagcaattctcctgcttcagcctcccgagtagctgggactaccagagtgtgccaccactcctggctaatttttatatttttagtagagatggggtttcactatgttggccaggctggtctcgaactcctggcctcaggtgatccacccgcctcggcctcccaaagtgctgggattataggtgtgagccaccacacctggccggatttttctttatttgagaaacagaaaacttgatcctcgagttcatacaaaactgccttttcattgttgtactttgtagggtctcccatttcccccattttgtgcgttctgagtgaaaaacagagagtgccttgttggctgtgtgacccagccagttgcatgttttccccagcaaggctgaaccgaagccaaggctttggatagccaaagcagtcttcaaaaagtagaattcatacttcctgattcaaaaataagccaatgatttaaatataaaagctacagaattcttagaagaaatgtagaagtaaatcttcatgactatggattgggcaatggattcttagaaaagacaccaaaagcacagtaacaaaagaaaaaaaaatcggacttcatcaaagttaaaaatttttgtgcctcaaatgactatcaaaaaagtgaaaagacagcctatggaatgggagaaaatatttgaaaaaatcatctatctggtgagtatccagaatatattaaagaactcttatgactcaagaagaaaaaaaaaaaaaaccccaattacaaaatgggcaaaggacttgaatatacatttcttcaaagaaaatataaaaatgaccaacaagcacatgaaaatatgctcaatatcggctgggcacggtggctcatgcctgtaatcccagcacttcgggaggccaaagcaggtggatcacctgaggtcaggagtccaagaccagcctcgccaacatggtgaaaccctgtctctactaaaaatacaaaaatttgtcaggtgtgggtggcaggcgcctgtaatcccagctactcaggaggctgaggcaggagaatcgcttgaacccgggaggtggaggttgcagtgagctgagatcacaccactgcactccagcctgggcgacagagtgagaatccatctaaaaaaaaaaaaaaggagaaggaggagaaggagggggagggggagggggaagaagaagaagaaagaaatgctcaacatcattagttattagggaaatacaaataaaaaccatgagataccacttcacattttttgactggctataatttctaaaaaggaaaataataagtgctgacaagcatgtggagaaattggaaccctcgtgcatagctgatagaagtattaaattgttcagccgctgtgggaagagtttggagtttcctcaaaaaagtaaacatacaaagttaaacatatgacccagcagttctactcccaaatatttacccaaatgagttaaaaatatatactcaaaaaaatattcatctacaaatgttcatagctgcattatttgcaattgccaaagcaaggaaacagctgaaatgtccatcaacagatgaatggataaacaattgtgatatatatatatacaatggagtattattcacccataaaatggaatgaagtactggtgcatgctacatagtaaatgaacctcaaaaactacagaaataacatttcctacccaattgttttggaaaaaattcaaaagcatgacaacacgttctgttagtgagactgtaggaaacgtgcacagtcacattgttggtggcattacaaaaaggtataatctttatgaagtagaaatcggcaatatctagccaaactatatgtgcatttatcctcttttttctcttttgagacaaagtctagctctgtcacccaggctggagtgcagtggcttgatcttggctcactgcaacctctgcctcccgggttcaagcgattcttctgcctcagcctcctgagtagctgggactacaggcatgtgccaccacgcccatctaatttttgtatttttagtagagatggggtttcaccatgttgaccaggctggtctcgaactcctgacatcatgatctgccctcctcagcctcccaaagtgctgggattacaggcgtgagccaccgcacccagccgtgcatttatccttttaaccaatgatcacacttttagaaatttactgatattatacctccaacaatacagaaaattatgcataattgttcattgcagcattatttataatagcaaaatcttggaaactacctaaatgcccaaatataggagactggctatatgactaaggtgtatgtcaaatgcagctgtaatagaggaaaaattgttatgaactactggagagcagttttcaggatatattgttaaatgaaaacaacaaggtgcaaatgggtatattcgtgcaagaaaaacagagttgagagttcaagtaactaattatcttaaatcaagaatttatagagaattgataaagaagggctgctactcagcacatcctatgaagtcagcataaacttgctatgaaaccaagcaaggacaatatgagaaagacaagttacaggcccagttcattatgaacatagatgtaaaataccttaaaaatagcaaactaaaccaaacaatataaaaatgataatattcaatgatcaccttatattaccatagaaatggcttaatgtttgaaaatctgaatgttcactgcattaacagattaaaggatataaaaatgttatcatctcaatatacatagaaaaaagcaatacatataatctgacataaactaatttaaaatttcttgttaggaatgaaagaaaaatttctaaacctgatagagggtacttatgagaaacctaaagtggagacaattctaaaaggggaaacaagaagttttcattttaaatcaggtatcagacaaaaatacacactatcaccacttacatatgatgtactcaagggcctagcgagcacagtgaggcattaaaaatggcataaagtttgaagaagaaaactataactgcttatttgcctatgataaacactgaagagaacacacaaagaaaccataataaacaatgggagaatttagcaagctaactagttacaaatttgtggaaagaagaaaagatccaagctttaaagagaggaaagcaagtttgaaatagtatttgtagaaagtgggaacactggcttactgaagaaacttagtaagattgccagaccctttttggtttggtgatggtgcatctattgtgctgtttagtagcccagttgagttattttcccccagcaacaattatctgcctaggttcaagcttcaatgaaattgatggttggattcattcagggttgcagtttttgtaggtagattcaagcaaggagatttaaatgacaggttctgagtcctacattgatagaaagaaaagtaaacgcctataggggaggactacgaaatagggaagtgaagagtcaatgtttattggtttcagtgaggtcaaataattgtcatggtggagatttttgagcaaactggaaagttaacttctctacattagcagtaaacaaaaggaattagttgaaaagttatgataacatttacaatttccttttaaaaacttcaagcctcagaccaggcgcggtggctcacacctgtaatcctagcactttgagaggctgaggagggcagatcacctgaggtcaggagttcaagactagcctggataacacagtgaaaccccatctctactaaaaatacaaaaattagctggacatggtggtacacgcctgtaatcccagcaactcaggagtctgagacacaagaattgcttgaacctgggaggaagaggctgcagtgagcagagatcgcaccactgcactccagcctgggtgacagagccagactccatcatctcaaaaaaaaaaaaaaaaaattcaatcctctgtgaataaatataacatgtacaatttccacaggggaaaattataaaaaaatgttaagggacatgaataagatctagatacagatgaaagagatagcaaggtcaagattaggggaataaaggaggatatgaaaacactacgtgaccctggagtgggtgtgattgggaggtgcttggattcctgccctgccggttttgattggagtacacggtgaaaggctagtcacactgggcctccactttgccctctttccttctcttctcctcacagcagtgcctggtcaaacccagcaacccttggccagaacttactcacccatcccactgacaccatgaagcctgtgctgcctctccagttcctggtggtgttctgcctagcactgcagctggtgcctgggagtcccaagcagcgtgttctgagtaggtgctggatctgggcccaaggagggaagtaacatgtgtggataggagaggatctgagggctgacagtctgtcacacctcttggaaaaataccgtgtcatgttcaagggcccaagctttattgttggcaagatctaggtttgaatccctgctctgttgctgagtgaccttgggcatagtatctgggccttaggtttttatccttataatgaatacaggaggagaacagataatgcatgcagacatagctcactcttactaaaccatggtaaatgctcagtaatattaaatgctgtaaatgtgatcagcctcatcatccagcttagtcttgctgcccgtggctccttcatggatgcttggactcacttttcaagcaataaaacagagagacaacgaagttggtagaactcaagctagaatctacataaccttggccttggaggatgttttgggaaggagggaaaggaagtcttgccttttattccacattttcaaactccagaggtactgtacaattaccggtaattagcatcaatgggacagtgtagagtccatctcagcagccaccactgcccagctcaactcaaaagagctctggctctagtaatgttgaccttaaccaataccaagtgggaaaagaactgttattcatcatacatccactcttctatggggaaaacatcttcagaatactggcggctcagaagagggataagtgtggtagctcatgtgtctggggaggctaggtcctgcttaagaagtttcagaaaaggcatgcaggtttgtaggactaagagggactaagcaagctacaagaaaataggagtgcccagggtagagttaattggagaancagaatttgaggaaaggcacaaagaggctttctaaaagactggtaaatgctgtgagtgaagttgggaccagatacccagaagaggggtcaagacttgaaaagggtgacctctctgagatctctggatcatggtgtctatctctaaactgctctgttgagccccaagctcttcaaagtgtggattagttccaatttcttgcagtgccccagtgagctatagaatagctgagaggccaggggtgagtactagttattggtctctgttaaattgtcaacagcttgaacctcagcttcttttaccccaattctggtgccatttgctactacagttatagtcatgacctctttcttcattcattcctttcaaatcatcataatatcctatagatttccttctaattgcaaatatttgcagaggaatagacccacaattcctctatttgcaatagaatgccccacttttgacttttgcccccaaagaaagggagaatcacaaggtacaaaaattaggacctggaagggcttggggaaagggattaatggggcccatctttagagtccaggaatagaaaggagattgtgggttgtggacntagggaagactctcccagggcaggtaggtcttagctttgaactgaaatacttgggggtaggggaggaaataggaagtcaacataatgatgcttattcttctctaacagtagaaagtggggcatcctggtgctctggcctcctgatcgagagacaccaaggaagaaaaaagctgaatctttgaacgccattctgaaatccccacccttcttaccatgaaagaagtcactcccagaacttacttgtgaattgggtcccagctctctgatccagtaccttcagtttaatgcatggtcttcatcctttaccaaaacttacctttcactcattcttcctgtacacaaataayccatgttaggttaaccccagggtaaactatgttgttaatgagaagctctacaacttgctcaagaccacacaatgaatcagtgcagaacgaacatacaaacctctttcttgttcaccacatacaccattgatacccttgatatggacacaaccatagtcaatgggggcttggcatctgaactacaaggatggtgaatgaccaatgggtgcagggttctaccaaactctgttcttgatcaaaaaatatccatgccctgcttccctgctcagaactcagaggaaggcagcagctgaggacaaaacctgatgccaccaccctggaaccatgcaaggcagatgagggtggcaggtttcctggcagttccctgggctttctgagttctgaacattactccagcctgttggtgrggcccttctcttacttgttctgtgttccagagtatatcttggaacctccaccctgcatatcagcacctgaaaactgtactcacctgtgtacaatgcaggaagattgcgagaaaggatttcagtgctgttcctccttctgtgggatagtctgttcatcagaaacatttcaaaagcgcaacasgtaagagatatctcatatccaggtctgatcctakagctgctggtgggagcccagcagaagagtcccttaccagcaactgtgctggatctctccttttttttttttttccttggtggccatgttgccaacatgccccttctcttgaccaaggataatttccataaaagtcctgattagaaaagccctcctcccctcccaatcaccacatcccatcaccatatccgtgaatttctgactctgcctctctgaacacacccacaaatgcctttatccacagaccttcccccgacccagaatccacccttatcccagggacactgtacctgcaggtgtaaccaaaatcccaaagcaaaatttgtcctacacttttgcttgccctcctttcacaagacaccatcctttggccaccagtgttcttgggctctggagatccagcccaaaggaagttttgattaattgtccagacattaacactagccgcaagcctgctaaatggagtgtgctcccagggcagagaaaggacatagggtgctgatgagacatatggtttctaatcccatcttgcaactatgtctttctatgaccttgagtaagacaattccctcttttttactttctttttctcatgagtaaaataagtactcttgttttttcctgctttgcaaggcccatatgaaatttcaaaagactcacagtggaagactcaaccaatgagccctttgagggaagcctggcagtcttgttccctgctgtattccctaccatgagcagaatacccagcatgagataatgtgcagagtgattaagcatgggctcaaagccaaacacctgggctcaaatcctggcttcttagctaagtgaccttaagtgatcttagacaagctaattaacctctctctgggcatcaacttcctcatccttaagactggaacaataatagtgaggttaaaatagacaatccatgtaagctttaaaacattacttgccaacataattgctgtgaattttggggattaggcaaccacttctctttgaagagactagcccttgcaattaaattccacatctttcaatgctctacattggaatgcagaagcataaatataactctttggtgtcattgagttttttgaggttctgccttccctatggcaagagaantgagcttcatggtctaatattaatggtggaagtaattgaaagaaaaatatatatctctaaaagtaaaacttcactagttaatatttgaaaatatttttcttctacagaatcaaacacaagggctcagaagtcatcatgcctgccaactgaggcatatttcctagatcattttgtaagtacagggatttggtctsgccttcctcatgtgagattcccagggatgctcactttcttcctgtagcctcaccaggggcactacattcccacaagctcagaatggcctctcattacctgattgcctcctcctccatcattcccctccaagggctatctttgcactccctgggggaggcacggtgcagtccagcatgaattctgcaacacagagcaatgtaaggaaccaagtcatggcccagggggaacccagggcactcagatctgaggctttgtcaaggaacaagctcttctagcctccgggttgacagcaccctgggcagggactcaagctgagcccttcacgctctgagactttggtctgctcactgtacctctctgagacagtcacctccctcatgtgaaatatgaagaaaacatccatgccttggggtattgggaggacaacacaaggccatgtagatggaagaacttggtctctgcaaaggtagaaactgccagcaactcacttacaaggtcactcattcaggttccagttttttctctgaaaaaagagggagtgggccgggtatggtgactcacacctgtaaccccagcactttcggaggccaaggtggacggatcacgaggtcaggagttcaagaccagcctgaccaacagagtgaaaccctgtctctactaaaaatacaaaaattagttgggtgtgatggtgcacacctggaatcccagctactcaggaggctgaagcaggagaattgcttgaacccaggaggcagaggttgcagtgagccaagagtgcaccattgcactccagcctgggcgacagagtgagactccgtctcaaaaaaaaaaaaagagggagtkggaatcatctttattattttactgatgcttcaagaatggtgaacaaaatggagtcctgtggaattccaccaccaaaaaaatgatagtattcataagttggtggatttcgtttcagagtatttgaaagaaaaagttagaagtttagggtcttctaatgggccttctgatgtctccagatgttccaaattagaatggtggtctttcagcttagtccttttattaaccctgtacaaaggagcgtgataaatagtagmaggtggaggccagtggagcagtttagacgcatgagcacttgcccaggctccggtgagcccaccatgctgcggatgagctcccactcatgcttcaaggtttctattaaattaaacactccatagaaacttcaccagttcactccagacagaattagtccctctctttgtcttttgtagtgtcctatctttggcctaccataacctagtgacccctgatccagggcaggaaatactgttcagaaaaatctatagactcttttactaccagaaactgaccatatgtggttcnagttgacctgagtgaggcaggtctcttacatacaggttggctatcactgttttaataatctgagtttgatctatccaatactgtaggcacyggtcacgagaggctatttaaatgttaattcatatgaattacaataaaataaaatattcaatcagttccttagccttattttccatttcaagtgtttaataaccacatgtggttagtagctaccatattacacattataaatacagaacacagaaagttctaatggaaagcattgctttaagctacataaagctgatgtctaaaaaatgatggctaattaaaggtgatcatgacagaggacaccctctatgacagcctcatgttagactccaggaaaagtttttgggggctatttctttaaggagttcctaagcatagcctgacaacagacagttcaatgacagtaattctctagagacccaacatgatgtccaaggatgtttaaagaatcaagaagaataaatggactaattatctttccttccccacaggcctctacgatgttttttcttggtccacctttaggaaggtattgagaagcaagaaactggaggcccaatatctaacctgcaaatcgtttttgagtttggcaataaaggctaatctaccataaaactcttgaagcttaagctttaggtcaacacttgcaagagccccttccaaagctcagcacagtttcctcctgggatgaggagaggaatcagaaaccccactttggcatagagacaagcagcactgttccagtccagggatgctgtgtgtgccctggtggtggtcttaaggacctaccacatcaacatctggacaaccctcactgattacctgcccttggttgcactcatcaggctaantgatcccatatttaacctcaaggagaaatatcaaccagacactgcatggcaacctccttggggccagccttcaaggcttcatggccatatcatgaacccaggacaggcacagtgggggtggtgaggacctgatagagttggatcagtgactaagaggctgcaataaggtgccatgaaatcaaaatcaaagggctagaactctccaaggtcttgcccccggcatgtagcaccacctgagccagaaactgcagaggacatgacagtgtggcattactgataagttatggaaatggaaataatctttcctaaactaccaataataactttaaatttttgatcaaccatgctagagcaaagattgaattatccttctgttctctctacagaaatgatataaaaactatagtcataagaagagacaatcaaaaataatcagccataaaatattaaaaaggtattataaaggtatttaaaataataataataaagtgttattttcctgggattcatgatatttgatatattcgtaagcttttgttaagtttgtaatttgttgcaatttctttttcatttcaaataaatattcacttacgtgtctaattttgtattagtagttctgcattatttttctaaaacaaggtatccataattatacaagcatcaagctccacaaagcctgggcctttctctgcttgcctccattccttccaactctgtaccagtgagccttgtgttcctcattaggaaaacagcataagcaattgttcttcattttcacaagactgtacaaaaagattaaacaatataatatgcataaaaatatgttgtacgcactgtgacagaaatatgaatggttatgattattgttaacattttgaggacttactgcaaagggtgagatataaggaatggcattaaggaagaagaaaaatggattttcaccccttcatcagtgaatataatctatacaccatgacttctcacttaaccatagttgtgctactatggcacatcatctaaattcttcaaaacttgaatttttcatgcttaaaatagagataacaccacttaccttacgtaatttgtgatactaagttcttgattgtagtctggtggttgggaggcttaattaaataaccagtaactcagcagtatcaacttgctttgaagggaacatggctggactggaaagtacctgacacacaaccacacaggacaggctgaccctccaggatgaaatcttgaagggatgtttcagccaatcatgagtttatttagtttattaagaacaagtgacaggcatggggaatcttggaaaagatgctctaatagataggtccaactcttccccaggggagtgaataaagatgaaaagctaagagacaagaatttggccacaatgaagccagaataaaactgttcaaaaaataacaatgcttatggatatcttgcaaattcttgctgggagttctcttctcagtccatcccagcagagatggtgaaagatcagtagttcagtaggggctataccaagtcaataaggatacttgggagacacaatgaaaaaagagtcactttttcttgctgtcacctgggaagaagataaatatgaagactatggccctttggagagcactcttgtactctgtcactgcctcctataagtgcttagtcaacaatccaacataattttaggtttgctgggaaaggtgggtttggctgtgttaggaatggaatttacaattttgaaggtgaaatcttgtttgttcatgggttctgcttcccagccttgcagccaagactcgtatacaacttttgaggacaaaactttaattcatttctatatacccaacattgagaatagttactgaaatatagcaggagctcaataagtaagtaccttttaatgagatgagaaaggataaaatgctaaaatattgaggcaggggaattgcttgaatccagggggtggatgttgcagtgagccgagatcatgctacttcactccagcctggatgaaagagtaaaactttgtctccaaaagaaaaaaaaagaaagaaagaaagaaaaagcacttgagaaaaattcaacatttttttcataataaaagctctcaacgaattaggtatacaagccacgtatctctatataacaaaggccatgtataacaagcccatagctaacatcatactcaatgatgaaaagctgaaagctttgcctctaagatcaggaataagacaaggatgcctactctcaccgcttctattcaacaaaatacttgaaatcctatccagaaagattaggcaagaagaacaaataaaaggcatccaataggaaattttccaataggaaaattgtctctgtttacagatagcatcttatgtatacaaaactctaaagacttgataacaaaaataactgttagaattaataaattcaataaaagtgcaggataaaatcatcaatatacaaaaattagttgaatttctctacactaactacaaactatccataaaagaaatcaagaaaaataatcccatttacaatagcatcaaaaagaataaaataggagtaaatataaccaaagaggtgaaggatctgtacactaaaaactatagaatattgataaaagaaagtatagatgacacacaaaaaatgaaaagatatcccatgttcatgagttggagaaattaatattgttaaaatgttcataatgcttaaattactccacagattcaatgcaatctctaacaaaattccaaagatattttcacagaaatagaaaaaacaatcctaaaattcatgtgagccacaaaagacactgaatagctaaagaaattctgagcaaaaaggacaaagctggaagcatcacacgtcatgattttaaactatattgcaaactacagtaatccaaacagtatggtactagcataaaaacagacacatatggcaacgaaacagaatagagagcccagaattaaacccttgcacgtacagtcaactaacttccaacaaaggcaccaagaatatacaatggggaaaggataatctcttcattaaatgatgttaggaaaacttacaccatacacaaaaatcaattcaaaatggactaaagacttaaacataagacctgaaactgtaaaactcttagaagaaaacatarggacaaagttcmattggtctggacaatgatttttttttatttgaaaccaaaagcacaagaaacaaaaacacaaataagggagaccacattttctgcacagcaaaggaaacaatcaacaaaatgaaaatgcaacctatggaatggagaaaatctttgtaaaaaatacatttgataacagttaatatgcaaaatatataaagaactcctacaactcaataacaaaaaataaaaaataaaaaaatagtaaaagtccccaaacagacattttttcaaagacatacaaatggccaacaagtctatgaaaagatgttcaacatcattaatcattatgaaaatgcaaatcaaaaccacatgagctatgacatcacacctgccaggtgcctattatcaaaacaaaagataagtgttggcaaggatatggagaaaaggaaacccttgcacaccattagtgggaattcaaaatggtgcagccactatgcaaaacagagtgaatgttccttttaaaattaaaaattgaactaccatgtgatccactaatcccacttttgaatatttattcaaaattactgaaatcaggatctcaaagagatattaacacttagcacctctatgttcattgcagcactagtcacaacagccaagatgtgaaaacaatcttatgtacgttgacagatgaagacatttttttgaaatgtagtatatgcatacaatggaatactattcagccttttaaaaaaaggaaattctgcaatatgtcacaacatagatgaaccttgaggacattatgccaagtgaaaaaagccagtcacaggaagataaatacttcacgactccacttatatgaagtatctaaaatagtcaaatttatagaatcaatagtggaacagtggttgccagggcctgggtggaggtgaaatggataattagtaattaacaggcataaagtttcagtcaagcaaaagaaataagctctagggatctagtatacaacactgtacctatagtcaacaaaaacgtatcatacacttaaaaatatgttaaaacagtagacttcatgttaagtgcttttaccacaataaaataaaatttgaaaaaagaaagaataggggctgggcacagtggctcatgcctgtaatcccagcactttgggaggccaaggcaggcagatcatgaggtcaggagtttgagaccagcctggccaacatggtgaaaccccatctctactaaaaatacaaaaattagccagacgtagtggtgcacgcctgtaatcccagctactcaggaggccgagatgggagaattgcttgaacccagtgggcagaggttgcagtcagccaagatcacgccactgcactccagcctggatgacagagtgagactccatttcaaaaaaagaagaagaagaaggaataggaagtcattaaacaagtttactaagtagaaacaatctcctaaaacagaaaacaccaagtccacatgattttcagaaaagttcaatcaaatcttcaaggaataaaccatttcaatcttatatgaaatcatccagagactagaaatgactattcctgaattcagtctttgaggccatatagtcttagtgctcaaaccaaataaggagagcatgagaaatgaaaactactggccaatctaactcacaaacgtagatagaaaaatcttatacagcatattagcaaactaaattcagtagtgtataaaaagattatttagcataagcaactttatcccagaaatgcaagagtaaaaatgagaaaaacctacaaatacaattcaccgtataacaatttaaaagccatgtgattatcccaacagatgcaaaaaatagttttataaaattcaaattttgacagattacatttttaacacactgggaatataagggaatatccttaacaagataaagtgtaggtattttttttaaataaaacctacagtatacatcattcttaaaggtgaaactattagaagcagtcccttaaaatctgcaaaaaaaagacagggatgaccactacactgcttctattccacaatgtactaaagattctagccagagtgatgttaaaaaatagaaatttaaagcattcataattggaatagaaggcacaaaaccatcattagtcacagatgataactgcctatttttgtagaaggcaaagagaaccacatacaaattatttagaaataacaacagaatataggaaggtgactggatataagattaatatataaaatgaattacatttttgtacaccagaaaaacatagaaagaaatataatgtttaaagataccatttaagatggccaattacaggcagctgcggtcacagcactgctgaggaaggagagcagcaaagtgaattcaccaccttcaactgaaatatccaggttctcacattgggactgactaagcaatcagctcaacccatggagagcgaagaaaagcagggtggggtgagggcccacctggagcaacatggagccgaaggaacccccatccccaaacaagggaggcagtgagtgattgtgcgaccctgcctgggaaaccacacttctcgcacagatctttgcaacctgcagatgacgagatcccctcatgagcctacatgagcagcgccttggattcaatgcacagagctgtgtggagtctcagcagagcagcaatccagcacacacagagacccaggagttttacatactctggcctcgggatccccaacaagggggcagatccatctgtatattcccctaggaaggtggctgaatccagggagccaagcagcatcattctgcaggccccacttccacagcacctcacaagttgggacctgctggcttggagttccagccacagtggcagtaggcggagtctgcctgagactgggggagtttccaggacctggggggaggggtggctgccatttctgcagtttggtcaactagtatttcagcttgccagctctggacagtccaggcagtctggactagtccccttctatgcagcacacctgctttgccagatcgtgacagactgcttctttaagcaggatcctgatccattcctcctcactgggtggggcctccctgctgggagccctcagtcaccccagccaggcttatatggacagaattccgatctctccctgggatggagctcctatggggagaggtggccaccatctctgcagttgagttgactcagctgttccagcctgccagctctggagagtctaggtggtccagacaaggaagggtccccaccaacacagcacacctgctctaccaaaaagcagccagactgattctgtaagcaggtccctgatcccattcctcctgactgggtgagacctcccaacaggggtctccagacacctcctacaggagcattcaggccagcaacaggtcagtaccccctgggatg

SEQ ID NO: 10575 - DNA, 25346 bp, Homo sapiens
  misc_feature (1)...(25346): n = A,T,C or G, or insertion/deletion polymorphism (see Tables 1-2)
atgcacgtcttcaggctcaggcccttccgattggctgctgggacacaacgtggcctgtcattggctacggcaccggcgcagggccttcggagaggaagtgtggaagtcccgcgcctctaaagcccgcctttcgtgacaaataaaggtcgtagccgcagagtcaacgggcggagctaaagtggtcgtgattcatgctgtcgcgggaaccccgaaggtggggccccacgtaacaagaagatgacccgaagttgctccgcagtgggctgcagcacccgtgacaccgtgctcagccgggagcgcggcctctccttccaccagtgcgtatgggagcagcctcgaagccttcgaactccctgcggggcccggcgggccgtggcgtggcgtggggcggggccgggccgcactgtgggtcgcgccgcgtgtgtgacgcgacgtgacgtgcgcagcgtcggggcgtgggagcggaattggggcactgtgagaattgagattctctctcttcccgcccagtgtttacctctgaatagccggttctcgcaccgcctaccgctttaaggagagttacgcgaaaggagtcctccattaattggatggtcttattatttgaagtgaggaggccgaaagggaaggcagtttaggacaacggttgaagtgtgtgtgtggcgtcttcctgagcacgagtacagatcagttttctcctgtactgcctgacattgcaagttcttaagtgctgttagccgagctgtgcaaggccggtccgattctggctggatttgatcatggcagggaagtttcatttggctcgacagtggggaagaatttcagatcagtcttatctgaactcatatccatggttcagactggtataggtcattcagtattcagggtacactagcaagtagaaaagtgggtaaaatagatcctcacagacaaaaggagcagatttatggaaagatcaaaaagaactttatggttggaaagggggggtaggaagagggtagttaggaatggcatgggaaaatgtaaaggatagaaagtgcaaatatagaggagtggaaaagtacctgagaaaccattttaaaaatgtaaatgccaggttaaggagtttcgagtatgtatggtaggctatgtataaaattcattgatttttttttttttttgttttctattttttaaatagggctgattcctccacctaaattgttagcagtgtgaaccaactcattgtgtatgtgagaccataattgatttgggatttttcttgtgatagaggtagttttaaactagggagacatgaattccaattttaattgagtatttactgatgtctgtacttggctctgggtcttggtttcttcttctgtaagaggaataaaaacctgccttgtagaattttgtaaaactaaaacgtaagactttatagcatatgtaacgcacaaggtaaatgctttaaaaatggtattattaccaaattaattttttccagaactcaaaactagttatgctagttagattacaatatttcccaacattttccttcttttttttttttttttttttttggagacggggtctcactttgtcgcccaggctggagagcagtggcactatcacagctcagcgcagcctctatctcccaggctcaagtgatcctcccacctcagcctcatgagactacaggcacagaccaccatcccggcttttttttttttttggtagagatgaggtctcagtgtgttgcccaggttggtctccaacttcttggctgggattacaggcatgagccaccctgcccagccccagcctttttcatagcattttacgcataggaaataattgttcaatactttggggcaaacctacagcactgtttggggctgccttcaagtaactactcaggtgtcccagcccaccccatggactaagaatatcaacagctgtactcactaggcatacctgttgggaagctttgcatcagaggaccacgctagtaatagaagttgttggaccagccaacttttgagggttccttgcacgtttagagactatacccaatctgtggaaaagctcccttgcaaaatatgttccatgagttagaaaagaactcagtgaaaaaagatagatttgccccaactttattggaaaaagaattccctgttcatttgcccttgatcaagtatcatcatcttcttagaacaataaaattataatcccagaaatggaattagttgttcttaggaaagatcgaactttggatagtactttacagtttacaaagtgattttgaatacatttgtagcctcatacactcttactacagccctgtgaggaagttctaagattgagagatgtgtctaataccatatagctggtagaaagtcactgaagcttaaatacaggttttccaattcagagttctttctcgaggtgatttagagagcatatcagaattatgttttaccatgctgctatatttttgtagcatttagctgagaaataaaatttataccaatctcagttctagtaactatgtgttttaaagtctaaattaaaatacacaaaaagcatagttacctataagtctgtctctaagataacgtcaaagaagaaggggcagaaagagtagttttgtgctttttattgtgttaatttcacaagtttctttttcttttcttttttgagatgaaatcttgctgtcgcccaggctggagtgcagtggcactatcttggctcactgcaactttgcctcccaggttcaagcgattctcctgcctcagcctccctagtagctgggattacaggtgggagccaccaggcccggctaatttttgtatttttattagagacagggtttcaccatgttgtccaggctggtcttgaactcctgacctcaagtgatccgcccgcctcggcctcccaaagtgttgggattacaggcgtgagccaccacgcctggccgacaagtttctaaacataatttggcttggattgaaaaataaataaatgcaaggtaatttttataatcaaggctaggaaaaagtagtgcctttaaacatgaaaaaacaatatagtaaatatacttgtcttgttttctactgctgcataacaagttacctcaaaattcagtataaacatttttatctcacacatttctgagggtcaggaattcaggagtgtagctcgatgttacagtatctcataagattgcactcatctgaaggctgaagtcacctgctttcaaaaagactaactcaacatggcctttgactggaggcctcagttcctcaccaactagttttctccacaggactgctttataacataccagataccttaccacagagcaaaccattctctacagagagcaaggaggaaagcttgttcctttatgacgtagtctgtggtcacttactgtcacatgttctttttccattccttagcaaatcactaactctagcccatactcactcaaggggaggggaattaggctcccccttttttttttttttttttgttacggagtttcactcttgttgcccaggctggagtgtaatggtgcgatctcggctcactgcagcctccacctccggattcaagagattctcctgcctcagcctccccagtagctgggattacaggcacccgccaccacgcccggctaattttttatatgtttagtagagacggggtttcaccatgttgtccaggctggtcttgaactcctgactgctgatcctcccgcctcagcctcccaaagtgctgggattacaggcatgagccactgcacccagccaggcttcacttcttaaaaggaagagtaccaaatagtttaaaatcactacaggaaaggaaaagatgcatatattctttaaccatttaaatttgagcaaattctattaagtgtaggaagtgaagacaaaatatagtaggatttttaatatgggaattgcccctctatgattgacaaagaaaaatcagatattgaacctttggattaaaaaaaatcaaagaactttgaaaaatgaactaagtaaattaaacttttaattcacttggctttatgtttctataaagcagtaaaataatagatgggtttatatagtaaatactactgtaatagtactataatgttttcatgttaatggaactttaatgtgattgtcatagatttccaactgataccatacagcgctcaaaatggatcagggctgttaatcgtgtggaccccagaagcaaaaagatttggattccaggaccaggtgctatactgtgttccaaacattttcaagaaagtgactttgagtcatatggcataagaagaaagctgaaaaaaggagctgtgccttctgtttctctatacaaggtatttaaatgtaggtgtaagtcaacaaaatgaaaatttacagagcctttaaaaatcaagatagcccccattatagctagaatttgcagacaaaaaaacccaagtcttaaatccagtaatagattttaaatgctttgaaaatttaaaaaaaaaattatatatattagcatttgttctggagcttttaaaaaactatataaatgcaaatcatttgtctagatatatataaaggttactaaccaattgcaaaaatcaactggtagatataaatagccttagaatacaggcttttgttaagtatgagacagctttcatagtactttgaaattatctatgttttttggttcctcctaataatgttatttatcttgatcaaaaatatacctaattattaacattgatacaggaagtatgtgggaaataatgaaactttctatgagtgagtcaccagtattggtatgatattcttctgtttcctatgactgtttttattttatccttttaccccttaaccacaactctgacacatgggctttcactttctgcacagtctgtgatagtcacctaactgttctattctgacactagccttactttcctcttaatcgtcagagtctccttcttccagtattggtttatctcattcccctattcggaagtatttagttggtgtcaaattcaaactcaccaagtcccaagagcttcctattaactgatttgtacatttttaactgtcctgaattatcttttcaaaccatatatacttactatatatgtgataaatttgcttgctttcatacttttgtgtaaaatcaataatggctgccatgtgttgagagctacaatggtccaggcattgtactaggagatttacataaattcttatattgtatcttcaaaagaatcctgtattattatccacattttacagatgaggacacaagggattgtagagcttatgtgacagctaattgagggagctaagattcaaacccaggtcagtcttaattccaaagccatgcactgtccactatgccttcttttttgcacaaataacttctctgtcaccttcattaaccatgttattgtaccttctaagaactgcttaaaactcacttccatgaagccatcccagtttactaccacctttctctagttactttatttcagaaactttcaacatcatattaatatttctgtgtagtgcaaaaaaaaaaagcctgtttatattaccctataaactatacattaaaacattcagagattatgaccttttctttcctaactaactctccacagcaaccagattagtgctttgtatttagggtatttttacagatactcttctatgtgattatttctaaaataactttaattttatatatctgtcatagattcctcaaggtgtacatcttaaaggtaaagcaagacaaaaaatcctaaaacaacctcttccagacaattctcaagaagttgctactgaggaccataactatagtttaaagacacctttgacgataggtgcagagaaactggctgaggtgcaacaaatgttacaagtgtccaaaaaaagacttatctccgtaaagaactacaggatgatcaagaagagaaagggtttacgattaattgatgcacttgtagaagagaaactactttctgaagaaacagagtgtctgctacgagctcaattttcaggtacttccccctagtaacctgtagtatttacaaaaatagctytttttctgaggtaccattaagtatttattttgttcttgcctatgaaaacatgctttcagttgggaagtgaaagtctcagtagcttaagaagaatgaaaattaatcaccaaaattcttttgtatcttatggttttccagttataaaagtaacatttattataggaaaagcaaagaaatatttaagtaattaaaataatgttnatcccactacccagagatgaaaccatatggtttataccattttctgttctgcacttatcactttttgtagtagctcttacccatttgctactgcaaattcattataaacagttttaactgctacataattttaccaaagtctttttgcagtagagttgtactagtttgcanaatttctttgagcttggaaattgtgtatctccacatttttttctaaaatattctatagagtagactataaacccatggaaaggctacctagtcctctttagagtgaactaagatctttgaagaagggcaaaataaaaattgccaacttgttctttgatgaaagcagcagagatttggatttacattctaggaaaagagaaatgtgtcctctttttagaaaagagtagctatctccaaaggagatgaatattttatgtttttccaagaggggactagaggtcataaataggaatccccaccaggaacagaattttttttttttctcttgatattaggcaagatggtctgttcagtctgaatagtaccctatccccagaaatgtttttcatatctaattttcaccctcagataaatagtaagcagggaacaaaataaaataaatgtcctcattttattttcttttcagttcctctaaaaatctctcctctcaggctgccactgaacagtaaaacataattcaagttgaaaattttttcttccctctagtgaaatgattccagatgaaccgaataaattggtcaaggggtcctaagtggatattaacctctgaatagacttaatcaaaatgcaactatatttgtatttgaattctgatgcccagtgcattttatatccaaatgctataatctgtacctgaaaattttactrttcatcacaaagaataaaaaaatttattttaacagattttaagtgggagttatataattggagagaaacagatgagtactccgcagaaatgaaacaatttgcatgtacrctctacttgtgcagtagcaaagtctatgattatgtaagaaagattcttaagctgcctcattcttccatcctcagaacgtaagtgaattatttttttattttttaaaagtgactttcttgtcaggacatcttgttgattgcatgttaattactctttagatgttaaaccatattattcttttgttgcattttacttattaaggctattagtactcatactcccatttaaaaaaagaaaaaatggactaatgaaaaaatggactcccattattagcccatttttgttcttcaaaaacttctaggtagtatttgccaattatcacaacagcaatattttcaccaacaaaatgaagacacatagtatgacaagttttttgcatctcccagacactctgggtggataaaatttgaatcctgaaatattggaatttctagtatacttcagtagtttaatatctgacgatcctggaaaatctagaacagttctggattgatcgccattggtcttaggcaaagcacaaaaaaatctgcgtttttcataagcactgcagttgatgccaattaggttgtccaggaaacagattttgataaataattttttaggatttgtgattaaaatggatagatataattctcttagtgtgcagcaaataacaatgattttctagtaatgtcttataaatttaatactgaattcttaatttttactgtttttaccactagttttacagattcctttttttgttttggagactgagtcttgctttgtcacccaggctgcatgcagcacagtggcacaatctcggctcactgcaaccttgccttccaggttcaagcaattctcatgcctcagcctcctactgagtagctgggattacaggcatgtgccaccacacccagctactattttgtatttttagtagagacgggattttgctttgttggccaggctgatctcgaacccctggcctcaagtgatctacccgccttggcctcccaaagtgctgggattacaggcatgagccaccatgcccagcctagttttacagattcctttttttttttgagatggggtcttgctctgtcgctcaggctacagtgcagtggtgcgagatcttggctcactgcaacctccgcctcccaggttcgacccattctcctgcctcagcctcccaagtagctgggattacaggtgtccaccaccatacccggctaatttttatatttttagtagaggtgggatttcaccgtgttggccaggctaatctcgaactcctgatctcgtgatccacccacctcggcctcccaaagtgctgggattacagacatgagccactgtgcccagcccagattcctttataaaaaattgtagattttcctctatacacactattacaataatactaccaataaaagatttaaaaataattgaccttcagagtgggctgctcttctaattgaccttcagagggctgctcttctaaaaaaatttaaagaggaaaaatttattattcccatacattatatataaataattactgttaacatttagagtatttccttcctgtgtgtgtgtgtgtgtgtgcacttagatttattagtgtttacatagttatgatcttttgtaaataaatttcyaaccagccttttattactttattatgtatgccttttatctgtaacgttattttgaactctttatagacaagttttaatagctgcatgatatcaggtagtcctaccctacttaactctgacattctccagctattggacatttctattgtttacattttggggttataattgttttttcatatattttgatgaacatttgtatataaggcttactctttcataatgtgattttaccattcaagctagatattatacttatttataaatattcactttttgctaagcaagagagttttataggtactgtgttgataatttctcctcctatacctttttggttttttgttttctgatggttgtacatattctgggggtacatgtgatattttgatgcatatatataatttgtaatgatcaaatcagggtaattaaaatatccatcatttataaatccaaacatttatcttttctttgtgttgagaagcatatacctttttaatctcttcactggttttaaagcattacttaatggtatttcactatggtttatataagagatttcaggtaacttcttatcttttctttttcatggttttcttcatttcccatagttctgcgtcaactcctagattaaatcttcctggtaattccagcgcacatttatcttttctctcttcatgtcattttgcattttgtgacctttgctgtaacattatatatttagatttataattccagtacttaaacagttgctcatttctttaggtactttgcctataagtaaggtatattgtttagtatgatagtaatatatgtttgttataaaacattcaaacagtatataagtacataaataccagaaagtgaaaaacacagtacttcgcttcccctaatcccacaaaataactacagttagcagttttgtgtatatcctccaagttaaataaaaaaaaaaacctatttacctaccaataaaattttgttttagtgttctgttatattaatggtatatagagcctccgtttattttcttatattaatgtaagattatattatattaatataagattcttatattaatggtatatacgtttccatttattttcccatataaaaagtgatgtttttaacacagttatcttaagtattagatctttataatcattatatttaatatttattcaataaatatttattgatcaggagcggccagtgaggcaggaggaaaaccaggagattgtgatggcctggaagccaagtgtagaaagtatttcaaggagggagtagtccactatgtcaaatgctgctgggagatcaggtaagatgaggacagagaattgaccattggattttgcaagatgaaggtcattgatgaccatgacaaaagcagttatagtagagtggtggagaggtaaacctggctggagtgggattaagagagactaaaggtgaagaagcagagaaaatgattgtgggctcttccatggagttttgctatgaagtagagcagagaagggtctgtaggtagaaaggaacatgcattgaggggagggtgtttgttgagatggcagatgtcccagcgtgttcgcatgtttatggcaatgatccaagagagaaaagaaaattggcgatgtataagagaaatgataattgcaggaggatgacatccaacactactgtggaaggaagtatgaccttaaggtattgggacagttcatccattgaaacaggaagaaaggccagaagtacagataaaataggttaacagatttggtagtaggaaaatgagttttgtcttttaaaaagatggggtctcggctgggcacagtgactcatgcctgtaatcccagcacttggggaggctgtggaggacggaccacgaggtcaggagattgagaccaccctggctaacacggtgaaaccccatctctactaaaaaaataaaaaaaaattagccgggcatggtggcaggcacctgtagtcccagctactcgggaggctgaggcaggagaatggtgtaaacccaggaggcggagcttgcagtgagccgagattgcaccactgcactccagcctgggtgacagagcgagattccgtctcagaaaaaaagatggggtctcactgtgttgcccagattggccttgaacttctgggctcaagcagttgtccagtcagcctccctgagtagctagaactacagacatgcaccaccacactcagcaggaaaatgagtttttattgcattacttctgttttctcaaagttattaactgagagttgaggaggaaggcattagatttgggaagaaaggagaaaatgtgaccagtcacctaccaggaaaagtaagtaactagaaaaatgcagtaccagatttgtggtcaaaactgttgtctttccctccataatgatggagaaacaattagatggttaacaattagacgatgacagaccaaactagacttaaatttttttaaaacccttggtttggttagatagggtgcctcatgaatttctaattgtctatatctttctctagtcttagctacatcagatatttctctaattttctctttactgatgttggatcctttttcagttctccctggattctttatgtccaaaactttcccaaagctgtgttttttacaattttcagtgtttggggtctttaaagtaatttattttcacaaatcctttgaaattaagtcttaatatccttaactttccttgttataatagtgatatatttagtgtgatcttggtcatagatagaaaatgctggcacagttgctctttatttatatttcctctgtttctaatttttggcttatattcactgcagtttagtaaaccaactccctctataggttacctgctgtgagagaatcaaaagtaacaacagtgggagtagctaaaagtcttaacagaaaaacatttagcactgtagatctctaggactatatttttcccaggcagaattttaggccacccaagtgactccctataatcattccataactaagttattgtatattggtttgttaatttaaaatatcgtgttgatgagagtataaatgaaaattgctttgaactttcgcaaggacagtttgggaatatgaattgtaaattktgtaaatatgaattgcacaattatgtgcagctgaaatcctaaatttgtctttaatttcttataaaatataagtaagtttaccttggcatgttattcctaggaattacaaaatgacataaatatgtatatgtgtatgggtgcacatgcgtgcatatacacattgtggtactgttatctaaaaatttgaaattatcaagatgtccttcgatttgagttggttttcatttaactatactgtgatatatactgtgtacacatttaaaatgttgctgtaggttgatacttaagggcgtgtaaaaatatgtgaaacattaattaccattaagtgaaaaatagattcagtatacaattttgaaaattatatctasgtatgtatacataaagacattaacagtaacttttacttctttatactttttgtattgtttttttaaaaagaatgtgtctttttttatgatcataagaaaatttttttattttcagagacgaaaagagatttaaaggagaaattgtctccttccttaccattctaactcatgaacttggtttggatatgcctactctttcttataaaaactttaaaaaataaatcaacaaatccacgtaccattctgcttcatgttcatgacattgttctagtagctgtagatattcagataccattgagatttccatttaaaaatcaaactcagcagaacataagttggttgtttttttaaccccatttaaaataaaattacatagggacattaagtgctttgttatatatgtaccacatatgcaacacagttagcatccttggtgctcatttgagaatcctaatgtaaaaaaaaatttttaaacaattaaaattggatgacacacttggaaagagctttcaacattctagtgtgctgtagcactgctatactgttgagtcattgtcttactgttttttcctttttttaaaaatcttgtaattttaggttcaggggtacatgtgaaggtttgttacatrggtaaactcctgtcatgggggtttgttgtacagattatttcatcccaacctccaccctcgagtagaccccagtgtctgttgttttcttccttgtgtataagttctcatctttttttttttattttttgagacagagtttcgctctgttgcccatactggagtgtagaatgtagtggtgtaatcttggctcactgcaaccttcacctcccaggttcaagtgattctcctgcctcagcctcccgagtagctgggattataggcacacaccaccgagactggctaatttgtgtatttttagtagagatggggtttcaccgtattggccaggctggcctcaaactcctgacctcaggtcatctgcctccctcggcctcccaaagtgctgggattacaggcatcagccaccgtgcccagccaggttttcatcatttagctcccacttataattgagaacatgcagtatttggttttctgttcctgttagtttgctgaggataatagccttcagctctatccatgttgctgcaaaagacatgatctcattcttttttatggctacatagtattccatggtgtgtatgtactgcattttctttattcagtgtgtcattgatggagatttagggtgttccatgtcttgactattgtgaatagtgctgcagttaaaatttgcatgcatgtgtctttatggtagaataatttatattcctctgggtatataaccagtaatgggattgctggataaaatcatagttcgcttttagccctttgaggaatcactttccacaacaattgaattaatttacactcccaccaacagtgtataagtaagttttcccatttctccgcaattttgccagcatctattatttgttgactttttaataatagtcattctgactggtgtgggatagtatctcattgyggttttgatttgcatttctcttaacgattggtgatgttgagctttttttcatatgcttgttggtggcatgtatgtcttttgaaaagtgtctgttcatgtcctttgcccactttttaacaattttctcttgtaaatttgtttaagtttcttacagatgctggatattaggcttttgtcagatgcacagtttgcaaatattttctcccattctgtaggatgtctgtttactgttgacattttcttttgctgtgcagaagctctttaccttaattagatcccacctgtcaatttttgcttctgttatgattgctttggtgtctttgtcatgaaatcttttaccgttcctatgtccaggatggtattgcctcggttgccttccagggtttttatagttttgagttttacatgtaagtctttaatccatcgtgagttaatttttgtatgtggtgtaagggtccagcttcagtcttctgcatatggctagccagttaccccagcaccatttattgaatagggagtcttcccttttgcttggttttgtcagctttgtygaagatcagattgtcataggtgtgtggccttatttccggtttgccctattttaatatacaaacaacagatacttttgtcttctaaatagattataacctacttatagtcaaggtatgtcttttgccatcctgtaagtatgttaktgttttgttttgttttgttttgagacagttttgcctcatcgcccaggctggagtgcagtggcacaatctcggctcactgcaacctctgcctcccacgttcaagcacttctcctgcctcagcctcctgagtggctgggattacaggtgcgcgccaccatgcccagctaatttttgtatttttagtagagatgaggtttcaccatgttggccaggctggtctcaaactcctgacctcaggtgatttgcccacgtcagcctcccaaagtgctgggattataggcatgagccaccatgcctggcccataagtgtgtttttwaaacctattaatgcatcatgaaattagtgggtcataattgccatttaagtatatataaatatatttatatttayttnaactattacagtcatcccttggtatatgtgggggattggttctaggacacccccaacttgtgccagtataccaaaatccatgtatatacaagtcctgtagacagtcctgcagaacctgtatgtatgaaaagttggctgtctgtatatgcaagttttgcatcctataaatactgtattttctctccatgcatttggttgaaaaaaaartcatgtataagtgtacccatgccatttagttcagaagtcaactctgtgtgtgtgtgtcatatatgtgtaagttcgtagtatgtactaagggtgaattttgtttatgaaacttctaggtagcacctaaaatatttggaaagccctatcccaaaatacttagggaagaacattaaactctcaattaagtagaggtcagctgtccaggaagaagccttggttgccttagaatatagccaaaaaatcagaaatttaacttaacagacatttgagttacaaaagtatatgttacaggtgaacatcctagtctctccctcagaatccctttagttttagacagttattaaatgtggctgttttctttcctgatctataacaagttagaaagagttaactagaaggaagaagaattccaaagatagacaccattataggaagaaaataattagcagtctgagaagagcagggatactatgaaagaactcctaagatagtagcacaggtaggttgtataggggtgcagatgcacacttgttatatgcctttaagggtgtaattttgaggctgtaaagagtgagaaatgcactaaactcctgggcatcaggaaagccaggtttcacattcgttcataactaacagtacattatgggccaagtcgcttaacctctccctctgtcccagtttcctaatctgtaaaatgaggtagatgtactagatgttctcaaagattccttcacattcagcagttttctcatttcagtgaatttacaggtaagacttgtttatgatttacaatataaaaagatcagttagaacaaactggttagttggtttactttttaaagaataaatgagaaattaaaaatgttggatgtttgcatcttaaaatactactttgtgtttctaagtttatcttactattttattgtaacgatgaatttaccattgaaaatatctatagaatttggctgcttatatacttggctttatttctacagggatgggagactactttaatagtgcttaaggcattttcccatttgtctttttatttctctttgagtgttctttcactttttatgtattctaggtggttatccaaatgccaacccagtccaggtttcaacagcaacattttttcttttcttcaacgaagagtagagaatggagatcagctctatcaatactgttcattgttaataaaaagtatncctctcaagcaacagcttcagtgggatcctagcagtcacagtttkcaggggtttatggactttggtcttggaaaacttgatgctgatgaaacgccacttgcttcagaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattagaatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctraagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaaractggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattnatctttttgtagatgtgaataagcatctctttgatggagaagtgtgtgccatcaatcactttrtcaagttgctaaaggatataataatctgtttcttaaatatcagagctaaaaatgttgcacagaatcctttaaaacatcattcagagagaactgatatgaaaactttatcaaggaaacactggtcatctgtacaggattataaatgttcaagttttgctaataccagtagtaaattcaggcatttgctaagtaaygatggatatccattcaaatgagagacctaaaatatattaacattttaattaagaatacttgatcaacattttttgaagttcaatttaccatattttataaattgcgcattctgcacagtggacaagtttgcaattctgacttattaaaatttcaaattctgcatatcacaaaatctccttatacttttggtatggcttgcagcatttatgagttttccaaaatatagaaagcagtaggtcagtaggagcaaactagccaacaggtactgtctttgaatttactactgtaagactaagcagtgttactggacacagttttaacttgttcaatctgcttcaaaaacaagaaaaacaacaactatgagttatcaaaatattgactccatttatgactagactacatttctgaaagatctttggtttacgattcttaagaatattgacaatacctataaaactttgaagataacttttacttaaatatgaaaattatagtttgaaaattaggctcaagcaaatatcaaatactgcaaaaatccccttgtcccaggataccctaaaatagaagtgcttaaactttgtcaggcagaaggtaaagtacatgagccatgagattcttccttgtgctgcagccacgctggggagtgcaatctggaaagaacatacctaatgtgtttttcaccatccattatctctgaactttgaaatattacttttgaataataggctggacacttagtttgacttgaaagagctcaatgctcatcggaaaacagggagaaacctaatctgaagatggaagcatactaaggacaattttctccactcacatccacatttgaaaagaggyacagaaaaacataggtaactctactttcacaaatgaggatagtttaacggatagaagaaacaagcacattattcacctgtgttgtaaaacatctactcttttttgtcactgaataagtgttcccaaagtacagttaatcctaatatgaaaacttagaattgtaaaagattaatgataacgtaaaagtatattgattaaaattccccttacaaagtatattttgatgtttgtttattctacctcaaacagaggcttaagttttgaagtgtaaccagtttatacttcattttatacaaaacttattgctgagaagtctgaatattgtgctttttgttgtttgtaaatagaattgaatttaaatacaccaggataaatcttatttaaaggaagcctgtttgaaaatcaccaactttaacttattgcttatataaatccaagctctgtacctgatctttatgtaaagcaagattcatatgtgtagtatctaatgccctttggtgttacatttgactaaaatacaaatgtctgtattttagtgttgtgcattattctttcaagtgctaggtaaattggaaagagatggtcgattgagacagtgaatattcaaaaattggaaggtcacagatttctcttagataagaatagtctcatcactacatttagcccagttaattgctcctgcacttgtgaaagggcttggagtcttataccagatacaatacactttacagtgaaataaattattcattcatatttgatttagggcagtttggttataatttttactttgcatcttggccatttttttctttagagaaaagcattccctttaaaaatttatcctgctttccaacaactagtgctaggagagatggatatccacatgcaaaaaaattcactcaaaatgaagcaaacacctaaatagaagaggtaaggctatacaacttttagaaaataaagagttaatctttgaggtttggattaggtggtggtttttctttttttctttctttctttttttttttgagacagagtctcgctctgttgcccaggctagagtgcagtggtgtgatcttgggtcaccacaacctgcacctcctgggttcaagcgattctcctgcctcagcctctcgagtagctgggactacaggcacgcaccaccatgcctggctaatttttgtatttttagtagagacaggatttcactgtgttggccaggccagtctggaactcctgacctcatgatgcacccgcctcggcctccaaagtgctgggattacaggtgtgagccactgtgcctggccaggtggtggtttcttaagacacttaaagcacagcaaaggaaaataattggacttcatcaaaattaacttgtgctttgaagggataccatcaagaaagtgaaagacaacccattgaatggaaaaaaatgtttgcaaatcatttatctaattaagttattatatgtagaatctacaaagaattcctataactcaataataaaacgacaaataaccaaaatttttaaatgggtaaagaatatgaatagacttttctccaaatgagttatacagaaggccataaaatacataaatatatgttcacgtcagctctccagaaaatgccaatcaatgacaatgaaacatcacatcacacctgttaggacagctattataaagaagacatggaggccgggcacggtggctcatgcctgtaatccctgcactttgcgaggccgaggcgggtggatcacctgaggtcaggagtttgagatcagcctggcaacatgaggaaaccctgtctctactaaaaatacaaaaaattagctgggtgtggttgcacgtgcctgtaatccagctactcaggaggctgaggcaggagaatcgcttgaacccgggaggcggaggttgcagtgagctgagatcttgccactgcattccagcctgggcaacaggagcaaaattccgtctcaaaaaaaaataaataagacatggccaggcacagtagttcatgcctcaactcccagcattttgggaagccgaggcaggaggattgcttcaacccaggagttcaaaacaagcctggataataaacagtgagacccccccatctctgaaagaaaaaaaaggaaagacatagtattggcaagaatgtggagaaattagaaccctcatacacttttgttggtgagaatgtaaaatagtccagctagtgcagcagctttggaaaatagcctggcagttcctcaaaagcttagagttacctatgacctagcaaattgtactcctaggcatatacccaagagaaatgaaaatgtccacacaaaaatgtgtacatgaacttcattgataatagccaaaaagtggagaaaaagcctaaatgtccattgactgattaatgaagacaaaaaaatgtgctataaccacaagatgggtatgtttaaccttataacaaactgccaaaacttccaaagtgactattgttttgcattctggccagcaatatatcaatgttcccgttgctgtacttctttcttagcacttggtattgtcaggattttggtcttttttcaagtagccattctaagaggtgtctagtgctatttcattgtagtttacacttgcattttcctaataaccaatgatgtggagcaccttttcatatgcttatttgccatcgtgtatcttcttaggtgaaatgtctgttcaagtcttttgttcatattttggaagattggctcttttcttactgagcattagttacatattctggatataagtgcattatcagatgtgttttgcaattatgtttttctcagtctgtggctttttttattaactgtcttttgaaaagcagatgttaattaattttgataagtccagtttttctatttttttctttctgggatgtaagctgtgattcattctcagttaactttggtatatgagttgaggtcctttttttttttttttttttttttttttttttttttttttgagactgagtctcgctcttttgctcaggctggagagtgcagtgacacaatcttggctcactgcaactccacctcccgggttccagtgattcctttgcctcctgagtagctgactacaagtgtgtgctaccacgcacgactaatttttgtgtttttagtagttagggttttgccttgttggccaggatggtctgaactcctgaccttaagtgatccacccgcctcagccttccaaagtgctgggattacaggaatgagccaccacacccagccatgaagttcatatttttacatatggatatgccagccccatttgtttaaaaaactatccccattgaactactttcatacaatgataaaaaaccaactatatatatggggtctctattgtcttccactgataaataggatctatccactaccagtcttaattactctagttttatctgtcttgaaattaggtgggagttctccaactttgttcttttttcaaaaatgttttggctgttctggttgcccctttccatataagttttatcatcagcttgttgatttctataaaaattcctgctgggattttgactgaagttgtgttgaatctatagatcaatgtggagacaactgacatcttaataatatagaatcttctaatccatgaaacatgggctatcttcttttttttaggttctttgattttatcagttttttacttttcagcacagatcttacatatctttgttagatttcatgttttctgaaatctgtaagtggtgatttaaaaatctcagtttctaaacattcattgctactacatagaagtacagtcaacttttgcatactaattttgctaaattcacttattctagtagttttgagattctttgatttttctatgtaggcattcatatcatcaagtagtcttatttatttatttccaatctgtgggcctttttcccacctgccttattgcacagtgagctacattgttgaataagaatgccttgctcccagtcttaaaggaaagcattcttcactatgtgtatgttagctgtaggctttttttgtaaatggtctttatcaggtttagtcttagttctctgaagactttatttttttgtttattgaatcatatgtggctgaattttaccagatatgtttttctgcaccttttgggtaaaaaaatttctgagataaaattcacataaccataatatttaccctcttaaataagcatatagtggccgggcgcggtggctcacgcctgtaatcccagcactttgggaggccaaggcgggtggatcacctgaggtcaggagttggagactagcttgaccaatgtggtgaaaccccatcactactaaaaatacaaaattagccaggcttggtggcgcatgcctgtaaccccagctactcgggagactgagacatgagaattgcttgaaccaggaggcagagggtgcagtgagctgagatcgcaccactgcactctagcctgggcaacagagtgagactccatctcaagaaacaaacaagaaaatatataatttagcagttttacctatatccacagtcattttctgcaacttttgagatgatcatttagcttttcttatttgtatgctgatacagtgaactatgttttttttaaaacattggatcaacttttattcccaggataaaccctacttggtcatgatgtattctttttataatactatgaccagatttcatatgccagtatgatagatgacagttttataaagtcccagtgaccttataataaacataaccctaaacatacttgttttcttattgcttttgaatagaaactgagtgtcttaaatgctgtcacaaaatttgccatttagaaggaaatttttaattaaaaaaaaccttatagctttcaactcataaaatcacatggattaaaaaaaaaagctcacctttggtatacagataatgacaaaatgtgcattcaagaagccctaacaagaaaagcctgaagtaatttacatgatgaaaataactccaatagaaagggatttttagttgattgccttcccttctgctttgggtagccacaccagaattcctatataaaatgcttaagagatacaacatgatcaaagttatggccggaggtcctgctgtgaagcttcatttacataacaagtattcattttcttaactatttgtgttacagaacaataaaaatagataacttttctaaaattatttttattcacattttacataagattgaaaaaatgtcagttgttcactaccagaaaatggggaactaatcactctgtttgcttttgtacctgtaacattaaggttctgtttcccagaccccagagataagacctacaggttgtgtttagtgcttcagaaaaaaaggaaactaagaaagatagctatcataagaacatttcacattaaaagacagagtagattgattttctaggtatttttgtttttgagacaaggtctcactctgattgccaggctggagtgcagtggtgtaattttgactcactacagcctcaacctctgcaggctcaggccttcaaagtagcgaggactgcaggtgtgcgccaccacacgcagttaatttttttatatttttagtagagacagggtttcaccatgtagcctgggctggtctagaactcctggactcaagtgattcacccgccttgacctcccaaagtgctggaattacaggcgtgagccaccatgcccggctgagtttctgctcttaaaagaaacagtggggaaaaaaagagaagacatattctcatttcaaagcaatttatgttagtaataactgagcaaaatgatagaattttttagttgtgtgttttcagaagtaatgtcaaatttacttcagataatttaaaaggttttttgcatattaaatggttaataaagtggtgttattatactaaagaaaaaatgcaaaaccttttttacagaatagtataaatgtttattttctgtatgatttactttgctgtcctgtttttacaatatagaaaagtgtattctttgaatagctctagtaaatataaatttaatctttctactttgggatgtaaatagagctaaaaaattatatacccaaccctccccaaatagtcttttaaaatcattgaattaatgtggctattcatc

SEQ ID NO: 10576 - DNA, 17025 bp, Homo sapiens
  misc_feature (1)...(17025): n = A,T,C or G, or insertion/deletion polymorphism (see Tables 1-2)
tcacctttgcaagcctttggtgtttgtttgttactcagtttgctgagaacaccctgtcatcatcttttaatcttggataccacaactccctggaagggatgggtgctttgattaatggagaaagaactaggtaaaaactgaccaaccccagtggagacctgtaccaacaggtttgtagggttaaagccagcacaaatccagtccatcctgattagagctgcattcgagtttttttttaccaacttgttcctgggatccccttttggctttggatgtggaggtatccactctatactcatgagcataggaatgaagcccaagagctctaaaggggtggaaatatggggccaggcatgacttaagtgacatagcacccagcccttatgttttctggagaaagctgtgctctcctgagaaatgggcgatgctttcatatcaagtcattacacatttactgcaaaacagccttgtcctcaaaaagggagatgatctagaaaagatgataaagcaaatagacaatcaatggtaatgatggtagagtaaaatagatgctgtgaaatgtaccaacaaaagaatatttggagcaagtgaatatgtttgcaggagacttcatcggagtgggttgatctgaaaatatattatggaggcagtgctatttgagctgttctgaatgaatggggggcttttgcatggaggagatggagaggaagcatgcaaggctggaagaagggttgcaggaagtcaagaaggcagccagagttggggttttgcagggaataataggcccatactttgaccagagattatgataggaataaggacatagtgagaaaattagtctgtttcctttacatttaagttaataaacttttggcaccaccaggactttgtagggttctgagaaggagcagtggtgaagtaggaaaaggagctcaccgctcctgccatgatttttcttcttttccccttgggaaaaaaaagagcttggaaccttccagtttgcaggttctaggagttctgcctatggattgaacacctagatataggatatgcagagtccctactaaatggcagattccagctcttctggcaaaaccaagaatactaacaatcatgttagccatgtgcctgctgcctagatcagaactcagagaaactgcagggccaacacaacctgtctgttcagggattaggcccagatagcctgagagatattcactaagccactggaaattgtgtcaacaggtgcgtctccaatgtctgcttaatcctccctggcatttccagggcaaaacttgagcatctgggcttccgggattttatgatcaggggctatgtggagcgggtttgaggaaagagattccaagttaggcagagagaaagtaagaaggcccagaacttctcactgttcttttttcctctaagaaccattcccccacaaccctgtctttcagtaagtatacgtgggcaacatgaaccagcaaattctctcataacccaagcaactctagaaaacatctctccagctttcagatttggttttgttcttttctgaaggtaaagaccaagatcatggaatttgctcatctgctactttttgagagagatgtgagtggccaccctgtagccattcattgtcccatattaccgttgtgtgctcctgggtgaaggtgaagatgtctggtgagcagcattctttaagggttgggtttttggctgcatttgtaatggcagaaatttaaaggcagccatgtcagggttaacagttacctgccacctgacccaagaggatccatgtagcttaccatggtgtctccctgtccccttcatccaccagccaatcaggacctgacagcagacactgatgaagctgcactggaagagacacttcattagacagacggagtttagcctgctgagcagtctgcctcggcctctgtgtgtgtatgtgtgtgtgtgtgtgtgtgtgtgtgtgtgcgcgcgcgcgtgygcgcgagtgtgtgtatgcgcgcgcgagtgtgtgtatgtgtgtgtgtggtaagtacatagctgtttggggcagtcaggagataacgatcatgatgtaggactggagggaacccaaagaaaagcaccacctgcatgaaagcccagctgttccccctggctgaacttatagaggcttttgccaaacattctggattttgccactgaacaaaggggaagggggaagaaggagaactgtcagtatgaagagagattatttccttgggctttgtccccggcatctcacagggcctctggatttgggaacttgccctgtttgttactctctgtggtcccatagctagttcacgtagtgtttaagctggaacataccatgttgagctgggtttaagtcaaagggaattttccagacttcagataagaaacttcagccaagatgcaaagcagagaggttaagatgctgggctctgaagttgaacaggtttgggttcaaatcctgcctttaccatttattttctgtctttggaaaattaagttagttaatgataatttcttcatctatgaaattgggataatatctttgctaccatagggttgttgtgagggttaaataaaatgatatgtgtaagtttttagcacagtgtctgtacatagtaggcacttagcaaataaaataaagtaaaataaaactagcaaaccaaaacaagcacaggtagggggtgttgctgacatagaccctgatctctcatattcctgagcagtgattctttaccccagaccttgtgatatttgacaatattttttagttagcattctaaaaatttctacttttcattttaaaataactatttttggtgtgtaaagcctgtttgcccaattgggctaattttctggaaagcaatcttaatttatagcccactaagtgtggcaaatactgcttgtatcttgtagaaataaatcaagtagaggtcagcaatacattgttgagtaagtgtataagaaggagtcaaagtgcaaaactgggttttcattgctgagttgctgatccagcacctggtctcactgccctccagcatacccgtaaaatgtaactgctaagtagactcactaatgtcaacttaaataataaccacagtgaatctctcttaaaaaaaaagttacctatttgagaatagggcattgcaatgggaatacatgtgccatagtaaactacgtgcatattcaggaggtaaaggaaaacaaaagttcttacaggaaaaacaatgaaaattacataattttattgaaatgtgtattcttggctacaaagatcaataacaatggtgatgctaatatgaagttggacaggcagctgctggactgatgtcctcacagaagtgtttgttgtgtaaggctattatggcctttgtgtaaggttgtggtttttgcagtcttttgtgatagttgtgttatcaggtgtacaagcatgagaactctctcttcgcagccttccttagctctatatttgtcaaggatttttttgaagacaagtgactccattttgattctgacaacttgcacactaacttataacatctcctcaccaactttataaactaacaaacttacacagtcaattacaggctcagtcccaatctctgccaactcatctcccccagccccacctgcacacttcaacccacctccactggcccagcacacacatacagttctttaacctctacttctatggtgccccagctcctcacagctcagtcctgccccaggcacacataaagacctattaggctttggaggcaggcagacctaagttcaaattcaggtctaacttcctagctatgtgaccttaggtagtttacttaagtttacttacttactctctgtgccttggtttcttcatctataaattgggttaataatacctaccaaatattcatcttctagatacagcctctggcttgttacttccctaacttaccctcagttcccaaacctttctggaagttctaagccccatcagaaaaagcttcaaacaccaccacagaagaaggtctaatcggctctccctcttgttctccaacttcaccctctcatactggccttcttctaactctgatcaggtagaagcaacctcagccccctcttgctcccaaaggttgaagcccctactctgcttttccctggctggtatgcctaccccaccttcaccccaggactggagccaacctgtccccatgtagacagatctctccaaacacaaagcctgcatcctgccctcctgcagtctggaactccccagtgctctgtgccctgaggggaagtgctggaggctgtgctgttgctacagggctgccctcaatacaccagtctcttcaaccaaggcccttaccatgccttcctatcctgttgttccctttcctgtctgttgcatgctgatctataagtgaggatggtaaagatggctttcccttccagagtcactcaggaagctacacagtatatattatctgcaaagtgccactcaagagcactctttgggacttggcttctgagctcagaaaacttcctcctcaggaatggttcttcatgcattgaggataagtgtgatgttcataaggtgccaaaactcaatgagagaagaataaatggcagcatggtgcaacagagagaacacaggcctggagtctgaggggctctagtccagcaccgtctccgcttcacagagtggctacttctctgaggatttctcagtgttctcatttatgaattgggcttagccataccacctcagaggattgctagggagatcaaataagatgagatggtaatgaaaatggaataaaatcaaatgaaatgaaatggcaataccattatcattaacctcttggggacttacccctgggatggccaggctatagacttcatgagagttgaaactgctgccatcgtattcaacactgtattcctagggccttagccctctgcctgaaatggagcaagctttccataaatatttgctgattagccaccagttgagtttcctgtccttgcaatgaggagttaccacatgatcatggtaagccttttttctcatcagctacaaaatgctacctacccatagcatggggtggggaaggtattaactttttttgttttaattaaaaatgagaccaactttaaagagatgaaactggctttcttgtgtctcatacactaggtgtgaaaggcacttacaaaacaagaattcaaaaaatgttctaagtaataacggttctaagtaacatcaccacaaaaacatgtgtgccctctcagagtggctactttgtaaaagttaacctcaatagatatattcttgaacatttatattaaaaaaggaaacagtggccaggcacggtggctcacacctataatcccagcactttgggaggcagaggcaggtgaatcatgaggtcaggagttcaagatcagcctgttcaacatggtgaaaccctgtctctactaaaaatacaaaaattaaccgggcatggtggcaggcacctgtaatcccagctactcaggagtctgaggcagggaattgcttgaacccaggaggcggaggttgcagtgagccaagatcgcaccactgcactccagcctgggcgacagagcaggactccatctcaaaaaaaaaaaaaaaaaaaaaaggaaagagtcccataactttgtaggctcatagagacaaagaatgttcaccaggaccccagcctgtaccaagcactgctgagcccatcacaatggaaagaagcttccctgtcaagaggactcagctacagaaggtaccaaatgtggtaggaggggcctgttaattagaccaaggcagtcacacatcagcaggtaaaacagagacaagaggaggtgtggctgggctgggctggakcttggatgaatcaagccttcccatagggcaggatatcctgtctaaaacaagagccttggttaaaacccctataaaaggttctcatcacactgacctggtactcctcacaccacttaacagccacttgtttcatcccacctgggcattaggtaagtcccctcataagaaacctctttctcattctcagtgtcttggtgatctgagctcataaaactggggcagtcaggtatggactatgcatccttcagagctagctgtgagcactgggcaaaccaacgctaccgttgggaaacatgctctcctgaagcaatcaggctttctcctcctccctgaggctggcctgggagcagctcctctcactgggaaactgtgtgggcagcggctatggggccacccatgtgccttcctggatcagcaaaggtttcttttttctaaggctctggaagcttctttgcagtgctgagagtctatgggatcagaatcagtttacttatgccaacctagacaataagatcaaactgtgtcatggatgaaggggtttacatgattcccctctcctacaccagggtgatatttaggcaaaatatgtgtagatttttctaaggaatctaaaatgtaactaaaaggtcatcttattattttattatctaaaggtcagtggttaaagtctgctacatggttttaaaaaaaaagaaagatatttttcatctatgttgaggaaaacatccccagttttttaccttgatgaaaagtttgcctgaaattgttggttaccaggtcctagaaagggtttctcctgaacagcccaccttttgctatgacttactgagtcctcatggccacactaatctgctttttctagaactcaagtctccttccttccttttttctctttcttctcctacctatatctgcctcgtcccatcctctctctggctttccagctgctacaggctccatctccccttgcatttgagacttgtcatctttgataccatctcctcctttgggtctctccaaggcttctgcttaatgaatcttcaagtctcttttccttttgctcatgcaaccaaacccaggcctcacctcaacctacctctagatttctggctaatgaaaaagaaaagctttccctttgattaggaaccaactcataggtcaccagaaatctgggcctgatggagccacgtgcctgttgggcaagctgacttctctgataagtctcagggctgtggacagaggcgacatgcagagaaacttggaccctcagaactggaaggcctcccacccaaagaaggttcccccctcctgagcattcccagcaggtggtagcccagtttcttcccactttcccaaaaaaaacaagaagggagggctgtgtccctggaatttctgcttggctcccatccaagacaggggttgactcacagatgtatttacttccttttggtgttcccgatgggaccctaacacccttgtgataaataaataaatcctgtccacagggtacattctagaaagcccattgcatttgggttaaggaaaaatggatcctaggatttcttggctccttaaaaattgtgtggcctaacttctctgagcctgtttcctcacctataaaaaaaagtggaaataataaggattagaagagatgatgtacaggaaagtgattatataggtgtacaaaaattatatgtgtgtatatgtatataatagcataataattatatttaataaggagcacttaatataagccaggcatctgccaagtgctttttatgaattatgtctttaaatcttcacaataatcccacagagtactaatatcaccttcaattacaatgagtagtaaactgaggcatggagaggcaaagcaacttgtcccagctcacaycatacttaagtggtggggccagcatttaatcctgactcaggaacctgcctccatcctgtgtgctcctccttcccatacataagatgcattatgtaggaaaggacaaaggaaractaaaaacagagctgaacgtgcaaggaaagacctagcagcagacgtgctataaaggaaatagctgagrttgaytatggagcctccaagggaacttttcatcttttccaggttgacttcraagatgcctcagttactgcaaaacattaatgggatcatcgaggccttcaggcgctatgcaaggacggagggcaactgcacagygctcacccgaggggagctgaaaagactcttggagcaagagtttgccgatgtgattgtggtacggtgtgctgagccgggtggagaggggacatagcaggagagtgaaacctggtttgcctgcagaggccttgacctggggaatttgaggaggcagcagctaaacccaggcctgccgggacagatggcagctgtgcaggcagaaaaaaaggtgaaagaaccagagatggtcatgggagttggcaagtcctggctctttagattaaaaccttggttttaattaattctaacttaaagacaaggtaaaagggctctaaaaggacaactcagacaggagcagagccttggaatatttcaaaatgaaaataattgctgctttctgccgcctcttaaatttgatacagtaaatatttcccacgtctatctgaaangtaatcatccattcatagacattcattagaagcatagctctgggcttgcacgaagcagttactcaaaaatattagcagactgatcacatcagaaatgaaattttgaagagcaggttgttaatagctagggggagactttggagcctcaccccaccccacctggcaaaccagaaccaaggccttgatgcactttcctgtctttggtttgcatctaaagcaaccaggatgatgatggccttagggacaaggacatatgggcacagaaggatgctgcatccacatgctcagggcagcgctgcaggggcccactgcttccctccctctttatcatggggaaacatctgggcctcaatgaggagcgcacagaattcccatggggctgtgttcccaacctgctgctctttgtgctgggcctgctgaagagactaaggcctcagtgccaggggcaaggtgccaagggcagcccagacagtcaacttgagagcccaaacagttgcattgtgaattcaataatttattaactcttcaataaatctttatctaattttcctgtagcccagaaattgtgccaaatagaggctaccaaacaaaaaatgctctctacacttgagggagagagacgggactaaaaaaaaataaaggcaattaagtcttgctgctgctctagccgtatgtgtgtgtagtgtggggtctgaggcaggggaagctggcagcagattggaagggacctgcccatgtcctcctcaggggagggatgctgactccacctcatcttctcctcagaaaccccacgatccagcaactgtggatgaggtcctgcgtctgctggatgaagaccacacagggactgtggaattcaaggaattcctggtcttagtgtttaaagttgcccaggcctgtttcaagacactgagcgagagtgctgagggagcctgcggctctcaagagtctggaagcctccactctggggcctcgcaggagctgggcgaaggacagagaagtggcactgaagtgggaagggcggggaaagggcagcattatgaggggagcagccacagacagagccagcagggttccagagggcagaacaggcctggggttcagacccagggtcaggccactggctctgcgtgggtcagcagctatgacaggcaagctgagtcccagagccaggaaagaataagcccgcagatacaactctctgggcagacagagcagacccagaaagctggagaaggcaagaggaatcagacaacagagatgaggccagagagacagccacagaccagggaacaggacagagcccaccagacaggtsagactgtgactggatctggaactcagacccaggcaggtgccacccagactgtggagcaggacagcagccaccagacaggaagaaccagcaagcagacacaggaggccaccaatgaccagaacagagggactgagacccacggtcaaggcaggagccagaccagccaggctgtgacaggaggacatgctcagatacaggcagggacacacacccagacacccacccagaccgtggagcaggacagcagccaccagacaggaagcaccagcacccagacacaggagtccaccaatggccagaacagagggactgagatccacggtcaaggcaggagccagaccagccaggctgtgacaggaggacacactcagatacaggcagggtcacacaccgagactgtggagcaggacagaagccaaactgtaagccacggaggggctagagaacasggacagacccagacgcagccaggcagtggtcaaagatggatgcaagtgagcaaccctgaggcaggagagacagtaccgggaggacaggcccagactggggcaagcactgagtcaggaaggcaggagtggagcagcactcacccaaggcgctgtgtgacagaagggcagggagacagacagcccacagtggttggtgaggaatgggttgatgaccactcaagggagacagtgatcctcaggctggaccagggcaacttgcataccagtgtttcctcagcacaggrccargatgcagcccagtcagaagagaagcgargcatcacagctagagagctgtattcctacttgagaagcaccaagccatgacttccccractccaatgtccagtactggaagaagacagctggagagagtttggcttgtcctgcatggccaatccagtgggtgcatccctggacatcagctcttcattatgcagcttcccttttaggtctttctcaatgagataatttctgcaaggagctttctatcctgaactcttctttcttacctgctttgcggtgcagaccctctcaggagcaggaagactcagagcaagtcacccctttgtactgaattgtcctcatcttgtggggggtttcaggactatttttatctctgacatctctctattgccccatctaccctaatgcatcaataaaaccttaagccactggcctctgtgtctcattcaaccaccttctattgatattacaggccaaaggctgtagagttatgagatgatgaactggacatagtccctacctttgaagagcaactagttgagaaaatattatatgagattcctgctatatatcatacttaatacttggcagagatggaccagcaaaggtttcatacaaaaggcgctttctttatgatggccctgaaaagacaattagtatttagatagataggcaaaattcctcttggtctttcactacctctaattctatagcgttaaaccgctattcacctgtaaggtcacacaggaaagctgatttaagattaccaagaaatggaagaaggcccccagtggctgtgtagggaaagagcgagaaagcttgtgttaccaggtactgagccaggggccagaattttgtgcttcccttcctacctccccctcagtgtcagctctgacctctcatgatgtctcacccaccagatataaaccatgttatggggtagagactatcaattctggtttattttaagagtgaccagaagaacagttttaaaataaagatttatagggacgggcgtggtggctcacacctgtaatccctgcattttgggaggcctaggtgggcggatcacctgaggccaggagttcaagaccagcctggccaacaaggtgaaaccccacctccactaaaaatataaaaattagctgggcatggtggcacatgcctgtaatcccagttactcaggaggctgaggcaggagaattgcttgaacccaggaggcagaggttgtagtgagccgagattgtgccactgcactccagcctgggcaacagagcaagactccatctcaaaaaaaaaaaaatgtataaacctaaccctacagatgctggttctaaggtttggagccaattaatattgtttagaaacttcttgggggtcttgtgcttttgtcagtacagaagactagataatctgaaagatttcccaagacaaaataactagatcctgcataaagcatttttttcactgtgttactggtttacaggaagtaagggaaatcgctaaggaaaaaacaaaatgtggaataaacaacaaccaaacaaaaacaacacgtaggctaaataacaacctccaaagacgtccgggacttaatctcagaaacctgtgaatatgtcactttatatggcaagaaagggacttcacagatgtgattaagttaggaatcttgagatggtggggggttattctggattatctgggtgagtccaatataatcacaaggttccttacaagagtgagacaagaggatcaaagtcagtaaaaggaagtgtggtgatgaaaccagcggctgtagccatgtgctatgagccaaagaatgtgtggagaatagaatctggaaatgcaagacactttcctctagagccttcagaagtaacatagcccttctgccacctcagttttagactcctgaccttcaggcctgtaagagaataaaatttttgtcattttaaggcattaagtttatggtaaactgctacagtagtgatagaaaactaacacaccaagcaaaaacctagagctggagccagagtagtaaagggtgaatgtgtgaaaggcaaggttgttcttctgaggacaaattgattttatatcaattcatgctggcttataagcataaaggccaaagaaaaacagcaaagaaaatgcaaagactcagggaatattgctcccataagccctttctggggaatctactagagaatcagcgcacatacatacacactaaacccagaatcacagaactgtttggcatacaatctgatgatgcacatttaaatatattccactgtagaactaagactacataatgtggataaaggtgacagaatagcatttcatgttatatgcactgaaaatttaaatacaatacagctaacaaaaaaatgaagggagaaagagaaagcatacagaaagtagaatgagctccctgattgtcttaatataagcatatgcttacaaggaaaaactgggagtgaaaggatatcacttcacattagatactgagaaaggaagaaggagggtaaggtgaaaatttccagaaaattccatcattacttagagtggggagtgaatatgccatttattaaagggaagggggaatacagaatacatattacataaagatgtactataagataacaacacaaatacaaaccttcctcaacaccaaaagacattctagaaaaaagcaaataacacagataacagagtggatgatgttatttatgtaaaagatacatattttcataaataggacataaaagagcgtgatagactgaggtcaaacatatttataacaataatgtcaagagcttaactcactactagatgaacaagttgcatattagctctatacaagtctatgctccttacaagaggtgtgcaaatcaaagagagtcagaaaacaatttgtaaacagggtggttgagttaatatatatcaggaaaatgcaggttaaaacaaaatttagaaatcaggagtcatgatcttgatcccagattagatcaaaaggcattaaataagactaagaaggaagctttaaaatgccaaatgctataatttcacaatgaagatataatggtttttaatatctatgcattcaataatgtagcacaactctgatgacacagaaactataagagatacaaggaaaaacttaaagaaaataacatagtaataatagggcactttaatcatctctctcagctcaagacagtaagtgtagagaagaaacagtacattcaataagatataaagaactctacagacatatagtccagcaatgtattaacctaacaagaaaaaactataccgtctacacatgaaatattcaatatcaggtcacaaagaaaacttcaatgcattattcaaaaatagaaataggcccaggtgtggtggctcatgcctgtaatcccagcactttgggaggctgaggtgggcagattgcttgagctcaggagttcaagaccagcctgggcaacataatgagataccatttcaacaaaaagaaaaatacaaaaattagttgggcatgatggcacatgcctatagtcccagatactcaggaggctaaggaaagagaatcacttgagcccaggaggcagaggttgcagtgagctgagattgtgctactgcattccagcctaggtgacagatggagaccctgtctcaataataataataataataatagaattatttctttctttctttttcttttccttcttttcttcctttctttctttctttctttcttgcttgcttgcttgtgtctctctcgctctctctctctttctctcactctctctttttctctctctctctctctctctttcttttctttttgagacagggtctcactctgtcacccaggctggagtgcagtggtatgatctcagctcactgctgcctccagctcccaggttcaagcaattctcctgcctcagcctcccgagtagctgggattacaggcccttgccaccacacctggctaatttttgtattttttgtggagagggagttttgccatgtttcccaggctggtctcaaactcctgagctcaagtgatccgccctcctgagcctcccaaagtgctgagactaaaggcatgaaccattgcccctggccacaaatagcattcttaaaagaacatgtaatagtgatggattttaccaaatctgtgttgttgttggaaattaaaaacatatatataaacacacacacacatattattttaaaactgttgaataaaaggaactgaaaataaaatgaaattgcagaatttttagaaaatgataattaaattagacatataaggatctgtagaacacagctacatgaattccccataaaaattaataaaagtataagttcacaaaacagtcaacaactaaataagtaagtaaatgaatagataatcctctttttttttttttttggaatcaacaagtagaaaaaccaacctaattttgaaaagagtgaaaaaggtggggtaagaaggcacaaacacacaaaataagaaataagaatgggcaaaagatacaaacagatagctcacaaaaaatacaaatgatgcttaaatatatgaaaagatgctaaagcttgtttgtaatactagaagcataaaccaaaactatactagtttgagataccattctcactatcagcttgacaaaaatctacaagtttgagaatagatgatgatgaggtaaagcaggcattttcacaccttctggtgggaatgcaaaatgagcctcagtggagaggaatttggtacagttcagcaatactacatgtgcctgttttgttcctgctgttgctttggtgtctgaagtagtgcctagcattcaataattatttgttaaaggaattgaatatcctaatctttcctgtcacatacataaattaacataatccctacacagacatgtgactgtggaaacatagacataatcaagctcatagcaaataagaaaatggagtttctttagtgttgtcaaaagttatgcagttagaaagaaagaggcagaaataggactaaacccaggtcctcggactctcaactcagtgtcaggtcaaacctcacagataagaaagggcaccagagtgtatgaagatccatccaaaggggctggggaggaagccgtagaaagtggtccttccacttctcacctccagccttaacaggaagtctggccatgaaaatatggagaagacaccatctcagcatccatgttcctaggaccttgcaagaataggaagattatgagtgaccattcctttcaacagttaaggtttgacagatgtgtctatgactcaagaaggatgttctctcaaagtagttcagagcccagaggcctaagagaggggccctaaacccctgtttaagcattcatgtaacattcaaggcaactaggctgctccatctcaggcccaccccctccatctcctgtagggacttactggccatccttgacttttaaagtttgcacatagaggcttctttcaaaaaatgtgcacgttattttagacaagagggaaaatttgtggaaaatacagagacttgatgggaatgaagtatttacactttctgagacagactctattttgttcaaaggatagagtaatcatccttccaaatcatatcaaacacattaaaatgtacacacagaccacttaaatacaatttttgctgacaattttttgaaaaaaattttatagttttgtttttggaattaggacataagttgtacatttgcctcattttagctatgacttctttgcaactacagagcacgtttttgaaaaaatatatacattaaaattgcttaacaagtaagaattttttattactactaaatttaacaataaatgagattcacagagctttatatctagacatttaaatttaaatgtttatagatttccattgcacatttattttggagctgacacacaggtatacctatggaaagatatctacattttaaatattttaaacctcaaattgtcagcaggtggccataactatccatgttttattaaaatcacataaaacctaggtacaaaagcaccactgattattgatctagaaaaactgcatgaattataacaaactgtctctcagaccacagtgcaatcaaactagaactcaggattaagaatctcactcaaaaccgctcaactacatggaaactgaacaacctgctcctgaatgactactgggtacataacaaaatgaaggcagaaataaagatgttctttgaaaccaataagaacaaagacacaacataccagaatctctgggacacattcaaagcagtgtgtagagggaaatttatagcactaaatgcccacaagagaaagcaggaaagatccaaaattgacacactaacatcacaattaaaagaactagaaaagcaagagcaaacaca

SEQ ID NO: 10577 - DNA, 47314 bp, Homo sapiens
  misc_feature (1)...(47314): n = A,T,C or G, or insertion/deletion polymorphism (see Tables 1-2)
tcagtcatacctgatgcacatggaagctctacaacaatgttattttcatgacctaggaagcttcatgaaagtaatgagtttataccacttcattactgaaaaaatcagcattaagacagaacatttttatttatcaccatctgaggcttctttctggcttctaactctagttttgtagatcttctataagatatcaagaaataaaaaccaaaaaccaggagatgcatcaatatttaaagtgttttatatatttgttgagtagaagtggttaaaaaattaagaattagtcctggttgcaaaataactttaagcacaaaacctcaattactgattaatgttgaaaagattatatttaagaggtaaaaatattctgtcatgagcatcaagtatttgatgcacaagtattagcacaagtagaacatttcctcaccacttttttgtgacttaataattgtaaatccagggaatgggcaagtggatgagtttgaattcataactgcccattaagagaattggattcttgtatcaaaactacctgtagggtatgtgacctttacctactttatttatatgtacaaataaggttaatcaaatagtccttctacttattttatgagagcactgagaaaagaatttatttattctttttttttttttttttttttgagatggtctcaccctgtggctgaggctggagttcagtggcatgatcttggctcactgcaacctccatctcccgggttcaagcaattctcatgtctcagcctcctgagtagctgagattacaggcgtgcgccacaacgcccagctaatttttgtatttttagtagagatggggtttcaccatgttggccaggctggtcttgaactcctgacctcaggtgatcctcctgccttggcctcccaaagtgctgggattacaggcgtgagccactgtgcccagcctactgagaagaatttaaattatggaatggatgacaaaaacttgattgtgaataagctcttgaaaatgcatcagatcactgaagcgaggtgaacaaatgttccaacagaagtgtgaggaagaatatcacacagacgtttccttatttaccatgagcgaagttctcaaaagtcagagagttgtctagtccagccctttccattagagaggaggtctctcagtatactaagagtatttcaacaaaagtaaatatatatatgagaaagacttgggcagtaaagaaaaaaaaaagatttttattttctaattattctttgttagtaagggccctaaatctagaagtgtatatgctggaacacactagaccataatacaagaacaatcaaggacaaaacaaaaaggaatttagaatgaacagattattccccgactcacactgtgaggggttataactagtcccttagtgaccaatctcagcaaggcagtcattcaagaaacctgcaagtcactctttacattccgtctttttcctacaccatagccaaatcctataggttctacttccaagattaaaaacaaatgcacttttctgtatcacccctgtaaccatctcagtctaaccctccatcatctcttgcctgaaccggccttccattgctctcccattttccactactctatgttttccctagatagcagtcagaggaattttttaaaactgtccagtggatctcctagtctgtgcactaaaaaatcctccaatggcttcccaatatacttgagatataatccaaattacctaatatgacctgcaaggtcttcatgatctggcccctgcttccctcaccactgttctttattttttacataccgctttccacctcactcctgcacactggctccctttcaattattcaaacccagtgaattgtttgctgcctcaggccatcgtacttcctgctgtctctgcttaaaggctttttctgtctattctttaccaaactcatttatctttcagataacagcttaaaaatcactgtatcagaaaggccttcccttggttctccaacataaattagggctccctcttacatgcttccatcataccagttatttactttcacataatgtctaagggtatgtaatcacttatttgtgtatatgtgtgcatatgtgtgtatttgtatactttcttttttggtctcccttaacacattataagctcccagaggacacaaaccatctgccttttgtctattactgaatacccaatgttcagcacagtccttggcacaatatgtattttttttaatggataaatgaccttgtaaggtgggtaactccttactatagatgaggatactaagatccaaggttattaagcaacagaaaaactgaatcagtactctaatgtctgcctagaaagtactagaaaaaattttttttccagcatgatctgtttgaatctgaagaacagtagattattattgtctagccaaatactgtgatttctactagttttttccagatggccacatatgcattcatatgtatatgcagacttatattctaagtggtaaaattttcaaagctttctttcttggaagaaaatattttctgatttttctgtttttctttctactcagctacaattcatgatccttggacactgttcagttcattagagtcagacacaatgaaagaacgagcaagggaacaaatggacattttttgctggatcagtggaggtactagattcaaacaatcatttaatgacttaataactaacttttcagaatgttttccttaaaataattttgtgaaactcatttctagtcactgcaggtaaaatttctttcaaaaccttttaggttaattctgttgctatttctactatagcacaactacatgatttaaaaggccaggtttccatgcaggctttcattatttcactgccttcagtgagagcatgagaatctctgctgtgtccttgagagcagcctcaagtcaaataaaaagtagactttaattgcactgagcatgtctgcagggaggataaacactttttctctactcttgtaagttcagtagcagaagcctgcaaattaaattgacaaatgacagataaacaggagaaaaggtttatttcatatgcacatggggggcctcacagaaaggaagtgaaaaccccaaaaagcagttaggcctaagagcttatataccatttttttaaaaggtgataaattgtggagaagtgataagacaaaggaaaaaggggtgggacttgtgaaggtggtaaattgtggccgagtaaactatatgagggaaactattggaagacaagggttattttgcaaggtttgccatatgactcaagttggtgctctggtgataggaatctcctcctcctagtgtgggatggggaggaggaacaacttcacaaagggaaatttatgtcctgcttttaggcagaaataggaaaagcagagtgtttcttctgttctgctgtttcttaattgccttcaactccaaataatgcttgtgtcaaagtggcatgttttggggtggcatattctggatctccttcaatgtccaacaatcccaaggaaatggaaaagtggggaggaaagaaatgattttgggggaaccccctttcaggaagtttttctcaaatttggatcccagaagtactccctgagaccctctaagattttcttttttttttttcccattaaaaagaaatttggcaagatatacataaaacataaaatttaccatttttagccatttttaagtataaagttcaagagcatcaagtttattcacatcgttgtgcaaccatcaccaccatctatctccagactttcttcatcttgcaaagctagaactgtagacataaaacagtaactccccattcccacctgcccttcctttcccacaaccacttcccaccccccaactgtctctatgaatttgactactctatgtaccttatataagttgaatcatacagcatttgtccttttgcgactaggcataatgtcttcaagcttcatccatgctataacatgtgtcagaatttccctctctctcttttatttttgagacaggatttgcccaggctggtcttgaactcctggattcaagtgatcctcccatctcagcctcctaagtagctgggattacagggatacctcgccacacctgggtccctccttttttaaggctgaataatattttattgcatgtatatactacattttgttcatccattcatccattgatggacatttgggttgcttccaccctttggctattgtgaataatgctgctataaacatggttgtacaaatttttttttgagtccctgttttcaattcttttgaatatatactcagaagtggaattatttaatcatacgataattctatttttaatgttctgatgaaccatacaattttccatagtggccgtaccattttacattcccaccagcagcacacaaaggttataatttttccacatccttgccaacactcatatttattttctgttctgctttgtttataatcatcattttaatgagtgtgaagttgtatctcatggttttgagttgcatttccctcatgattagtgaccttgagtctcttttcatgtgctcatcggccatttgtataccttctttggagaaatgtctattcaagtcatttgccaactttttaattgttttttttcttttctcagaaagggcatcagtacgttactcaagtttaagagatactgccaaccaaatcctagagataaatctgttagctacttgatattaaatttcttacaaatactattgctattataggtaaaataatctccactaatttttaaaattattaagtgtgaattataattcacatacagaaaaatgtgcataagagtacagcttgaattttcacaaatggacacgcatttataactagcgccaaaatcaacggagagaacctcactagaaggaagcccctcttccagttgctaactggaagcccctcttctagtcgctaactccttccagtcactatcccctgcccaccaaggtaaccattatgctaactttgagcctcttagttcttctgtttttgtagtttatagaaatggacttatgccatgtgtacttttgttgtctttttatgctgggcattaggtttccccagttgattcacgttattgcctgtaattgcagatgcttttttgcgttgctgtatagtgtttcattatatgaactctgtgtaatttcattaatttattctattgttgatggtcttttgggttattctcattaaggaattattacaataaatgcagctacgaacattctgatacctgcctgtccgtgcaccctaagtattcgtttctctttgctctatatgcaggcgtggaactgcggggccatagggtatgcaccttttgcagacagtcccaaactgtttttcaaaggagttgttccagtttacattccagcagcaaagtagaagaatgcagttactctacatcctggccaacacttggtattttccatcttttttttctattctattttattttgaaatataaaaacaactgaagcaaagttgagattgcttttgcggaaccttttcgtttttggttcgcttctctgaataattaaccatctcaggcttctattttgtcctgcaggctgtgtgagtgcgttttcgactttgctcgacatttttttgctcacttggccacttaagatgtcatctggtcaagaaaataaggtaggtgtccgaagcggggcaagccctttgaggacactggaagtgtgataactctgtaggcgaaactcatgcggaccgtcattggccgatttctcttttctagagttcacgatctaggagatcctgctcgtctctgatctccccactgccctcccgggctcccttggaggcgcctggaaagctgagccgccgccagccacccgccagaacaggggcggggcagggccgcgggtccgcacagagcatgcgcagacgaagcacggcgcatgctccgcagcgcggcgggtccacagatgaggggagtcgagactcccgcgccccaccacccccggcggagctgctgctgagccactcaatctgagccctggctactaataaagttcgtttaaaaatcataatcattcttaagagagcgaaagagggtgcgaactagccgctcggccccgcagggagagctggcgcgtcgggaggagacagcggcggcagcggttgcgccgcgaccaggaggagccggtggcgccgggcggcgggtccgcggccggtgggggacggtgagtagcggctcgcgctgcggtgcagcggcgctgcactcactcgccctctccaggggctgggggttcgtccggctccactggggaagactcagcttctccccggggtcccgggttgtgccttactctccggagtgggcaggggtatcgagggcaggggcctcccggcccggctcccccatcccccggttcggaccgccgagcgccggctctcccctccctgagcaccgatcccaagttccagctagagaaggtgggcggcagcgccagcccggcgccccctcccagctcccagcggtgggtacctggaattgcctggtgggcgggaaagaggggtggagcgagggcggcgctgcgtccccagtctggccgaacgttcggctttttgcctgccccaagtcccgactggggaaggggcgacccgggctgggccagacaccagtaagggcgtgaagtgctcaggttaggtttgatggcgaagagagtcctcagctccaccctggcatttagactcctccctgcagtgcgaccactctttacccgcgaccccacccttccctagtttcttgttcatagagtgctggaatatgaatgagccaaattgtgctgttccattgacactggttgctacagaattaactttactcggagatccgaggagccatcggcagttcccaggagtaagaacctgagagcgtgtgagagtaagaacttcattatcaggagctagtgaagtggcagtagggtctgaaaagggctgttaacttctctaggtttttatgtatctcctaacatctaggtaatttcattgaccctaagaagtttttcagtatttttacaaatataacctgtacttctacttaaataaaggctgttatgagaaaacaaccttttgattagtgagttaactcaccctttgcttctctaatttattagaccgcattagcaaaatgttaaaagttttggggaaagggtatttatataaagtattattgtcgaggtttttaattgtactcagaagtatgcttatttctaggaacgtaattgttttgatctagtgctttaagtctatagtttctgaaaagcaagagtccgactgcctgttaaaatttaatttggcttttttctttaaatttattttaaggaaattaatttattattttaaaaagtgtatggtaaaattgattttttttcgatgtacagttctgcgaattttagactcatgtaaccaccactacagtaaggatgtagaacaaatctatcgctcccccgccacagaaaaaaaacctaatgtgatcccattatatcatactccttacccctggcaattactaatcttttctagaaatgaaatcataacagttagtaatctttcgatgttagctttttttcactcagcataatgcctttaagatttctccaagttgtttcatgtatggataatttctttttttattgctgagtactattttattatgtggatatgccacagtctgtttcaacatctgcccatggaaggacattgaggttgttttcagttttctgtgattatgaatcaatctgctataaataccatgtacaggtttttgcatggacatgttttcatttctctagggtattgctaggagtggattgcagggtcatatggtaaatgtatgtttaacttttaaaaaactgttaaactgttttctggagtatctgtgtcattttgcattcccacaagcaacatgtgagagttctagttgctccacatactcccagcatttgatagtgtcagtttttttaaatttagccattctaataggtgtgtagtggtatctccttgtggttttaatgtgcctttaactaatggctaaagatgtacatgttttcatgtgttcatttgccacatggagtcgttggtgaggtatctggcaaagtctcttgcccatttttaaattgggctgttttcttatgttgagttttgaaggctctttatatgttttggatacaaattatatgttagatacgtgtttttcaggtattttcttccagtctgtctttctcttcattctaacagtgtctttcagacagcaatgtttttaattttggtgaagtccagtatcagtttttccttttatgggtcatctggtgtcatgtctaaaaactctgcctaacaggtcaagattttctccttctaaaaattgttttataaaagtgttccatttagatctgtgatccatttgagttaattgtataaggtgtgaaggtttacttttttgcatatggatgtccagttgttccgtcactatttgttgaaaagactgtcttctctccattgaattgcttttgcacctttgttaaaaatcaattgtctttatttgtgagggtctattttgggcctgttttgttccactgatttacttagctttccctttgccagtattacactttgttaatttagcattataatgtcttaaaaccaggtagtataatttcctccagttttattctttttcaaaattgttttagctattctgattcttttacctttgtgtataaagtttagaatcagcttgtggatacagaaaaatttggctggtgctttgattgaaattgtattacacccgtagatcaatttagggagaattgctgtttactttgttgagtctcccaatctatgaacatgatatgtctttccatttatttaggtctttgatttgtttagtgttttgtagttttcagcatacagattgtgtacatgttttgttacatttatacctaagtatttaatgtttttggagctattgtaaatctcattctaaaaaatactggtttcaaattgtacattgtttgtacacagaaatacaattgaattttgtgtgttgtacatatgtcctctgactttgctaaactcattagttcagggtttggtttttgaatttttggtggattccatgggtttttctacagagataatcatgtcatttgtgaatagagaaagttttaattttttcctaatctgtgttttatttttgtttcctattacaatgactagaacttcatgtatgatgaataggagtagtgagaatatatatccttaccttgttcccaatgtgaggggaaagcagtctgtcttccagaattgttttatgttatagatgcttttttttccttttttttttttttggagacagaatctcactctgtcacccaggctggagtgcagtggcacacgatctcagctcactgcaacctctgcctcccgggttcaagcaattcttgtgcctctgtctcctgagtagctgggattacaggcgagcaaccccacacccagttaattttttgtatttttggtagagacacagtttcaccatgttgtccaggctggtctcgaactcctgacctcagtgatcagcctgacttggcctcccaaagtgctaggattacagatgtgtgccactgtgctcggcctatagatgccttttaccaggttgaagaagtcccattctatttctagtttgctcagagttttctcacaaatgttgaattttgtcaatatttcttctgcatcaattgatactatgttgtgtttttttccttgagtttattaatatggtggattacattgattgttttttgagtatttaactagccttgcattcccagaataaagtccacttggttgcagtgtattgtgttttaaatattgctgaattcaatttattaatactttgttgaagatttttacatctttgttcagaagagtttgtctaattttcttttttgtagtgtctttttgtggtatcaagataatgctggcttcataaaaagagttgggaagtgtttcctcgtctctattctggaggagattgtgtacattggtgttaattttttaaatgtttagtaggattcttcagtgaaactgcctgatcctgtagatttctttctgagtttttacattacaaattcaatttccttcatagttataggggtattcaaatggacctatattatattgggtgaattatggtcgtttatacttttcaaaaatttggttcattttgtctgggttgtcacatttatgtgtgtagggttgttacgttatccttttgagtctgcagagtctatgttgctatcccctattttattcccggtattaggtatttgtatcctctctcttttttgtgttagtctcactaaagttttattaaatttattgatcttctcaaaaagccagctttttgtttcatcagtttttctgtttgcaatttcattgatttctgttcttcttttttagtatcttcctttttttttgcttgctttgggtttattttgctcttcttctagttcttgaggtgagtgcttagattattgagttgaaacttttttccttttcaaagtaagcatttagcgctctaaattttcgtatcttaggctgggcacggtggctcacgcctgtagtcccagcactttgggaggccacggcgggcggatcacttgagccaggagttagagaactgcctggccaacatggtgaagtcctgtctctactaaaaatacaaaaattagcccagcatggtgatgcatgcgtgtagtcccacctactcgggaggctgaggcaggattgtttgaacatgggagggggaggttgcggtgagccgagatcaggccactgcactccagcctggactactgagtgagactttgtctcaaaaataataacaataaaataaaatatattttcccatttcagcactaatttagctgtgccccacaaagtttcacatgtattttcactttcagttaattttgtttttttttttttttgctttccttgtaactactactttgaatcctggattatttgaaaagtgtgtgcttttagtttctgtctggagatttccctgttttatctttctgttattgatttctagtttgattccattgtgatcagtgaacatattctgtatgatttccattattttaagtgtgtttgagacaggaggtcagtagatctggttccacaagatacaggtcttaaaagatccccactgacaaaacaggatgcagtaaagaagctggccaaaaccaagatggtcatgcaagtgacctctggttgtcctcactgctcattatatgctaattataatacattagcatactaaaggttactgccatcagcaccgtgacaatttataaatgccgcggcaacgtctggaagttaccttatatcatctgaaacagggaggaaccctcagttctgggaattcccccatccctttcccagaaaagtcaagaataatccaccccttgtatagcatataataaaaaaaaaaccataaaaataaccaaccaccagccctcagggccgctctgtctatggagcagccactcttttattcctttactttcttaataaacttgctttcatgtcactctgtcggctcacccttgaattccttctgcacaaagccaaaaacccacgtggcctcctgggctgaactccagttttggggtttgccctgtgacatgttgatgtttgttttatggcccagaatatgttctatctgggtacttgaaaggaggtatattgtgctgttgtatagacagttctataaatatcaattaaattctgattttattgtgtttttagaattccattttgatttatctgtgtgtttttgagagtacctgcttgtattattgttttagtggttgttcttggtattacattatatatatagtcatgcattgcttaatgatggggatgcacattatggttttgtcattgtgtgaacatactaaaatgtacttacacagacctagatggtatagcctactacacatctaggctgtatgctattagagcttattgctcctaagccacaaacctgtacgctgttactgtattgaatactgtaggtacttgtaacacattggtaaatatttgtgtatctaaacatatttaaacacagaaaaggcatagtaaacatatggcattgtaattttaaaggaccactgttatatatgcaatccatcattgaccgaaatgttgttatgtggtgcatgactgtatatgtgatttatccccataatttatcactgcagtcaatattttacaaattcaagtgaagtgtggaacccgtacctccctttatagtcctttatccttccccatttataattgtcttaaatatttttcctacatatattgaacaccacattggacagttttataatttttttttcaactatcaaacatagtttagaacactcaagagaagggaagtctgttgtatttaacaatatttttgctcttaccatgttctttcttttgttctgacactccaagttcttcttttaaaaaattatttcttttccactgagaacttccattagctgttcttttgcattggtctgctgtcaacaaatgctcttagttttccctcatcagagattaccttgatttccttttcattcctagaggatatttttgttggatatataattttgagttgacagttcttttctttcaacactcaaaaaatgatgtgccacttccttctggcctccatggtttctgaggagaaattcactgtcgttcaaattacttttccccatcctttttctctggctgctttcaaaatgttttgtctttagttttcagaagtttgactttgatttgtttaggtctagattttgactggtttatcctgtttgggatttactcagcttcttgaatctgtagctttgtctttttccatatttgggaaattttcagtcattatttcttcaagtccttttttagctctatcttctttctcctctcctcctggaactccaatgacagaaatatctgatttttttgtggtttagttccacaggtcttgaaggctctgtcctttatttcagcctgtttgcgtggctcagattgtatgttcaagttcactaattctttcctccgtcctctctattctgccgttgaacatatcatttagttttttaaattatggttattataattttcagttctactttccatttggtacttctttatatcttctgtttatttttgagactctttattttttacattcgtttaagtatatccataattgctcattgactgccagttaactttttatttttgaaatccttattacatgaatctaatgtctgtcatctcattgctagtgtctattgattgtcttttgcatttaagattttcctggttcttggtgtgctgagtgattttcgatgaaatcaggacactgggagtgttatgttgtgattctctggtctcattacattctcttttagcttgattctcttcctttgatgtgctccaaaaacaggaagggtggggcactacctctttactaccaggtgaggataaaaactccaggtttcctgcttgtcttccattgaaacagagtgggctgggcgcagtggctcgtgcctgtaatctcagcactttgggaggccaaggcaggtggatcacttgagcccaggagtttgagaccagcctggccaaaatggcaaaaccctgtctctacaaaaaaatgcaaaaactagccaggcgtggtggtgtgcgcctgtagtcccagctgaggtgggatgattgcttgagcccaggaagttgaggctgcagtgagctgtgttcaccccactgcactccagcctggaatgtagaatgagacactgtctaaaaaaaaagaaagaaactgagaatgggaagagctcctcttactactggtcatgatgactctctactgggggccactgataccaccctggctgggaagaggctgacccactgacactgcaaagagtcagtagatggccttattacctgtgagagatagtgtaagtcctgactttctagtaggcttcatctgacaccaccccagcaaaaaagtagaggtgaaaaggggtagggatgactgaattggtggatggggtgggagttcaggctcccacatggtctctagggatgccttggtggtggttgggcaggggtggggggtgccttcatttctccccagtgaggatgcaagtcctccccagtcctccccagttggtcttttctgacaccaccccatagagggagttggggtgcatcaatatagccctcacaagggtataggtgttttctatctttctgcttgctaggctgcccctttcctggtcctttgactcaagagagtaggcttttatgtttttttgttgttggtggtgatatttcctggttactagcttctctataatccagtctgggatatatgaggtaaaaagaactcaaggaaaactcattaccatgttgtgctttgtgtcctgtggtacctttgcacttttcaatgtctaatgtttgtttatatatagtatccaaaatttttagttatacttagaggaaggaatagggaaaaatgtgtatcatttcagaagcaaaagtgtctgaagtatatatctttaaaaggataaaatgtgataagatttttgttgttgcctttttttgaacataacagtcttcttgggtgaagaattgtttaggtagagaaaggaagttgctttctaggaactgaaccagtgtgagatacagctggatgaacaagggtcagatcctggtcagaattttatatttgaccgtgtgtcctaaagactacatcttgtgtagggtaataggatgatgatacttgatgtccagattgtaccctagaccaggggtccccaactcccaggccgtggactggtaccgttctgtggcctgttaggaactgggccacacagcaggaggtgagtggctgcgagcattaccgcctgagctccgcctcctgtcaaatcagcagcagcattagattctcataggagcccaaactctattgagaactgcacatgtgagggatctaggttgcagcactccttatatccttatgagaatctaactaatgcctgatgatttgaggtagaacagttttatccccaaaccgtccctccactgccccccaccaacctcccatctgtggawgttgtcttccaccaaagcaagtccctggtgccaaaatggttgggaaccactgccctagaccatctgatcgtatactcagagggcaagatgcaggcatcaggcatcaggttttttgtttgtttgtttgttttttagacagggcctcgctctgtcacccaagctgaagtgcactggtacagtcatggctcactgcggccttgaactcctgggctcaaacaatcctgccttagcttcccgagtagctgggactacaggctcacgccaccatgcctggccaatttttttttttttttttttggtagagacagggactcacatggtgcccaggctggtcttgaacccctggcctcaagcaatcctcctgcctcagcctcccaaagcactgggattataggtgtgagccactgcccccagccaagtattttttaaagttatctagatgatcccagtgtatagccaaaattgagaatcactagcataggatattggctttgacacttacctgattgtaaaatcacttgggatgtatatccatttgagttctccaggaagtaagtatcaagatggaactaaaagtgcaagagatttattggggaaaatgcctgagaaggataaagaggctgcaatgctagttttttatacttgtgaaaggataaagaaagatggggtggaaagagctccagactgcagtgcatttctgaaaaaatctcagctagtctgatggggagccccagaccaaagaggatccatgttgtgcataattgtcccaactcaagtggcactgcctgtttagtctttacccggggagaatgcggcctcaacaggagtggacagtgcagtggatcctgaaggtgaggtagcagagactgccaggtagcagctcatgaagggagagctaaacagcaccttttatgcttgttttataaaccagattccaaggcttcctgtgaaatttctgataaattatgcctgaggcagagacccagaactgtactttaacaagtacttttaggtgattcttatgatcactcaggtttgtaaagtaccagagacaattgctgagactattagggacaaagaaaggaatgttcacattttggactcccttggtgtagtggttgtatagatggattttcagttaaagtagttgaaatataatagctaaaggagcagtagcctaactagtaattttaagaagaaacatgaagaaattgactttctgttcttttcattcttaaaatgcaaagtgcccattctattgctttcactgtatgtgtaactataaaggtttaaaactaaagcaagaatgtgtggtgtaagatatttatttgtacaggattcattgtaaaccaaacactaaatcattataactaagagtccaatgctgacacatggtcgtacactattatacaaaaccttctttggggtgcttttttagggacattattacctgtgaggttgaaaagcaatttctacagattttgaatttgttgcctatttggtgatacactatggaggatttacaatttttttttattttattttaattttttttagagacagcatcttgttctatcacctaggctggagtacagtggcgtgaccatagctcactgcagcttcagacccttgggctcaagggatcctcccacctcagcctcttgtgtagctgggacgacaggcatgcaccactacactcggctaatttattttattttattttttttagtggcaactgggtctctatatgttgcccaggctagtctcaaactcctggcttcaagcgatcctcttgcctcagcctcccaaaatgctgggattataggcatgagccaccacacctgccctatttgcatgtacataatgagatgtcttggggacaggacccgagtctaaacaggaaattcatttatgtctcatacatgccttatacacatagcctcaaagtaattttatacagtacttttagtatttttgtgcatgaaacaaagttttgactgctttgactgtgacctatcacatgtcaggtatggaatttttcccttatggcatcatgtcagtgcttaaaacatttcagattttgccacatttcagacttcagatttttggatcaggaatgcttaactaaattctgaatgcataactttcactatgctaagtgctttatgtgtatcattgatcaataaccgtatgagatggatattattgccaggaaacagaagcctgaagaagttaagcaacgtgttcactaagagcacagaactagtaagtggcacctttaaataatcaggcatcaaatctaatgatcctagtcatcatctctatgaaagtagatctaggtatttattgatatatgaatgtcatgcattgcgctattgatgaggattcattcaaaaatgaattgttattgctgtacctttcaaagagtttacattatctaaagagagtgggagggacctcagttatgaaaacacatccttgcaatgcaatgtgataatttcttgataaaacaattagtttattttgtacatttttgtgttatgaaaaaataatttcattttaaaccacagatttgagagggaagatctgatctcctagaattagagttggtayagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcagtaagtacttggccattttattcctttggctttgatttgtgaactatatccaagactcattggagtaatagttaactgattgcagtggatttcgaggtgtggcaactagtggcaatgctcatgcgacagtgatggtggttttcatgacatatgtaactttatccttttttttttctttcatctcttcccttctttcatttttttttctttttctactctccacgtttttttctgtctcatagctgttttatatttattggtgacaccttgggcacgtcttaaacacaaactgatgctgactccagtgagatttccaactgctattttctttggaatgaaagttatattatgggctcgtttttattagaatgtctgttctctttttgaaactaggcaagactgtatggaagttagagaattaatagtttgctttactctaaagaaataagataaaacagatttgggaggacaaaatttgcctatgaaaaggaaatcctgctttaggaaattcatttggattctaaagcacatcagagtaatattttttgtcattagtcctgagaacttctaagtatattttaaattgtagcagacaaactaaaatgtgttacccaaatacattttagtttgtatttcaaattgtaatttaaaatattacaaacctggttactggcccaactttaacatcaaagataattttatcattttaaagattaatttctagtctgtattctattactttctttttaaaagtatttccatatttgcttcctctcttagaacatattttaagagcaagcatgttaagtcttgatgatgtttgctttttatacttattacctgaaaccaaataaatatttcagtatgcagtcaatccttattgtttataggttctgcatatgcaaattcacccacttggtaatatttatttgtaaccccagaatcagtatttgtagtacatttgtggtcatttgtggacatatatagagcagcaaaaaatttaagttgcccatcatgcacttcccagctgaggtcatcaaacaagtctgctttcttgtttcagtacctcatacagtaaacacatgtcctttttgtgttctgtttaatgccacattttttacattttgtgctttttcttggtgattttgctgtttaagaaggctcctaagtgtagtgctgcagtgctgtctagcattcctaagtataggaaggctatgatgtgccttacagaaaaaataaatatgttagataagctttgttcaggcacgagttatagtgctgttggtcgtgaattcagtgttaatgaattaacaatatatatcaatcagtaaggtgtctttaaacagaaacacataaaacaaggttatgtactgatcagttgatgaaaatgtaaccaggggttctcaaaaacctaaccctatgtttcccttaggagcagtggttcagtatttgctaattcagtgttcacattgacattatagaacgtaactactgtgaataatgagaattgactatatgacaaaatagagtaaattttaagtttaagggcaaccagtgagccagggaggtaaatcgctttttttttttttttttttttttgagacagagtctcactctgtctcccaggctggactgcagtggtgctccacctcccaggctcaagcgattctcccatctcagcctcctgggtagctgggactacaggcatgcaccaccacacacagctaatttttctatttttggtagagacagggtttcgccatgttggccaggctggtactgaactcctggcctcaagtgatccgcccactttggcctcacagattgctgggattacaggcgtgagccaccgtgactggcggtaaattgcttttttgcattcttatcctcattttatcacaaaagcaccagaacccattagaaagatgtcgggaaaggagaacaggcactgacctaaggaaattccccttcccaaaacgttaatcttagaccaccactacgctgtgactgtgtcaaagaaaaaaacatggcagataaatccaaatcatgtgggaagctgtagctttaggggaatgtttttcactctttcactgttgataatgatatcaacatccgaaagtactcagtttttcagggtgaaactgacagtgtacatgtggtctctgactcaggaaggtttgacttacagtttttcaactttagcatgggttttttgagacatagccccatcgtaagttgaggagcataaggatttataatagttcagcttatgagttttttgaatttacagtggtttaatggggtgttaaatgcatttttgactcctaattttcagcttacaatgggcttaccaggatgtaacccccagtaggtttattgggacaacccatcataagtcaaggagcatttgtagttttaatatctttggatttgaaaatgaaaaatatacacaaagctatattaccaaaaacattttcctttacatatgaaataaattcatctcttgttttagagttaatgatgaagatgtcagactaatgttatgggacactgcaggtcaggaggaatttgatgcaattacaaaggcctactatcgaggtaaaacacaggatttatttatttattttgtttgggcatattattttggctaaataaataattttgctttctttgtttcccgtataagggcttctcttgaagaatagttaaaataatttcaaagtattttttaaaaccccagttcattattcttctaaagatcttgtatagtagcaaataatacctggtactgtagacagtttgtctctgccttagaattatatgactcatgtaggcattcccagaccaaatcattaagaaactcttaagtgcctactttgaccccaagaaaatgactgtatagtcagagagtggaagctaacatacgaaaaagtaaagccctggcaaataagatggcatttgttacgacacatgaagtcacatggtaaagccttttcactgctgtaggagttcagagaagtatgagatacctgtgaaaggaaggaaccatgactaaagaatttaaagctctaaaatgtgggctaaaatttcttaaaaggctaaattaaacttccaaatggaacttaaaagtttcctttaacattttcttataaaattttgcccttttcttttggaatttaaaacaccattttcagtgttcctgtaactcaactgccaatagtgattaaagtgagagaacacagtaacaaaagcttggtggaataccatgtggcattatagcctgttgatgccaagtaaatattaattgatcattcatattgacaggtatttaatactctgcatttcgcagatgctgtgggaaataaaaaggcacaactgatatactgattatcccttctatgatgtccctcttttctgaacttttcaccgtgttgtaattaaaacttgttttctaaagacacaacttcctctgctgccttctctaagggaggctttttacccatatccctgcatactcacattcctcaagacttaaaggctgttcggcagaggttgtcttgtttctcactgctgcttccacaccattcctcctcttttctccttccaaaacctcggcaccttgaaagtccaggtcatgagacttttacccaccactaatccccctgcttgctctggtccatcaacttcctttatgcctcctttctgataacagtggcatctgactcagtttcttctccataattgtttggattactttttgaaaattcagcctgttgctcatttccttgttgttttcaaggccaacaattgtttcattaccccaaaatctaaacctctatagtctcctactccctgaccactactggtggcttgtggcttgctaactttaatatccagacgctgtcttgaaaccatcgagagcttctctgttcattgaccctaccactttttaaatatgaccttccacatggctttacttctttccttcttcagcttagtttttctagtcctgtaagcatttgcttgcaaggacctttaactcccagacctgcgctctctgcataatacttgctcagcaaaatgcccaacccagttaaacccgactatctaccaatctgcatccgagcacctgaaccatatagagaatatcagacaaccattcagactgaactttgaagctaacatcacataaccttaatgagtacatagtgctgccaggcactctcagtgttttttactcaagtctctgtcattttccaaaagagctcttttgtgttttctcttgccttaactttgggaatcccttcctcctctccactctgctgatttctttgcttcactcttctttgagaaaatagtcagtgaaaaccattttatccttcccactaccaaatcactttcgtggttaaaactcttcagcatcatatacacaggactttacaactgtgtttcccctcgtctgtccagcatcatctgctgattcctcacttgtacttcacccttgagaaatcccccatttttttcttttctttttacactatgcctggaatgctttcttgtctctcttgaccttttgccttcaggtttaacatctcagaagtctctgtgaaactttctgtggccctcatccctgaacagttaataattttttttagctaattcagtatgtttattgcatttatcactctatgtagcatttgcatatttattttccctaagagattatgagttactttagcttctggcttatggagtggcagggttttttgtctttgtctccccagccccattgcgtagcacctgttggctcaagtgaattcagttgaccttaggagacagtatcattttggttaatttttttataaagtgaaattctgctcgttcatcacacagtctcattttacttatcagatgctataactttatactctgaccttaagtaatggatgaaattttatttttatatatatatacacacacacatacatacacacacacatatatacacacacttaatatatgtgtatgtatgtaatatgtatatatgtaattaatatagtgtgtatatatgtgtgtatataaagtatatatgtatagatgtgtatatatacacacagtgtatatatatttataaatgcaaatatatgtatatgtatatatacacatatttataaacagatgtatatatacacatatacatatatgtatgtatctatgtaaacatgtctgtacatatgtacacatatgtatgtgtatgtgtatatacacatatatctatatttataaatataaatgatttcacttaaaggtatttgctctctgaactagaagccccaggaaagtaggatctaccttgtttatagttgcccccatgactgtttctctagatttgaagttttattcagaaaatgtgtattaagtgtctctgttgttctagggatataataggcatagtaaaccttgccctggcttctttgtcttaacttgtatttatattcatgtaataacattgcttagaaatatatctgaaaagtttcctttaagctaattatcttttttacttcttaaatcttttgttttctgcttttaaatctactctttggtatcataaaaattaaaatatattctatcttagtatgtagaatgctagtagttgaatactaaacagtcccaaacaacagatgatatggaagcagttatgaattattttttcaaagtctctttaaacatcctgtattgaaagatacaggtttaatgaaactgaaataatagttatgtatacaatggaaattcttctgacttcttcatggaagtcttctttaatgtgtcactttacccaatttgaaagggaacctatgtttgtgtgtcctggattatcagagaagcagtacttgaaaatagaatagatatattgaatagcagtataccagtatgtgtctcttgaagaaatctatatatatgaaagttccaagtgacagtgttaatgaacttttaggtacagtatcatataaacacataatttcttcttttagacaggatttaccactgattttattgaagtagcttgcttatttacaaacttayaccagttatataaaatcgatatacttgagaaattgggtgaattcatgtaacttttgaatatatagcttatttttttcgcttttgaaaatgtaggatttattgtaataatgacaactaaggtttcatgattgtactaacatacaaatgaccaaagaagttgcctttctaaattggtaccaaggaaacttgacttccactgcctgctctaaaacatattttggtttcttgccaccactacttaccactctatttactgtgtactttaaggcttcccgtccacagtagctttggttattctctgtggctaccagtttggatcctgagcacctgtatcatggtctaaggttgagaattatgtttttactaccccaagccgttcttggagtagatggtattttttttctacccctctgtcattcaagtagatgatatttgtatcaaattatgaatttcatcagccttgacagtattgattaacaggtcctaaatgtacagttttattcttgagtaaaagttatttgtattttttaatggggttattaccactaccttccccacacactcaggaaaaaaataaacataaaacctatgtggaaacaccagaaagaagtaggattacttgagattttcattattttatttttatctagtgaacttggtcttctaaattctctgcatgaaatgtctgttcttttttttgaggaaacagataggctggcctaatcctttctaagcttttgacagtttgatgtggcagttattactttttaaccaatagggttatttttagagaatatatttgacattatgtttctataatttaaaaaggcaaaactggttgggcacagtggctcacgcctgtaatcccagcactttgggaggctgcggccggcaggtcacctgaggtcaggagttcgagaccagcctggccaatatggtgaaaccacgtctctactaaaaatacaaaaattagccaggtgtggtggcgcacacctgtaatctcagtactggggaggctgaggcatgagaatagcttgaacccaggaggcagaggctgcagtgagccgagatcatgccactgtactccagcctgggtgacagagcaagactctgtctcaaaaaaaaaaaaaaaaaaaaaaaacagcctatcttagtaatttaactttttagctgactgtattaaaatggcaaagagggtgagatactgagataggtcctcagtttcagcgtcttctttttctaaatggtaaaagtaaacatttatcacaatacaatatgaattaaagaaaaaacagcaattatacataaaattgaaaaacagtatattgaacattattttatgttttccctttgggaaacctctttggggttccattagaatgcttttggttgctgccaaataaaaggaatttcgtactgtcttaaaactacagagacttactgatttgatagaaaagtctggaaatagcatcccttttagttgtttgttcagcctataaccttactgattctcctggctttgtctcttccctgtgtggtaccggtacctcctcatgttgatttccttttgggttgcaagattatcaccaggagcaatgacagccacatgctttgtttacatccttggggagagagggttacttcccacagcagtggttcagatgtcctgagcttttctctgattagaccacccttgacctgattgcaataatgagaggaatgtgattaattgacttggatcacattgtgctccttgccaccaccacaactcccacctccagcagagaataggtttagtctacctaaaccatatggctactatacagtgggggaaaggtgtttttagggagagatgccacctaggcaatcagacaatatctgctgctagtacagatttagatagtgatgaaattaaatagaaataaaagtaagaagagaaggtaagggctagaaagaatgaattaagatacaaatgtagtggtagaaacactatgccatatatagttatgacttgctgatttaaatcctagaaatgtgttattaatgatgcataaaaatcaacaaattaaaattttaaaaagaacaattttattataattcatttaaaagacccattatatcaaagccattgctcaaaggtattattatggacttggaatgctggcttaattgtatagtgagagatgttgaaacaagaccttcttgtaaataggttacaacagagcacagattaggaagcctctgggatcccaagtgatttctctaaagctttttagaaagttgactccaggcagtaggaaccagtgattttagttagtacagaaagatacagacgacatgaaatagatttttgttacagttttttactgtgactttggtttgtaggagaggaaaaatatctttttccttctactctttttggtccttgattgggtctctaacaaaagacagattaacaagagaaaaacttatgaatttatttaatataagttttatgtgacaaagaaaccttcataaggaaatgaaaacccaaataaacagttaaacctgaacgtttttataccaggtttgaggaagagtgcaaagttgttgaagaatgtgataggacaaatatgagctaagagcagtaaactggaggaaacttagcaagattcatcagcagaggttcattcagattccttttggtatccttctctcttcagaaatgaggattctcctttcctctgggtatatggaggtcacctctcacctgaggggcttatgacctccttcaggtgagggtcagaaaatccttcctttgggaggccaagatgggcggatcacctgaggtcaggagttcaagaccagcctggccaacatggcaaaaccccatctctgctaaaagtatagaaaaattagttgggcatggtggtgggcgcctgtaatctcagctactcaggctgaggcaggagaattgcttgaatccgggaggcagaggctgccgtgagccaagatcatgccactgcactccagcctgggcgacagagcaagactccatctcaaaaaaaaaaaaaaaragagagagaaaatccttcctgaattttaggatctgcttcagaggagaaggggctaggggagatcaaagtgactctcctgcttctgctgttttctcagattccttcagcttaaaatattcagtacgtcaaggtgccatattttagtttagcatgtccagagccccattactggtatctcttagatgtggttcatctctgcccctatgaaattcatgtgcattctttgccctgccattgggagaggcacagttccttcccaatatagctctctgctttttgtctgctggttttgatttttcactctcactctcacccattgcatttttctcaggcttgaatcaaggcatcactagtccctaatgtccgccagttgctggaaatacgtaacagcttcctaaattggtcttgtcagcatccattctttaaggtttgagatgaagcaggtggtgatagcaccctcatccatcctactgcacctttttgcaggagaaagggtttggagtacagtacttcctctaaaaaaattcttttttttttttttttttttttgagacagagtctcactctgtcacccaagctggagtgcgatggcatggtctcagctcattgcaacctcctcctccagggttcaagtgattctcctgcctcagcctcccaagtagctgggactacaggtgcccaccaccacacccagctaatttttgtatttttagtagagacaaggtttcactatgttggccaggcttgttttgaactcctgacctygtgatccgcccacctcagcctcccaaagtgctgggattacaggcatgagccaccgcacccggccaagacattctttacagatccttttcctttccaacccccatctcatattaaaaaaaaaaaaaaaaattcttgaagtgcttgagggagttcagagttgtgcagcaggatcagccatttgctttctaaattctgcaaataatgatctgtctcataaatcttggaatcttgtatttgttacatgctttattggtacctcagtcaaagtttttttttaaaaaagggtggagggtaaggggtcatcttttgagctttttaaactaaatattagaaagggctttccggtcattaggatttttccaaacataaaagaaccatgatgaatcacagtttgacaaagtattttatctgtctagatggaagatgatattcagttaggggaaatggaaacaagtggttgtccaacatttgtcagaattattataaccataaaagtaatccataaaaagtaatccagttgattttttttccattttagtaatatttttaggttaaatcagacaaggtggtgcagcatttgatataaaggcttggtatcaggtgaaccgtcctgctttggagatttgtgtaccattctttctatagattgtaatttatcttcttaggacttatttttgcgatcttatttcagattttttatttcctgcagttcttgttttttcattttgttctttatactgcagaaatccatttttctcctgtggtttaatagtcatacattctcttattcttaaggtgattgcctttaacttaaggcatttactgtcttagtttaagcctctgtgtgccttcccactgcgccacatgggtggggctcgtttatttgggacatgatcccaggaagtagagtgaaagactagggagaatgaggcaaggaagggagaaaaaccagtaaagcgttctaagtatcactgtgggccactggggctcagtctccctgaggaaccatgaagagaggcctcaggagcccaccaaagggaggctgaggtgttcattccacccccccgccacccagaggcatcacttcccccttgggggatgcatcagaacagcccccagcagaacagcagagccccctgcagcataggcaggagcaactggcacaggaactgttctccacagctgcgctgaagcccggttgaggggacatgcatgcagccacaggcctctgctgcagggtttgtttatttacctccctgattatgtaaacatcttccctttcttcacacaagcactttggcacattcccacatttctctggtctgtacccattctgtcccctgctaaataatcttggggttgttatggacatactttcttttggtctttgattttttaaataatgttgagcttttcttaatcattcttactgcccgtatctctggcattatctgtttggggttttttttccatcatatatgcttcctctaagaggtttttttggttaagtgtctgagaccttgaacacttggaaataccctattgtgccctcaaatttaaatgacagctggacataaagctgtaggcttaaaggtaattcattgagttttatgataaagaacaaattttttttttttttttagacagagtctcacccttttgcccatgctggagtgcggtggcacaatcacagctcactgcagcctcaaccttccaggctcaagcaatcctcccacctcagtcacctgagtagctgggactacaggtgtgtgccaccacgcctggctgatttttgtattttttgtagagatggggttttgccatgttgcccaggctggtcttgcagtggcgcgatctcggctcactgcaagctccacctcccgggttcatgccattctcctgcctcagcctcccaagtagctgggactacaggcacccgccaccacacccagctaattttttgtatttttagtagagacggggtttcaccgtgttagccaggatggtctcgatctcctgacctcatgatccacagtttcttaaaatatgattacataattttttttatttgtagttgaggtaaatattacagctcaagtaaatataagtttatttatcggtatactaatgtgatctcttcagttttattttcccttaaattctgagaaggtctcagggtgtctttgtctctctctttctgtattttgcattattcatttattatttggattaaaacctgtttttaggccaggcacagtcactcacacctgtaatcccagcactttgggaggctgaggcaggcagattgctggagcccaggagtttgagaccagcctgggcaacattgggagacccatctctacaaaacaaacaaacaaaaacaaaacaaaacaaaacaaaaaaacaaagaattagctgtgcatgatggcaggctcctcctgtaagtcccagttactcaggaggctgaggtgggaggattgattgagtccaggaggtcgaggctgcagcgagccatgatcatgccactgcactccagtttgggcaacagagtgagaccttgtctcaagaaaaccagaaaacaaaaaacctgtttttagggtagggaagattttccaaatgaaccttctgtttttacagtaatagcaaactgctgttttctttctgtggtcttttgctttctacagtattcccccagtgatatatagatatacagactagttttggctctagagtgtcttagatagcccagacatatcttgagtcttagtagaaaactcttataccagagggatgtgtaaggaaggagtaatggtaagaaaacatgccttgatttcaggaaatcctcttgacccccaggatgattttctcttgttgcttacatgcctgcttttatcaccatgctacctgaatcaatagctaataatttataaaactgcttcttctaagaggtttctgcttattttagtctttgatattatcagcctaaaatgacagttgatggttaaaatattgtcaatggatacaatatgggtgggtaaaattatgcagttaaacagggtaaaactaagtttcccccaacccctctattatatatatatatactcttggcattggctttcaaattatgttccttaggatcactggtattctactgaaataaaataatacaatttatttaaaaagtgaatagaatgaacaaattatgatttttttctcataaatttttcttaaatctgcgctgaaagaaattaagcaaatgacatttttcttaaatctacgctgaaagaaattaagaagcaaattaacaagaagaatttggcaacagcctgtaattttagtttaccattctctctagcttttataatggaattaaatcagtattttatggtattccaaaaagaatgtgtatgsttttgaggtactttgacagttgaacacatttgagaaccactgtttttggtaaaaatgaaaatagaatttatatgttgaaaagtaaagaagagtagtgcaaagatgaattcaacataaatagagtttatatgttgaaaagtaaagaagagtagtacaaagatgagttcaacatttatttacataaaagttgttttgaatggataaaagttgcccccattcttcatgagattgttttcttaatgtaaatgtaatatgttaatgtaaataccttgattgattgattgattgattgtgaacttacaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaagtaagatggctacttttggggaaggagggacagtaattctataaagttaagacatcttaatttttgcatagttttacaggttctaggaaaaattctatactttcattttgaaggctttaatgacttaaatattttaatttacctaaaatttctgtgagctattctatgtgattggtttgggttaaaaaattcattgattcctaagtagataaaattaaaggattaaaatttgaaggctcttttagaattctaatctcaggtctttgcacaagaaatctaattcttcatgttaagtcaaaccttaatatggtaagaatgttaagaaaagcatccctagattttgtaatacccagaataagtaactatcctatgttgatgaattttaattaagggttcagattcatattgttttgtatattcagaactcttatgctcaaatttgtgaacagataatttctgttcataaatatttacttattgtattattatttttgccagttttgaaaatatttgcttggtttttacctgttttttaagtcttcttatgttagttatctgttgctatgtaacaaattagcccaaaacttagtgtcttaaaacaacaaacatctattatatcmcagtttctgtagatcaggagtttgagaatggcttagctggtggtttttcatgaagctgcagttgagatgttggctaggcctgttctcacggaaaggctacactggtgctggaccatccatttctatgatggcttattcacttggcaggaagccttagttccttgtcagatgggcctctcctattctcacaacacggcagctatttctcccagagtgggtgatccaagaaagagcaagacagaagccacagtgtttcttatgacccagtcttatactgtcccttgtattgcatattagtggacacccagaccaaccttgattacagtgtgggaggagactacacaaggggctgaagaccagaagccagagaaatagcgggagcctatggggcatggttacaacagtctctaatgacattaatatcaggagtccacaaccaggaatcctgataaaactaaaattaggagtacaatttggagatgtagtcattaatatactgactttggctttaggcagcaaaattgtttcatggccagtaagaataaaataagtaattcactgtaagattttcagagtgtaattaactacaggtgttctcaggaagagataaaattaattaaaatattatacaaagaaaagtgatattttcttagtttagggctagagattaatgactttatagaaaagtcttctatgtacacatacggtataacagttggtgtttatttctcaagagtagtgaaaactaaaatcagtacaggcactaaatgaaaacatagctttcaactgattttacttaactgggaaattatatcaagctcttttaaaaagaaatatgaaaattttctgaaagatctgatccaccttccctcccttccctgccaaactgtattcagtaaatgtaattaaaagtgatttaaaaaacaagctatcagaaggcacctttgtaaagcatttttttttaaattgatgtgcagtgaggaagctgaggcactggcaaaaaggttaaagttaagattctacagaacatcagtgaaagaagatctaaatgtgaatgaaggtaarttacctttaaaggatatagattgcaaaaagaaattttattcttgcgcttttaaaattgtgttgtttagaaattatatttataacgagaacaagatttttttgtcacctaacattaagtagaatttaaaggctttctacttctttttgttagtgcttaattatttactaatgcccttgaatacttttcatcctcgtaaggttttccatttttattattatctttgaaaaatktaagctatatatgtagagtatatgcatatgtggttttgatgcatacctgttaaaaataactcagttgttttagaactccatgatagtagatattccactaggtagttagtttatttaatagtatttaatttaatactttaatttaatagtatttcctagtttaagaaagtgaaattagaaaaagatggtaagttatttttctcattctggaattgccacttatttagattgcaactagatattctcttggatgtctattttggatacttttcttcacataaaggagacatcttttcaagagtgagtctgtttagtgttgcttagtattaatcactattcagatacttagaagagccaatcattacaagtattatttcacttatttactaataaaataccattatacatttgttaatattatcattgtactcagatactgcccaaataatttttaaaagttgaatttttaactagattgtatgctcctaattgtaactttaaatttgtttagtaagtataaatattacaaatgatgtgaaataacagatttacatgcataaatcattgacctggttctgggtgttttctttttattctagtttttaagtatttggctgaaaaataccttcagaaactcaaacaacaaatagctgaggatccagaactaacgcattcaagtagtaacaagattggtaagtacataggaaattttagcccatrtttacttggtaaagttaaaaaacacatataatatgctcatttctttcagaaatgtgatttaaaagtgattattaaactattaagtcagtgatttaagtatcaggtctcttgttaaaaggtatattgtgttaatgggggtttttttgccattgaattttataaatccatttgatagattaaacacaacagagataaagactttttgtaaagatctgtcctttatataaaggaactttataacagttattcttctgaatctgtacttacactggctcttaccttttccctttcttactatcttgcttattacccattactgattttgctttttcttatgttaaatgccagcaaaactttagcattctctgaagaacaagtgtgttgtgttctctttcacaataactgcctgaccagatgtctctcttcttgttctggattccaggaaaatgagagccaaagttgctggttctaaatcttgatacttgtataatctcttaaggacttcatatctgtattctgtcccccttcactacatatgtagaaacaaacacattattttctggacctgttttaacttagatttttcctggattctggcttttttttttttctgcctttgccattttcattgcaaaatttcttgccatcagagacctcaaatgctttgtgaacacaagacacttataataagcctctacctggtgtgatctccttggctccccttttgtcttcttcatatctactgattaaagctttaataagactcattgtggaacaaagtaaatgcagattctcttcaatccaacatttaaaggtggttttgcccttccttctgtgtagcctcctgccacaccattacatctatgtaacccatttactggttctctcagaggtcttgatctttcctgagtatgccccatgcttgctttcttcttcacttttggtcattttttttcttctattgagaatgacctctttcccatcttctgtcgaagaacaattcattcctcaaggcctttctagaaagttttcagttgtgtatctgcctgcctgaagacacatcctccatactctttttctttcttttttaaagaaacagagtctcactgtgttgtccaggctggtcttgaactcctgggctcaagtgatcctcctgtctcggcttcccaaagggttgggattataggtgtgagccactgcccagcctccatcttctaaaagaatagacatctaagcccagggcactgccaagtgtccagttctaccttcttcatgtagtttttcctttcttatgtatcagatgcaatctgtccttcctttgaaacttctgtaagattttgtgtctcttttatgacacttaacatataatgtcatatggcattacttgtttactgtcttgtcttattacattgtaaacttcttgtgggcnagaactggtcttagtcacctttgtatccctgacagtatctctggcccagaattttgtgtgtcatggatgctatatcataaattggagattacattttgtgaatagcacagttcaaaatggaaactataaagttctttatcttttagctactcatcacttttatctgtgggccacttttttactggtttagtataagtaggaaaaacgtatcttactagtattaacacagaatctcacaaatagctgggtgtggttgcttgtgcctataatcccagctatttgggaggttgaagcaggaggattgcttgaggccgacagtttgagaccaacttagacaacatagcaatatcctgtctcttaaaaaaaaaaagaaaaattagctgatggcattcctgtgcctgtagtcccagttactcaggaggctgaggcaggactgctggagcccaggagttaaaggctgcaatgagctatgattgcaccactgcactccagcctggtgacagagcaagaccctatctcttaaaacacacacacacacacaactcagaaatactgttgttactgttgttaactaaaaggtattcttgaggaagtgatatgatgtgaagttagtaagttattaaaattatcgtagttgccaggtgtggtggctcatgcctgtaatcctagcacacctctaatcccaggcaggtggattgcctgagcttaggactttgagaccagcctgggtaacacggtgaaagcccgtctctactaaaatatgaaaaattagccgggcgtggcggcaggcggctgtagtcccagctactcgggaggctgaggcaggagaatcaattgactccaagaggcggaagttgcggtgagccaaaatcacacaactgcactccagcctggcgacagagcgagactccgtcttcaaaaaataaataaataaaaattatcgtatttgctgattccaaacgtcaaagataaattgttaagtcaaaagatgcagaacattgtgtagaatatgccacaacttaggtagaaaagagaatatatatgcattttagcttatatatgcataaactatatctggaaggataagtaggaaaagtaataacatgcgtaccttaggggtgggaaaactggcaaggggtgaaaatctgggtaaaaaagagccctaatgtgacctcttttacagccttggaactttgtaccatgcgtattagctactaaaagtaaaactaaaacaagagctttaaaatcataaatctgtgtccattgatgtatgaaaggataagcaaaatgtggtatatacatacaatggaatattattcacccttaaaaaggaaggaaatgcttcagtgttctacgttggatgaaccttgaagacattatgctaaatgaaataagtcagtcccaaaaagacactattattccatttatataaggtagagtagttaaaatcataagagacagaagatagaatggtggttgctaaggtctgcagggagggggaatggggagttagttactgtttaatgggtatgagtttcagttttaaagatgaaaagagttatggagatggacgggggtgattgttccacaacattacaaatgtatttaataccactgaaccgtatgcctaaaaatggttaagatgctaaattttgttggattttactacaattttagagaaactgtaaatacttgaaaatattactgattttactaacaagctggatgcaacaggtaactcaggcgtgtcagtggcaatcactcttttccctcaatttatacaggtgtctttaatacatctggtggaagtcactccggtcagaattcargtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcamtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattsaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcrcttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatggaaaaataaaaaaaattaaaaagtaaatttttgcttttcattatattgaaatgayctggcattatctatttcacagtaatgtaaaatgcttatttttatgtcaccagttgtcaccactcccattgctgatagtgacataggttttgggggcaaaattcagttcctaacaaacagtggatactgctaatgagtcatcttttctactctcttcaattttctactctctactctcctctttaatttttgcacaaaataatactttgcaacaaatagtcttttgtctttattggcagaaaaatcacttgttatatgtgttctagttagttctttttcatgttagctgtgtggctaaaagcgtgttacctttctatatttaaaaaaagtaatctctgaggatagttacagttcctgtaatataattttatgtacctagttttatctttttttaaataagaactgaagagagagctttgttacatatttgaatttttaatttgcactgctgtattttaaacctaaccataattagtcatttaaaataattaagtaggcctgaaagtcagccatgttaatttctcaatttaatcaattcttaaagccttcaaaaattgacattttttttccaagacccttcattctcttaaataactttaattttatgaaaccatgtatactaaagaaaaacttttccaagattccaggtgattgtgcatttgtgctctaatctacttttttaacattacggctaatcttttgcgtagacatatcgctgtggaataactgccatatttcagagttcctcaggtttccttttccttttccagtctctgtctatgaattaaatagtatatagaatgacccatataaggcaatatagttaaataaaaccaggttaaatgatttcctttgtatctgcccaaagttgatagcacacgttactttttcaaaataaagctaaaactaccaaaaagaggatgaaaactttttcctcattatggagtgaagttctaggtggttgctttagaagttggcagtgcagtgctcagaaggaactctcaataaataacatgtactccttggacctgtgagttttaggaaactggaccttttctgaagaccttagaatagggagttggccttaggacctaatgtcccaacttagtgttggacccttttaatataagatattgttaattattagcatacttttcaaaacctttgaaatagttactgctaacctgataaaatgttcccattaatctatcattagtctgtttctctgaaaacaaaatgcattgatgaggtgaaagcttgttccacatggcacctacctaatgaacaggacttactcagtttttaactgttaagaatgtcacatgtactattgtcactccttaggttttcagctataaaacatgtaagtctctcatcatacagatgaattcatttgctaacaaaatatttaaaacccgcagtagactctgaaatatccagtcatcaaactcctggctaactggatgatttggctataataatctttattattattattttcatctgtctctcgaaatatctacagtaggatgttagtaaatggtcttttaaaagcaaaaaattggggataaaaggaaaactgaattccttctatatttttattactaataaataatgcttttgtaaatttgaatggaaaaccacttgtatgtattgctatttggttgcagttacactctggagcttaatttaaaacactactctaaaaatttcatgaaggatgaattccaataatcagaaaataaatgcatttcaaagctaaaattttgtgtgatatgtatgattgtatcaacagtgtggatctaaatagtaaaatatataatgcaacttctttaaagatcaaagcaacctaaaattatttcatatttcagatactctgccaatatttaatactctcattttattgaaagtagtgctaacaaggaatggcaggagggctaccctaaaattatgtattatatgctaggaatggtagagaattgagatacagcaaaacatactctatatccacttatagtctatataaaagacaatagtttaaatgagggtaaaaatgtgactcaggagattcatcatcatttgaaaataaattatactcccattcttataaataaaaatacatgttaagaaccaacccattggccaagcgtggtggctcatgcctgtaatccctgtactttgggaggccaaggcaggcagatcacaaggtcaggagtttgagaccagcctggccaatatggtgaaaccccatgtctactaaaaatacaaaaatttagccgggcgtggtggtgggcgcctgtagtcccaactactagggaggctgaggcaggagaatcgcttgaacccgggaggtggaggttgcagtgagctgagatcacaccactgcactccagcctgggcaacagagcaagactccatctcagaaaagaaaaaatgaaacctcatgaagtaaatgaaactatagaaactgcctccatagcatatattcaacaccaaacgtctacaaaatgtttgttctcttcccttcacagtctcttttccctaactcatatactccatagtgttccttgctacagtggatatgtcttctacttgtcagacagcctgggtgacagagcaagactccaaaacaaaaaacaaaaaaacaaaaaaccacactggagattccctgccctttagatgtggctctaggtacagaatgctggagacactgtaaaccagggaccccaagcagcttggaaatgtggatcatagctcttcaagtctgtgatcagaaatcaatgacctccattaaaaactccattgcaaaaaaatgggaaaaataatgctaagaataccaaggtcaaggaggcagagccagaataatttgtgtagaaaaagtcctggactgatgtggaagccatgggaagcagggagcagtagtatttcccagagtggaagggatttacggatgctgacaatacttgagaacctgaagaaaacatgactatccatttcttaattttcaaaaagctggtcaagaaaaaaatgatgcacacaaaaaatcatctcacagtctgatgacagcaaatcagtctgctaacaaaccaagtggctctgccatagatagaattaatgtttcccatgaaatgcaaagatttaaataaggcagagttggagctggcaaaggaagtaacatgaatgtcttcagattgtaactgctttttataaagagactaacttggcatttttgtagagaaaatgaagtttgatattgcttgcattgagagatatatacatacataaagtcagtttggatcttgatttggtttttcagtgtgaagaatacctacattcaaataaaaattgatgtgttcatttcaaaatagtatccagggaagttgttgtggtttttgtatatcaataggactagttactttgaacaaataagtgttctctagttgcttcacactttatcagataaaagaagaatcaacacactggtcaacctttttagtaaacaaaatgcaaactaggtattaatgctcagtgctggaaatatttcagtgaaatagctatattttaattactgaaaaaagtataaattgctgtaacctttatacaaaaaaagtttaatatgtgtgaggccatgaaaacgtctatatcctttgacccaatataattcactgctgggcctttatacagagaaaaacaaaaatgaaagaaggaaaaagtcctgtgtacaaaaatatgttgcagtaatagcaacaagttggaaacaacctaaatgtccataaaagaggaatggataaagatataactacacaaaatagagctcattaagttgacaattaagcagactttatatcagcatctaacttttttaaaaaaaggcaagttacaatataggaattttagagaattgatgcatttgagaaaagatgaagcagatagatatataattgttcacagtggtaaattataggtggttttctcacattttatgtcagtttcttgtatatcaaaaaatacattcatattatgagacacaggaatctttacatccaaaataatttgatacagatgccttaacattgctgaatgagacaactttggaaagattcttgttttgtgattcctttttaccctctaagcacagtgctttgttaacactgtgtgtgtagtaaatgtgtgtgctgcttaaggtaaagaatttctagtaaactaaatgcccaaggtgactgcgtgattccatgccagacaggaaaaagcagtcatgctttttgcccctagctgaacgtttgttttccccacaaactatgtattcatccacagaatagtgaaatatgctagatcctagtacaagacaagaattcaatctaaaaaatctctagatagataattaaaatattgctagttttgttattcacaaaactgaagatacttgatggaatattttcctcatctgaaacaactatcagtgtcaactaagtggttatacctaacaaagaactagttatcaattaaaatagtattttatcatttttacaccttgtgtattgtgtaaatgctcttaggtttgaagactaattgaatctgctttcagcattttgttgcagagttttggaaccagctcctttagaatgctctaatagcttgatggccttgtcasagttttcaatatttctaagcagagtctctaatcttctcttaattttcttctgatcttcaagagcacagccaattactatggattgaaacttctgatcaactggcccatgtggcacctcagatgaacatgcactgtagagcgacattaaatgactcttggcatttcccaaatcatccagaaacttattgaccacctcatcaataatccttgtggcatgctttagggattcttgctgctgggggtttctaattgtttctactgacacttcaacggtgagagttcttcccatcaaacggtttgcagtcagatttaattcttctctttctcctaaaaatcaatatgagatgtaaacttatctgtgtcaaaaacattaaggcatttgtttgtgactaaatttattattttctttacctctgccatgaaatttttttagagataaaagctgaaactatagcatgtaagattaactgatgaaatgtattagattacagaaagaggttgtagaataccacttcctgacaatctgcatatatgggataccagatgacttctcaaattggcatgtctgcaaaagtttgggtaggtatgcatttgtaactgggatggagatcaagtcttaacactgtgagcagtaagcacatatagggtttatgctgggtagagctccagagatcagatgtcccagatctctccagaacgacatgtgcatttatcagaatacaatgccccaaattttggttgagaaaatgtagccacgatagaagataagctgtcttctgtcgtcaatactaggcactgacttcatccttctccagatagaagcaggacagtggtctaaagtcttggccagcacgaggagctctatcaacatttcattatttatatgagaaagtcagcaagctcctgcttctgtaacttcctaattcattgatctttgggcaggatagcgtagagactagatcatggcctacctatagatgtgtaacagttttgatctggatttaggttgcttacttacctcaccagccacttggcccagtaccatgtggcctgtgtggcaccaaaggagcccaagtaggaagtccagtgccaataaaagaaaatcagaagtgacctattcctatttcatgttcttcacatgaaaatgacagcacaggttaggcagatgtcacatgcctgtaatcccagcactttgggaggctgaggcaggcggatcacctgaggtcaggagtttgagaccagcttggccaacatggtgaaaccctgtctttactaaaaatataaaaattagccaggcgtggtggcacgtgcctgtaatcccagctactcgggaggctgaggcaggagaatcgcttcaacccaggaggcagaggttgcagtgagccaagatcgcgccattgcactccagcctgggtgacgagtaaaactccatctcaaaaaaagaaaaaagaaaatgacagcacatttttacattcatgccttttattggtcctacaagtttcctcattttctctgcattttgtcccttctctttatgttgtacctcaattcatcttttttttttttttttttttggtctctacttctctgcttccactctctcaccctcttcctctgcttttttaatctcttgcagtccagtaacttgtgaggaactgaagttaggactgtgaacctgggataaaacacatggccttactgcttggggccagcttttctgagcttgcaggctttttcctatctctcctagccaggggcttggggtagagagcatgctggaagaaatctctgagtaagtggctgctgtaatgaactgacagctgcagctgctctctgtggctcacattaaatgctgtggcctggtgtacgcataccaaaagtcaagcaaaaattgacccacacttatcataaactctttaaaggagtgtaaaagatgagccccttctgtggagatggctctcaccgtcactgatctgcctcatgtcctggctattttggatactgtggatcatttccagaaggatttctttctcttgctcaacagcagttgctgcttctctcaargcttcaaccctatagaaattgggaaaacaaaacggttattgtatgcaggatgttcttcctattaattttctttatctctcattcaacccaaatcaagtttaaagatcaccaaacttttcaaaaattcttcatttctgctttaaaattctttcatttttctatacacttgcctttctcccattttcctcccagctcataaggcaatcattctttcgtgtttatctaattaatactatttgttttttacaagatctgtattatttgtatattttgaatttatatctcattctgtttttattttttcacttagcatccaggttgctagatttttgtttgttttttgtttttgagacagtcttgctttgtcacccaggttggagcacagtggcacaatctcaccgcagcctccacctcccgctttcaagtgattctcgtgcctcagcctccaggcccggctaatttctgtagttttagtagagacggggtttcaccatgttggccaggctggtctcaaactcctggggtttcaccatgttggccaggctggtctcaaactgctggcctcaagtgatctgcccaccgcagcctcccaaagtgctgggattacaggtgtgagccaccacacccagccccctatgtgtacttctaatcagttgctgctaattgctgtataatactccatgtgtatacctacctgattttccctctccactctcccagagatggacacttaggttgtctaccagcttctcattactacaaataacacttctatgaatacatctcccctttggaccttggtgaggatttccttaggacatataccaggacagaactgctaagacaaagggtatgtgtactctgcttttgacttagtattatgactattctgcagaacacctgtacctatccactctccacagcaaagcacaggggtccccatatccctaccaacattctgcattttccaactttctatttgctgccagtgtgacagaaatacactgatatgtcagtgttaacttgtgttttcctaataatttcagac

SEQ ID NO: 10578 - DNA, 148386 bp, Homo sapiens
cactgtcttctaaaatttcatgtattcaaggatggagagggtcaaatgaatagttaaaaatacaaattaaggccaggcatggtggctcatgcctgtaatcccagccagcactttgggagtctgaggcaggcggatcacttgagctcaggagtttgacaccagtctgggcaacatgacaaaacactgtctctaccaaaaatacaaaaattaacctggcctggtggcgtgtgcctgtggtcccagctacttgggaggctgaggtgggaggattgctggagcccccgaggcggaggttgcagtgagccgagatcgcacctctgcattccagcctggttgacagagtgagaccccatctaaaaaaaaaaaaaaaaaaatttaaactgattaacttattctattttctaggtacacactaaatctataaaaactaaactaaatcaataaaaataaaccatggccttggcctttagatagctgacaatttaggtttaacaatgtatatggtatttttgaacagcttttgtgtcatagaatgaatatgttttactatgaaatgtatagatactgattatctagaaaagcattgtaaatacttttatttttacaaagaagtagacagtttgatttattattttttagggatccccttccttgagccagggagccagtctggcattaggctaatcttaccactttcatggaggcttcccttactgctatagatctcatgaggtagaagaagtaataagagggactgctattctgagtcctggtctaatggaaaaggactagtttgtaatattggttgtgtgttgatgtggttgtattgaacagtttattgggaaagtcaccaagttgtcttacagacatcattgtaaagaagagaactgaaacatggttatgcccatcctttgcctttaaggaaaacagatatttgcaagattatagcatctatggctgtgatttcaaggctagagagttctaaaagaaaaattattagaagaaattcttataggtgtacaaaatgccctgaacagctcaggtttcttaaaggatgtgcatgattaatagatgaaaggagcacataatcatcacacagttatacagtgctaagactttaagaaataaacatttaagaattttctcttcaaaggccaaaatttaaaaggaactaagatgcctcagagtgcacaaagagcttttaaggttgtgtttggagcaagagcaacaagagggaagagatagctcactgtctgaagaagatattcttaatgtctgtttacaggtaaaaatcagacctatacaattcttactttgcttctataatcttgcaatagcagaaatccttttcctatagtaaaaggtaaaacaaacaacctgaaacagaggaaattaaacaaacaaacaaaaaatatgagaagatggagtatcattcactttaaatgaatttaaattttcaatactgaaatgtattgcctcccaggagttgacggactcaggtataatcgtagggttattgtcacttttttttttttaacaaaatatagttttttgtttgtttgttttgttttgttttttttttacaaaatcactgagaatatggggtaaatacttggagacaagagagagacaaatgtcctagtttccaaaaaggaataaagtatattgcaaaaacccaagaccaattccctactttaaactgtggtaaaatttgaagagattgtaaaaaaatgaaatattgtgtttagaagagaatgggatgatcaccatgaatcaatatgaatttataagaataagacatgccaaaatgacctcattttttttttgctttatttttagttgtataattgctattggattagagaatagtaaagacatgttgtatcttgactttcgccaagtggttgacagtgtttccttaactatccttgtggaaacatgatgaaattagattgtaattagattgatttacagctgcttgcctggccattgccatgcccgcatgcccagcgtttagttaaataatagttactttatatactggttcctcacagagaactggtggtgaacattaatttgcatatattcagaaagtatggatttgtagttaacgagtttttttaaggatttgtatgttgaaacttgagttcctggatttattcatgattgaggtttctgttagggacttttttgcaaccaagctgtatttgtaagatatataaatctgtttttaatttacatatgtaaccttgacttataaattacttagaagccaaggcgtaatattagcatttagagcaaagtctggctatgttaagaatgctaacgttatgaagaatcttttctttgttcagtaacaactatagtaagctcacttggatgtttttcatacccttgaaatgtcattcctgtgaactatccctaaacaaaaggcagatgttcatatacaaattgataatacagatatattcagcagtgtctttctgagttaatgtgtctgttggccttctggtaatcccacagtcagctgcctgttcaagatatttacatattttttaaaaaaatacaaattccctggaatcatatcaaagagagaaccatatattttgttcacttaggaagttcttttggcagtccatgatggctgctacatccaatatattttttaattaattgttacttttagagaatgcaagtccatagttaacttattaaactttcataattgatatttctttgatgcttgtaatattttgtttctagcctcaaaaaagtgtgataacttttttgaatacttgcagatgtttacataaaatatcacatttatttatttgcttatttttgagacagagtcccactctgttgcccaggctgaagtgcagccgcacgatcttgtctcactgcgacctctgcctcccaggttcaagcgattctcctgcctcagcctctggagtatttgggattacaggcacataccaccacaccctgctaatttttgtatttttagtagagatggggtttaatcatgttggctaggctggtctcgatctcctgacctcaagtaatccaactgcctcggcctcccaaagtgctgggattacaggcatgagccaccgcacccagccaaaatatcacacttacaaaattgtccctcacacttttctttacaactgttcgtctcggtgttacatccagaatcccagtagaaatgaacggtgaaaaacagagtgcaattccagccttggcctctgagtcttaagatcttgtaggcccttaaaacaagaattgaggccaggcacagtggctcatgcctgtaatcctagcactttgggaggccgaggtgggcagatcatgaggtcaggagatcgaggccaacctggctaatacggtgaagccccgtctctactaaaaaacacaaaaaattagccaggcatggtggcgggcgcctgtagtcccaactactcgggaggctgaggcaggagaatggcgtgaacccaggaggcggaggttgcagtgagccaagattgtgccactgcactccaacctgggcgacagagtgagactccatctaaaaaaaaaaaaaaaaagcaagaattgagttgtttcaattattttgccttaagagacccattatgctgtaatttatgattttattgtggctttgtccttaattatatctaatttaatggttgttattttatagattaaaatgcaatctgagtttttagcattttatagttatctttgtacgttataccatatctgacagtaaagcttcaaatttaaaaaaaaaaggaaatcgtgagttaataaaacaaagtattgagtcagattgtctttttaaattattcatgtattatcttttatccaaattaagtctttttctgaaaatatgttgtatagcagatatttagatgtcggagcctacattatgttgtttttaagtgggggaaaaaacaatgatgcattctctgtccattcaaaaaccctaaccaaacttccccaaatatcacaaaacacctttagacaactatatagcgatctacgaaaacttttgtataacatttacaaaacatttgagacatctcttacctgattttaaaaatacttaatgaattcattatttggtatatttttgttcaataagtaatgagactatacagtattgattataaattagcattttattctatccggtgatgaatagtatactgtatgattctgtattatacatttaaaaaatgaaataatattatttttatctaaataaggcttgggttagtgggatccctaaatgcttaatagaaacaacctctgggaccagagattcttctgtgttcatcctggtaaatatctttcaggtttattaaaatcacaaaggctcccccttgctcagcatctatttttagcaagacaaaagaaggactttttagggtttgtgtttattagtttaggatctgaatatgtttgctgaacttttgacatacactgatttcctgcttatgttaacaccgtcttgcataggttatgttcatttatacatatgagaagagcaaaagagggagttagaaatgtaatattgtggaataatagttaaaaaaattagctgatcaatagtatttggtttatctaagcttgtcataagtgcgttgctctaaataaaagagtatactttaatcaactgttcttattcaataaaataatctattttgccttagcattgattttttctaattatctgaagccttgtctaatgaacaatggtttggactgtttggagtttcattttaagttcaacccttactataaattcattgctatcagatttctgcaatcctgttttttctgcttaatatttctttgagagcccttatatctctctatttatttcccattttccccacaaataatagaaaatttttgactttcttaattattcacattgtatctaggagtcaagcaagtggacagaaaatgcctgttcaatctagtgataggaagaggaccctaaggtagggccagtttggccttttcgaagatcagaaagatggccaagaataggtggagcagtgtttgacagtgggaagagtgaccaaattaggatcagggatggctggagccagaacatgtagggccttctagtccctgttcgggattttagattttgttgcaagtataagatatctgaggggaccctaaacagagtagtaattatcagatttatgttttaaatctcactctggcttctaagtggtgggcagcaggaaggagacaagaatgatgccgattagaaggctgggacagaattccagatgaggaatcagtggtggcttagattagggtggtggcaaatgaaatgaagaaaagtcaaatatgtcttggaagtagaaccgacaaaagttgctaatgtgttggatctggatgggtagaagtgaaaaggagaaatcaaggatgacttctagatttcgagattgttttgcaagttgatggtgccttctacaatagggaaaatgttggggaggaaacattgggggcagatggaattaaaagttctgttttggctatctgaaacttgaggtgcttatttgacttccaaatatatctgcaatatatatgcatcagtttgatgagtttagagcttggcagaggtagatcaaggatggatacatgatatgaatgtggaagttatcattatatagatagtatttaaagccatgggactaaatgaaattactctgaatatttttgtcaccttctctgacctgtaccttctccctcccttaccatgtaaaattattcccacattatattgcaggtacatattttaattatagtacctataaataatttggtgttcttttctttttagtaaaattctctgatttctttatcctgtttatagctaactggtttaagagtattcagttactagcttctatatttaagtgaacgtctaaaaattatgcatttattttctgttttttttttttgtctttgctccaggcaaagtcattaataaagatttgcggcattacctaagtcttcagtttcaaaaaggatcaattgaccacaaactgcagcaagtgatcagagataatctctacttgagaaccattccatgtaagtatgtgatggaataaaagarctgaagcagaaatgtcctttcttaactaattaaacatctacagatagtttgatggagtatttcacatgaaattgtgaagactaagttgggaacaagaatgaaacaaaaattggataagaagaaaaattttcaaagaacttgagaggttttgtttttaaaagtagaaaaatggaaaaactgggccgggtgcagtggctcacacctataatcccagcactttgggaggccgaggtgggtggacttgaggtcaggagttcaagaccagcctggccaacattgtgaaacctcatctctactaaaaataaaaaaattagccgagtgtggtggcgggcgcctataatcccagctacttgggagactgaggcaggagaatcgcttgaacccaggaagaggaggttgcagtgagccgagatcatgccactgcactccagcctgggtgacagagcgatactctgtctaaaaaaaaaaaaaaggccgggcgcggtggctcacacctgtaatcccagcactttgggaggccgaggcggacggatcactaggtcaggagatcgagaccatcttagctaacacggtgaaaccccgtctctactaaaaatacaaaaaaaaaaaaattagccgggcgcgtcgcaggcgcctgtaatcccagctactcaggaggctgaggcaggagaatagcgtgaacccgggaggcggagcttgcagtgagccgagatagcgccactgcagtccggcctgggtgaaagagcgagattccgtctcaaaaaaaaaaagtagaaagtagaaaaactggaagattctatattgtgagttttaaaaagtgatgactagaatttaagattatataatcccagcactttgggaggctgaggtgggcagatcacctgaggtcaggagtttgagactagcctggccaacatggtgaaaccccatctctactagaaatacaaaaattagccgagcatggtggcaggcgcctgtaatctcagctacttgggaggctgaggcaggagaatcgcttgaacctaggaggcggagattgcagtgagccgagatcatgccgttgcactccagcctgggcaacaagagcaagaccctcaactcaaaaaaaaaaaagaaaaaaacgaaaaaaaatatatatatatttttacatgttgttaactagattttattcctgtaaatcaatttgtaaagccttatgcagtaagaagactttttagctcccagtgccttgcataccaagaacaagtattttattagaactttattttaaaataattttaaaatctttcccttccccaacaagaaaaaaaaaaaagaagaagaagaaaaaggaaagggactctctcttacttggaataatttcttttttccctccctccgtggcttcttcccttcctcccttgactatgtagtggcaaagagctaagtaaaattgagttcaaaatctttactctagcatcttactggctactttacttgggcaagttacttaatgttcctgatcctcagaaactctctatatagaattagaataacaagacttacctcatatagctgttactaggatttaaaatgagagcatatatgtaaactgcttggcctagagaggcactcaagcagtgtttgtccccttcccccattctaactggatctcctccctctcatttcacctcgattcaatcagtttttaaagtgcacatttctcagcactataggaaagggaaaaaaatttaaaaataaagtggacatctgattcttgtccaaartctatagtttatccttcaaagatttctactgacaaagttcagactccttagcatcgcataaaatattttttgtttttttaatctgcctccttatctatgatttcctcctacaaatctaccttgtagctgcagattgtaacttctgcctttatttcaatttgtatttgcctgatgtgtctttgtccatcttgttattcttaaagtctctgaatctctgttttacaaatagttctagactttactcagtagccagtgtgaaacttcttaaatttttattgatgtgatcaatatctttagcctcagttctgtcatggtttttatatttaccatatataagccttttgtatgaaaagcttttcactgtgtagtcattttatttgatctctttttaggaaggtttgtagggatcttttttttaatggttaccttgatacctttatataataatctttgttcctccctccctatttttttgcttctgtctctactatgagtaatattaaaattacttagtcatctcttctttttccttccttctctcccatcatctgacttgaagtaatatctttttattcctacgaaatataaggtaatcagtaartgtatcccacactttgctgtgcttttctcattcttaccctactttttttgatagttgggctgttgttctacattggctaagcaaatagccattacattactgtactttcctcctttataattatcatttatcttttattctgtgggtaaatacatatttaatataaccaccaatccttatgttgttatttttcactaattgtagttgtctaaagctttttctttactcgttttcccagcaaaggctcacaggatcatcttaggagtttgtttgtggcctttatactttgatgtttgtttggatggatataaaatttttgactcattttctttccttgactatcttaaatatattagtcaactatctaactgtttttggcataaagcattgctcttaaagagtttggtagcaatctaattttcattcctttgtaagtaacttgatattttgcctgcatgggatgtctcatttttagtttcatagctctagagcttcctcttcccttgttaaaacaagataataaaaatatgtacttgtactttctaagataggtcttttttttatactgccctctgccactttcacttaagtttttcttttaattttattgttccagttttgcagtttcctcagtgtgaggtttttatcctagaagggagctaaaatttattttgtttcatttcacagggtccaagcagctgtagcccttttagatctcaacaggccctcttaacttacacaaaaattgaagtgtccaaagctccctctaggaacctagacgcaatgacacatcagtagcaggtagcatactgaagggtcacatgtgatctctaaatatcatactttcctaaaaagtttgaggtctccttggagatagttctgattctaggtctggtacaaggaaagtacaagatgagctttggagcatataagtgtatcagaaagtatatagtgcttaaaacattatagagacatatcagaaggacatagaagccacctagaaggggtgcttgatacttactccaaaaatctgaaacaatttgagcaacaacgttgaaaaaagagggcacttctattattgtcagatattgagctgtaggtggarcaggactatgatccttgagagaagaagaaaggagaccacacacagaggaatcctataatttcctcaactttctacttagaggcactttctggaccacagcacaaggagggagagtccaggcagagtacaatggactctgagttgaagggacagaaatctgagttcaagaagcctgaggtatctggaatttgcaggacagaatgtcacagaggagagggctatgaagaaaaagagctcaagcaatctgtaaaggcacccccttgactctgtggctgaatactaagctgagaatatgtaggaccagactcttcaaggttaaaccaaaaaatctctcggagttttaagtttaacaattcccagagcttacccaggggccaggagacatttgagttctaatcagcttggtggaagaatcccataagggtcctcccttactagcagggctaaaatagtcagataaagctcctctaggcctgctttaacaaagcttaattaagcaagaccccaaaggatcaagtgaatatgcatgcaacttaactgctagcaaaaaaggaagaaagaaggaaagaagtaaatcaacactctttaaagaaagatagtgtctgggctcagtggctcacgcctgtaatcccagcactttgggaggctgaggcaggcggatcatgaggttaagagattgagactatcctggcctacatggtgaaaccccrtctctactaaaaayacaaaaattagctgggcgtggtggcgggtgcctgtagtcccagctacttgggaggctgaggcaggagaattgcttgaacctgggaagtggaggttgcagtgagccgagatcgtgccactgcactccagcctggtgacagagcgagactacgtctcaaacaaacaaacaaaaaaatagaaagacaacaaaatggaaacattgtgtaacaaaatattcagagtgtccagcatctaataaaaaattactagacctgcaaaaagcaggaaaatgtgacccataatcaaaagaaaagtcagctgatagaaaaaagaaacagaaatgacacatgatggcattactataccaggagttttagttattagaaatatgctcaaggatttaaagaacagtatcaacataatgaagagaaaaattatatataaatattcatatgtgtgtgtgtgtgtgtgtatgaatgaagtggaaccttaaaaattcactgaatggactcaacaggagattcaaaactggagaagaaaagatcagtgaacctgaacacgtagcaatataaactaatgaaactgaagcatagagaagaaaatgactgaaaaagtgaacttttttttttttgagcaaccagatgacaatggggaggggagagatttctacttctgcaatgaagtaccagtaccataactagtactagatttacccttttgtaataaagaactggaaattggacgaggaatatgtaacagctgttttcagacattgaaatacaggcagaacaggactatgatgcatttatatttacccatgacaaactatcaagccaaagtggaggaaggagaaaaaaaagaaatagtgactgaaatgtttccaaatttgatgaaaataataagtgcacagatctaagaagctcaatagatcccaagcagaagaaatgtgaagaaaaccatatcaaaggacatcataattagattataaaaaaccattgataaaaagaaaatgatgctgggcatgctggcatgtgcctgtaatctcaacacagcaggaagctgaggtgggaggatcacttgagcccagaagttcaaatccagcctaggcaacatggtgagaccccatctctaaataaagtgaaataaaataaaaatttttgaaaaagaaaatgcaaaatacagaaaaaaaagataaattacatgcaagggaacaaagaatgactgcagtatccacagaaacagtataagccagagtccatcaaataacatctttaacatgctgcaaggaaaaaaaaaaacgccaacctggatttctatgtacaacaaaaatatccttcaaaaatgaaagagaaataaagaattttcagacaaaaagtgaaagaagttttcagcagcagatatacactgtaagaaatattaaagattggacaaaatgcacaaacaacaaacgaaatgttaaaggaaattcttcaggtggaagagaaatgatatcagagcaatagaactgaaaggaaaatagacaactttataattacagttcaagatttcaacatccccttttagtaattaattttaaaattaagtaaaacatcagtaaggtaatagaaaacatgaacagtattttcaaccagcttggccgagttactatttattagaagatgccacccaacagcagcagaatacacatgctttcctagtgcagatgatacatttacaaatatagaccatattctgcaccacaaaacaagaactgatagatttaagaggatttagacttaaatcatatgaaacatgttatctagccatcatgaaattaaattagaaattattaacgatggtgggaggattgcttgaggccaggagtttgagaccagcctgggcaacataccaggaccccgtctctacaaaaaaaaatttttttaatgaggcaggcaaagtggcacatacctgtagtcctagctactcgagaggctgaggcaggaggatcccttgagcccaggagtttgaggctatagtgagctataatcatgtcaggaatgagaccctrtctcttaaaaaaaatagagaaagaaagaaattactaacagaaagatattcagaaattaataattaatagcacacttctaaataaactgtgagttgaataaatcacaaaggagattacaaaatattacacatatcaaccaacaaattgaaatgtatcaaacacaatatatgaaaatttgtaggttgtagctagagtagtatttaaatggaaacttacagtattaaatacttatattagaaaataatgaagatttcaaattagtgatctaaaattctaccttgagaatcttaaaaagaaggaggaaaatacttattttaagtagaaggaagaaaataataaaaagtagaaaccagtgcaatagaaaatagaaaaaaaccaatgaaatacaaagctcattctttgagatcaataaaagtgataaacctctagctagactgcttaggaagaaattaagcacaaattagtgctatccggaggccgggtgcagtggctcatgcctgtaatcccagtgctttgggaggctgaagcaggaggattgcttgagtccaggagtttgagacaagcctgggcaaatagtgagactctgtcactacaaaagaaaacaatatcaggaatgagagaggtgacatcactgaaaatcctatagatgttaagtgtgtaagtgtatgataaagattttttttttttttttttttttgagacagagtctcactctgtcacccaggtcctggaattcaatgatgtgattagagctcaacttccatttcttccatctcctgggctcaagttatcctcttgcctcaacttcctcagttactggaactacagatgtgtgccaccatgcccagctaatttttttttaattcttattagagacgacatcttgctatgttgcctaggctggtctcaaactcttgagctcaagcgatcctctggccttggcctcccaaagtgttggaattacagacgtgaggccccacacccggcctaataaggaatattctgaataactttatgccaataaactcaacaacttagatgaaatggacaaattctttagaagacaaaaactaccagtgctcactcatgaagaaataggtgagctgaaaaatcctctatctattaaagaaattgaattttagtttttaactttcctataaagaaaactttagcagagaggggtaggcaccatctctgctgtttggtcgactcagccattccagcctgcgggctttggagagtccaaaagtttcagacaagggagcgtccccccagcagcacaacatagtggctttgccagatcatgaccagactgctgctttaagcagcctggatcacttccttctcactgggcagggactcccagttgggcccttcagccatgcccactggcacatactatggacagagctctgatctctccctgggatggagtgccccagggaggggagggctgccacctgggttggatggatgactcaactgttccagcctgcaggctttggagagtccaagctgatgggcagaagtggttctccaccaggacacagctgttttgttgaggtgtggccagactgtttctttaagcgggactctgatccgctcctcatctcagctgatcctcccagctggctcttcacagccagggcctccagccaccacccatgttctatggaactgacagagctccaatttctccctgggacagagtgcctgaggggtgggcaagctgccaccttggccgtttgggctcgtcaacgggtccaacctgtaggccttggagagcccagaccaatagggagctgaagggatccccaacacaacacaacacaactcctttaccaaaaagcagccacactgatgccattcgtcctgactgggtgagacctccttactggagtatccagccacctcctacaggtacgttcgggctggcagtagttcagtacccacctgggacagagcttccagaggaagcagcaagctgccatccttgctgttttgcagacttcactggcaatacctccaggtacaggaagaaccaaggcaactagggtctggagcagacccccagcacgctccagcagccctgcagaagagtggccagactgttaaaagaaaaacaaacaaataaacagaaaacagcaacgaagaaaaaccacaaaaaccccatccaaagatcagcaacctcaaagatcaaaggtacataagcccacaatgatgagaaagaatcaatgcaaaaaaagctgaaaactcaaaaagctagggtaccscctctcctccaaatgaccacaacacttctccagcaaggtctcagaaccaggctaaggctgagatggctgaaatgagagaagtaggctttagaagatggttaataatgaacttcactgagctaaaggagcacattgtaacccaatgcaaagaagctaagaattatcatagaacagtacaggagctgacagccaaagccattttagagaggaacataaccccctgttatagctgaaaacacactacaagaacttctcaatgcaatcacaagtattcatagcagaataaaccaagcggggaaaagaacctaagagctggaagactggctttctgaattaagacaggcagacaagaataaagaaaaaagaatgaaaatgaatgaacaaaacctccgagaaatcagggattatataaagagaccaaatctacgactgactggggtacctgaaaatgatggggagaatggaaccaagttggaaaacatacttcaggatatcatcaaagagaacttccccaacctagcaagacaggccaagccaacattcaaattcaggaaatgcagagaaccccagtaagatactccatgagaaaatcatccccaagacaattcataatcagattctctaaggttgaaatgaaagaaaaaatgttaagcacagccagagagaaaggccaggtcacatacaaagggaagccaccagataaaaacagtggacctctcagcagaaaccctgcaagccagaagagattggggccagtagtcaacattaccaacccagaatttcatatctggccaaaccaagcttcataagcaaaggagaattaatatcctttacagacaagcaaatgctaagggaattcattactgctagacctgccttgcaaaagcaccttaaggaaacactaratatgaaaaggaaaaagcatcattaccaaccactacaaaaayacactgtggtgcacagaccagtgacgttatgaagcagccaccataaacaagtctgcaaaataaccagctagcatcatgatgacaggatcaaatccacacataaccatgctatccttaaatataaatgggctaaatgccccaattaaaagacacagaatagcaagctgtataaagagtcaagatccatcaatatactgtcttcaagagacccatctcacatgcaaagacacacataggctcaaaataaagggatggaggaaaatttatcaagccaatggaaaaaagcaattctagtttcagacaaaatagacttcaaccaacagactttaaaatagactttaaactaacaaagatcagaaaagtcaaagaagggcattacataatggtaaagggttcaattcaacaataagagccaactaccctaaatatatatgctcccgatacaggagcacccagattcataaagttccttttttttgtttttttttgagagggagtctcactctgtcgcccaggctgaagtgcagtggtgcgatcttggctcactgcagcctccgcctcctggattcaagcaattctcctgcttcagcctcctgaatagctgggactataggtgcccaccaccacacttggctaattttttgtatttttttggtagagacagagtttcaccatgttggctgggctggtctcgaattcctgacctcaagtggtctactcatcttggcctgccaaagtcctgtgattacaggcatgagccactgtgcctggccataaagcaagttcttagggaccttcaaagagacttagactcccacacaataatcgtaggagactttaacacccactgacaatagtaggcagatcattgagacggaaaattaacaaagatattcaggacctgaattcagctctggatcaagaggacccgatagttatctacagaactctccaccccaaaacaacagaatatacattcttctcatcactgcatggcacttagtctaaaactgatcacataatcagaagtaaaacactcctcagcaaatgcaaaagaactgaaatcataacaatctctcagaccacagtgcaatcaaattagaaatcaagattaagaaattcactcaaaaattagttgagtatggtggcacactcctgtagtcctagctactcggggctgaggcaggagaatcgcttgaacctgggaggcagaggttgcagtgagctgagattgtgccactgcactcctgcctgagtcacagagcgagactccatcttaaaaaacaaacaaaaaaacaaaaacaaacaaaaaaaaccaaaaaaacaataaaacaaaaaaagaaaaaaggaaagaaagaaagaagttcacttaaaaccatacaactacatggaaattgaacaacctgctcttgcatgattcttgggtaaataatgaaattaagacagaaatcaagaagttctttgaaaccagtgagaacaaaaagacaacacatcagaatctctgagatacagctaaagcagtgttaagagggaaatttatagtactaaatgtccacatcaaaaggctagaaagatctcaagttaacaacctaacatcacaactaaaagaactagagaaccaagagcaaacaaaccccaaagctagaagaagacaagaaataaccaagatcagagctggactgaagcagacagagacatgaaaaacccttcaaaaaatcaacaaatctaggagctgggtttttgaaaaaaataataaaatagacttcaagctagattaataaacaagaaaagagagaagattcaaataaacacaatcagaaatgataagggggaataccaccactgaccccacagaaatacaaacaaccatcagaaaatactataaacacctctttgcaaataaactagaaaatctagaagaaaatggataaattcctggacatatacaccctgtcaaggctgaaccaggaagaaattgattccctgaagagaccaatagccagttctgaaattgaggcagtaataaatagcctaccaaccaaaaaaagcccaggaccagatggatttatagctgaattctaccagaggtacaaagaggagctggcaccatttcttctgaagctattccaaacaattgaaaaggagggactcctccctaaccattttatgaggccagcatcatcctgataccaaaacctggcagagatacaacaaaaaaagaaaacttcaggccagtatccctaatgaacatcaatgcaaaaaccctcagtaaaatactggcaaaccgaatccaacagcacatcaaaaaacttatccaccacaatcaagtcagctttatcccgaggatgcaaggctggttcaacatacacaaatcaataaacgtaattcaccacataaatagaactaaagacaaaaaccacgattatctcaatagatgcagaaaaggcctttgataaaatttaacaacccttcaggttaaaaattctcaataaactagatattgaagaaacatatctcaaaataataagagccatttatgacagacccacagccaatatcataccgaatgggcaaaagctggaaccattccccttgaaaaccagcacaagacaaggatgccctctttcaccactcctattcaatatagttttggaagttctgaccagggcgatcaagaaaaagaaagaaagaaagcatattcatataggaagaggaagtcaaactatccctgtttgccgatgacatgatctcctatatctagaaaattccaccgtttctgcccaaaagcttcttaaactgataggcaacttcagcaaaatctcagggtacaaaatcaatgtgcaaaaattgctagcattcctatatatcaacaacaggcaagctgagagccaaaatccagaatgaactcccattcacaattgccataaaaaagaataaaatacctagaaatacagctaacaagggaagtgaatgacctcttcaaggagaactacaaacgactgctcaaagaaatcagagatgatgatggctgagcatggtggctcacgcctgtaatcccagcactttgggaggccaaggcgggcagatcacgaggtcaggagatcgagaccatcctggctaacacggtgaaaccccgtctctaccaaaacaaaaaaattagccaggcatggtggcgggcgccaatagtcccagctactgaggaggctgaggcaggagaatggcatgaacctgggaggtggagcttgcaatgagctgagatcgtgccactgcactctagcctgggagaccgcgagactccatctcaaaaaaaaagaaatcagagatgatgacacaaacaaatggaaaaacattccatacttatgaataggaagaatcagtatcatcaaaatggccatactgcccaaagtaatttatagattcagtgctattcccattaaactaacattgacattcttcacagaattagaaaaaaactattttaaaattcatttggaacagaaaatcagatgttctcacttataattgagagctgaatgatgagaacacatggacacatggtggggaacaacacacactggggcctgttggagggttgcgggtgggaggaaggacagcatcagtaagaatagctaatgaatgctgggcttaatatgtaggtgataggatgatctgtgcagctaataccatggcacacgtttatgtaacaaacctgcacaacctgtgcatgtacccctgaacttaaaagttggaaaacagaaaactttaggcccaggtgatactggtaaattgttctgaatatttaagaaagaaataataccaattctacacaaactcttctagaaaatagtggagggaacatttcccaactcattctgtgttgtgaacatgattctgattctaaaatcagataaaaatattaaaagaaaatgttaggctaaaatttttcttgaatgtagactcaaaaattcttaacagtattttagcaagtcaatatatatagcaatatgtaaaaggataatacattatgatcaagtggagtttgtttcaggaatgccaagttggtataacatttgaaaattaatatagtaatattagaaaacaaaaaccaattaattttttcaatagatgcagaaaarttatttggcaaaattcaactcccatttatgacagaatctgtcagaaaactagtctgccatttattacccattgcctcttggctataaatctacttttttgcctgcttgtgatactgtaacatttgtctcctgtccattggcacagtgttaagctttcaatagcgagcacagaaaggatactggagaaagaagagagttcttttcctggttccagtgtgtctttttctttttgctcctgctatccaaaaagacacccagcaagtttcagcagtaccctagcagtcagcttccctgtgacaagttcagtggcacacctgcaggagacttccttacagcaagttcagcaacaccctsataggtgatttcatgagtaccagcagtgcaccagctgacttatagtttcctggtgagttctgtgacatcccatttggtcccccagttttcagcaacatcctctgagaaccagttttcctatgggtttctcgcaagtccagccaatgtcttagctggttttctattcacaaacctcactcaccaccataggtagcttgctggcgaatttcactgataccccatgcagtttcctgcctgttaaatccctgacccactaactgtgaactagctctgtcctcaggcaacccaggaaaattccccaccatccagtgggctgttaccataccctcttcaatgaggtctaaatcccagaccttgggagagtccctcccttccaagtttgttccttatttaaatattctccctcagctttagggtgatattctttagagtcctcgtttattcctacttagttaattccctgtaaacagttaacaattctgtatattaaactgtctctgttcagattgccatgtggtttctctctcttctctggatcttgatacagaattagtactagyagcgctcccaggagacagaacctctaagaagggatttcagaattggttttggttgtcttggctgatcttacgtggagtgccaagtttcttccaatgagaggtgggatgctgataattcatgagaagccatggcatcacaatttaattacagtatcacttatggttgattgtgaagaaatgacaaatgaacccagtaccttgagagcccaaatgactgctgcacttgactgttatggcagtagttatggctacgaacactgtagtttaggatagattctcctgtgtggcaagtgcttacagagagaaactggcaagataaaatcaaatggtttactattgttgttattattatgaactaataaaataagattttgttactatttttcaatgatctctacttgatacagatgtctgataatagaaaaacttaaggagacattggttgggcatgttggctcacacctgtagtcccagcactttgggaggctgaggcggaaggaactcttgaagccaggagttcaagatcagcctgggcaacatagcaagactgcacctctaaaacaaatgaatgaatggaagcattaacacaaaataaataccaaataaaaatcatttaaaatttgaaagataatcacatacgtatttagtatttgaatttttcatacctaaaattgtagttatttatttatttatttatttttgatttatttatttatttttgagacagagtcttgctctgttgcccaggctagagtacagtggcacgatctcagctcactgcaacctccacctcccaggttcaagtgattctcctgcctcagcctcctgagtagctgggattacaggtgtgcgccaccatgccctgcaaatttttgtatttttagtagagatggggtttcaccatgttggccaggctggtctcaaactcctgacctcaggtgatccgcccgcctcagcctcccaaagtgctgggattgcaggtgtgagccaccgagcccaaccctgaaatgaaattttaaagcacaaagtatcaattgttttatctgatggtcttgatctttgtttggtgataaatatgccagaaaaaaatgtatttcattttgcactgacattcatcaaattattaagaatgtatccaaaaacatcctcatatcgggcattacaaagtatgttgtttcatgtaatctcattttcttttttaattctgaaagcatttcgtctgcttctcctgattttgattttgccgttgaaatctattaaatatattgcttttatttcagattttagatccgtttcttatttcatgttggaatgttccacaacagcattcactttctctctttgcattttttctgttaaatatttacaaagcactgaagcttgtaacaaataatcaktgaaaaatgccagaaaatattattggatagtattcaaataacctaacatttagatttctgagcatggttaacagcattacacagarttgtgtgttgaaactgccaatttaaggacttacttagcctccaaacttgttatttcttggaactcaactyataggatttatatgaagtataatatacatatcatcttattagtattgttttatgtaagaaagacccaccactagcagatatggccatgagcacacacttgtgggaacagctgcaagtaagactgacttgagtgtattgtgactactactctcccacatgcttctgtcctggttcctggaaatatcaaccttaacctttgattctgcctttcagtgtttcctgctcttgctttcatttgatatcagctgatttcttcaagccagatgtctctatgtcaaattattaaactttagtttgtgcaggagaattagaactttttttgtcatttttcatatcaactgatttgttgtaaatttagagaaagcaaattaccctagaaactccagaaggaattcctacttagtaacataaatcaaccgcagctctcatatattgcaggtgggaatgcaaagacatctactttggaaaataatgtgatgttttcttatcaaattaaacatacacttaaccataatacctagtaatttcactcctaggtattaactcaacatacatttaaatatatgtctacccaaagtcatgtaagttaatagcagctttatttattatagcccaaatgtggaaacaacccaaatttccatcattggtgaatggataattaattttggtatattcatacagtagaataccaaytgaataaaacaagacaaaagatcaatgaggaaacagaggacttgaacaatacaagaccaaatggacctaaccgacatacagaacatttcatccaataacagcagaatatacactcttatcaagcatgcatggaagattctctatgataaaccacattagaccacaaaacaagtcttaataaatttaagatttaaattatgcaaagtatcatctctgaccataatggaatgaaactaaaattaattagcagaaagaaaacaggaaaatttgcaaatacatggaaagtaaacagtgtgttcttaaacaaccagtggatcatgagagaatttaggaaatacctggagataaattttttaaaaagatacaacatactaaaacttatggaatatagtaaaagcagtactaagagggaagtttatagcagtaaacagattaaaagagaagaaaaatctcaagtcaccaacctaatcttataccttaaggaattagacaaataagaatgaactaaatccaaagtcagcacaaagaaggaaataataaagactagagcagagataaactgaatagaaaacattaaaaaaaaagaaaaaaatcaaccaaaccaggagttgtttttttttaaaaagaaaatcactaaaattgataaacccttacttagattaagaaaaaaagacttaaatttctaaaattaaaaatgaaaaaggagatattataactgatgtcacagaaatgaaaagaattataaagactgctgtagtgaaaagttagatgcccacaaattggatgatctagaagaaatggataaagttttagagatataaacctaccaagactgaatcataaagaaataaaaaatctgaaaagacctataatgagtgtggagattaaagcagtaatcaaaaacctcccaacaaagaaaagcccaggaccaggtgggtcccctggagaattctaccaaacagttaataccagtccttctcaaattcttccagtgaacggaagagaaagggacactctcaaactcatttaaactcattaccctgataacaaaaccagacaaagacacaataaaggagaactacaggccaatatccctgatggatatttgacacaaaaattctaaagaaaatactagcaaaccaaattatattgcacattaaaaaatcatacatcttgaccagctaaaatttatgcctggaatgcaaggatggttcaacatataagactcagtcaatatattatgccacattaacatctcaatacagaaaagcaaaattcagtaccctatcaggatttttaaaaatactcaacaaattaggagtagaaggaaactacctcaacataataaaagctaacattatgcttaacaggaaaagacagaaggcttttcctgtgagatcctgcaataaagcaaggatgcctggtcttgccattactattcaacatagtactggaaattctagccagagtaataagacagcaaaaagaaataaaaggcattcaacttagaaaagacttaaaagatctctctttgcagataacatcttaaatgtaaaaagaatttgaacaacatgggtgaatctcaaaagcattatgctaagtaaaagaagccagacaactactggaatcaaattaatgtatgattccatttgtattaaattatattaaaggcaaaactatactgacagtaggtcagtaactgcccagagtggaggactacaaagaggcccaaggaaactttgggggataatggtttccaaagttcacataattgtactattagaattagtgcattctattgtaggtaaattatttctttcataccatcaatatttagaaaatgaaagtttatgaaaatattacttaccatagcatataagtttttwaaaaatacctagaaattaacctctaatgaaacgtaagtcctctatagtgtgaaattgagggatgctaaagaagatctaaatatgctgacagaaatttcttattcatgaattaaaggcagtatggcaaagataccrgttctgctcaaattgacttgtagattcaatgtaattccataaaaatttcagcctttttagcctgtttatctgattctagaatgtatatggacaggctttgaatacaaaaagcaagataggtggacttgctatactatatatcaagatttattaggaaaatagaataattataacactgataatgataccagaatggtcagtagatagaaagcctagtagtaaacacccaagcttatatagacatttccatgaaagaagtgctgtggctgatcagaagggaaattaatgacttttaataaattattttgagtagtcatttggaaaaaaaggaaattagactggtacttctcaccagctcccccatccccaccatctgttttttgtgttaaagtcctaggtgtgaaaggcaaacctgtagtgctttttaaaaagaatatagaatatctccatagctttaggaaaggatttttttcaactagacacaaaaaccattagctgtaaaggaaaagatttatacatttgactacattaaaattaagagcttctgtcatcaaaatacaatttcttaaaaaggtgaaaaaatcagaatgtgacaagatactctctgttcctctacatttatttctgcagtacaaaaaagtttacatgtgattggcacatatgtagaaaatgacatgaatttaactcaggttatactagtttctatgccattttcctcagcaagctaatgttttttatcatcaaatagctacaagtaaataaaataaaagaacacaactgaatattgcagctgaggaagaatatggcagtgtatatgatacctatacacttcaatttatcctcttttctgtttgaccatgtgttctgttttaaaaatctttattgcactatttgccctatcttcattatttagtagcctaacactttcttatacccgtttctgtcaagccaccttttcttttcattcctttcattttcttaaaagaccagtattttatttactctgttatttttaattgggaatttaacatgtcttttaaactgtattaatattttaaattaggaccattatttattttgttagtgttctagttacaaagttgcaaaggttttgagaagtcaaccatgactctattttcttcataatctctcttattatgggtgcatgatttttcagaaagtactatttcaagaaaacatatttcacagaaatcccccatttgcaatacatatgtctgacaatggatcacagtacttcatcaatactaagacagttatttcacattttaacatctctacagttgggaagcatcttagaatagatgaaatctttcaattataattgccagggttttttctttcttagagataaaataatgatgcagtttagaaggggttggttacttagatttgatgatttactataatattcagaatataaagaattataaatcaattttattttattttttattatactttaagttctggaatacatgtgcagaatgtgcaggtttgttgcataggtatgcatgtgccatggtggtttgctgcacccatcaacctatcatctagattttaagcctcacatgcattaggtatttgtcctagtgctctttcaccccttgccccccacaccccgacagaccccagtgtgtgatgttgccctccctgtgtccatgtgttctcattgttcaactcccacttatgagtgagaacatgtggtgtttggttttctgttcctgtgttagtttgctgagaatgatggtttctagcttcacccatgtccttgcaaaggacatgaactcatccctttttatggctggatagtattccatggtgtccctgtgccacattttctttatccattctatcattgatgggcacttgggttggttccaagtctttgctattgtgaatagtgctgcaataaacatacatgtgcatgtgtctttatagtagaaggatttataatcttttgagtatatacccagtaatggaattgctgggtcaaatggtatttctagttctagatccttgaggaatcgccacagtgtcttccacaatggttgaactaatttacactcccactaacagtgtaaaaacgttcctatttctccacatcctctccagcatctgtcatttcctgactttttaataatcgccattctaactgatgtgagatggtrtcttgttgtggttttgatttgcatctctgtaatgaccagtgatgatgagctttttttcatatgtttgttggccacataaatgtcttcttttgagaagtgtctgttcatatccttygcccaatttttgatggggtagtttgtttttttcatgtaaatttgtttaagttccttgtagattctggatatcatacctttgtcagatggatagaatgcaaaaattttctcccattctataggttgcctgttcactctgatgatagtttcttttgctgtgcagaagctctttagtttaattagataccatttgtcaattttggcttttgttgctattgtttttggtgttttagtcatgaagtctttgcccatgcctacgtcctgaatggtattgcctaggttttcttctagggtttttatggttttaggtcttacgtttaagtctttaatccatcttgaattaatttttgtgtaaggtgtaaggaaggagtccagtttcagttttctgcatatggctagccagttttcacaacaccatttattaaatagggaatcctttccccatttcttgtttttgtcaggtttgttgaagattagatggttatagatatgtggtgtcatgtctgaggcctctgttccattccattgttctatgtatcggttttggtaccaataccatattgttttggttactttacccttgtagtatagtttgaagacaggtggtgtgacgcctccagctttgttccttttgcttaggattgtcttggctatatgaggtctttttgtttccatatgaaatttaaagtagttttttctagttatgtgaagaaagttaatggtagcttgatggggatagcattgaatctataaattactttgggcagtgtggccattttcacaatatcggtttttcctattcatgagcatggaatgtttttccatttgtttgtgtcctctcgtatttccttgagcagtggtttgtagttctccttgaagaggtccttcatgtcccttgtaagttggattcctaggtattttattctctttgtagcaattgtgcatgggagttcactcatgatttggctctctgtttgcctatcattggtgtataggaatgcttgtgatttttgcacattgatttttgtatcctgagactttcctgaagttgcttatcagcttaaggagtttttgggctgagaagatggggttttctaaatatacaaccatgtcatctgcaaacagagaaaaattgacttcctctcttcctatttgaataccctttatttctttctcttgcctaattgccctggccagaacttccaatactacgttgaataggagtggtgagagaggggatccttttcttgtgccagttttcaaagagaatgcttccagcttttgtccattcagtatgatattggctgtgggtttgtcataaatagctcttattattttgagatatgttccatcaatgcccagtttattgagagtttttagcatgaaggtgtattgaatattattgaaggccttttctgcatctattgagataatcatgtggtttttgtcatttgttctgtttatgtgatggattatgtttattgatttgcatatgttgaaccagcgttgcatcccaggcatgaagccaactggatcgtggtggatgagcttttctatgtgctgctggattcagtttgccagtattttattgaggtttttcgcatcgatgttcattagggatattgrcctgaaactttctttttttgttgtgttctgccaggttttggtatcaggatgatgctggactcataaaatgagttagggaggagtccctctttttctattgtttggaagagtttcaaaaggaatggtaccagctcctctttgtacctctggtagaatttggctgtgaatccctctgatcctgtgctttttttggttggtaggctattaattactgcctcaatttcagaacttgttactggtctattcaggagttcgacttcttcctggtttagtcttgggaggatgtatgtgtccaggaatttatccatttcttctagattttctagtttatttgtatagaggcatttatggtattctctgaaggtagtttgtatttctgtgggatcagtggtgatatcccctttatcattttttattgcatttatttgattcttctctcttttcttcttttttattctggctagttgcctgttttgttaatcttttcaaaaaaccagctcctggattcattgattttttggagggtgtttcatgtctctatcatcttcagttctgctttgatcttggttatttcttctgttctgctagctttttttttttgagacagagtctcactctgtcacccaggctggagtgcagtggcacaatctcggctcactgcaagctccgcctcctgggttcacaccattctcctgcctcagcctcccaagtagctgggactacaggtgcccgccactacaccctgctaattttttgtatttttagtagagacagggtttcaccgttttagccaggatggtctcgatctcctgacctcgtgatctgcctgcctcagcctcccaaagtgctgggattacaggcgtgagccattgcacccagccctgttcggctagcttttgaatttgtttgctcttgcttctctagttcttttaattgtgacattaggttgtctattttagatctttccagttttccgatgtgggcattcagtgctataagcttccgtctaaacactgctttagctgtgtcccagagattctggtacattttgtctttgttctcattggtttcaaagaacatctttatttcttccttaatttcgttatttacccagtagtcattcaggagcaggtttttcagtttctaagtagttgtgcagttttgggtgagtttcttaatcctgagttccaatttgattgcactgtggtccgagagagcgtttgttatgatttccgttcttttgcatttgctgaggagtgttttatttccaattatgtggttgattttagaataagtgtgatgtgctgagaagaatgtatattctgttgatttggggtgaatagttcagtagatgtctattaggtctgcttggtccagagctgagttcaaatcctaaatatccttgttaattttctgtcttgttgatttgcctaatattgacagtggggtgttatagtctcccactattattgtgtgggaatctaagtctctttgtaggtctctaagaacttgctttatgaatctgggtgctcctgtattgggtgcatacatatttgggatagttagctcttgttgcatggatccctttaccattatgtaatgcccttctttgtctcttttgatctttgttggtttaaagtctgttttatcagagactaagattgcaacccctgcctttttttttctttccatttgcttggtaaatattcctccatccatttattttgagcctgtgtgtgtctctttgcacatgagatgggtctcctgaatacagcacaccaaaaggtcttgactcctttatccaatttgccagtctgtgtcttttaattggggtattcagcccatttacatttaaggttaatattgttatgtattaattatatcctgtcatcatgatgctagctggttattttgcacattagtcgatgcagtttcttcatagggttgttggtctttatattttggtatgtctttgcagtggctggtaccaatttttcctttccatatttaatgcttccttcaggagtaaggcaggcctgttggtgacaaaatccctcagcatttgcttgtctgtaaaggattttatttctccctcacttctgaagcttagtttggatagatttgaaattctgggttgaaaatccttttctttaagaatgttgaatattggtcgcctactctcttctggcttgaagggtttctgcagagatctgctgtgagtctgatgggcttcctttgtaggtagtctgacctttctctctggctgcccttaacattttttccttcatttcaaccttagagaatctgacgatcatgtgtcttgtgattgcttttcccaaggagtatcttagtagtgttctctatatttcctgaatttgaaagttggcctctcttgctaggttgcggaggttctcctggataatatcctgaagtgtgttttccaacttggtcccattctccctgtcactttcaggtataccagtcaatcataggtttggccttttcacatagtctcatatttcttggaagctttgtttgttccttttcattcttttttctctaattttgtctttatgctttatttcattaagttgatcttcagtctctgatatcmgttcttccacttgattgatttgcttattgatacttgtatatacttcatgaagttctcgtgctgtgtttttcagctccatcaggtcatttatgtttttctctaaactggttattctagttagcagttcctgtaaccttttatcaatgctcttagcttccttgcattgggttagaagatggtcctttagctcagaggagtttgttattacccacctcctgaagcctacttctgtcaattcatcaaactcattctctgtccagttttgtgcccttgtcagagaggagttgtgattatttggaggagaagaagcattctggtttttggaattttcagcatttttgtactggtttttcctcatctttgtggatttatctacctttgatctttgatgctgatggcctttggatggggtttttgggtgagcgtccttttggttaatgttcatgttattgctttctgtttgttagtttcccttctaatagtcaggcccctcttctgcaggtctgctggagtttgctagaggtccactccagaccctgtttgcctggtatcaccagcagaggctgcagaacagcaaagattgctgcctgctccttcctctggaaacttcctcccagaggggcacccacctgatgccagccagagctctcctgtatgaggtgtctgttgactcctactgggaggtgtctcccggtcagaaggcatgggggtcagggacccacttgaggaggcagtctgtcccttagcagagcttgagcagtgtgctgggagatctgctgctctcttcagagtcggcaggcaggaacatttaagttactgaagctgcacccacagctgccccttcccccaggtgctctgtcccagggagatgagagttttatctataagcccctgactggggctgctgcctttctttcagagatgccctgcccagtgaggaggaatctagagaggcagtctggccacagccgtttttctgcgctgcagtgagttcyacacagtccgaacttcctggcggcttccttaacactgtgaggggaaaaccacctactcaagtctctgccatggtggatgcccctccccccaccaagctcgatcatcccaggtggacttcagactgctgtgctggcactgagaatttcaagccagtggttcttagcttgctgggctctgtgggagtgggacccactgaccaagaccacttggctccctggcttcagccccctttgcagggaagtgaacagttctgtctcactggagtacaaaaaaaaactcctgcagctagctcaatgtctgcccaaacagccgcctcgtttcgtgcttgaaacccagggccctggtggtgtaggcacacgagggaatttcctggtctgcaggttgcaaaagctgtgggaaaagcatagtatttgggccaggtagcacagtccctcatggcttcccttggttaggggagggagttccctggctccttgtgcttcctggatgaggcgctgccccaccctgcttctgctcaccctccgcgagctgcacccactgtctaaccagtcccaacgagattatctgggtacctcagttggaaatggagaaaccacccaccttctgtgttggtgttgctgggagctgcagaccagagcttttcctatttgggcatcttgccrgctcccacaaatcaattttaaagacacaaacccaacagagaaatggggaaagacttgaataaccacttcacaacagaggaaatctatatggcttctaaatgtattaaaaagaatgtttaatctcataaagcaattgctttatgaggttgaagtgaagggtaaaatcttgagtagccctcctatttttcggatgtcttgttcattgttgaggttgtggatgatatatccggagcatatgaatagtatggctttaaagaaagtgtgggattaaataaacagtgaagtgactttacacacccaggatattggaaaaatcttataagcctcatgacaagtattggtgtggacagaagagaatgcatgttatgtgattccattcataygaggttgcaaaagtggcaaaactaagctatgttgcttaaaaatgcattatttagttggtacaatcattaaaaaggaaaggaaatcatcacagatgtcaagatggtagtcacttttgaggatggagggaggsagaggtttatcatcagagacacacaagaaggtttttgaggtcctggtaatgttctgctttttgcttgggttgatttgcttgtaactaaacagaaagggtaaatgatcagttatgtcaaatgttattcataggtcagttaagatgagggtaagacttggccattgagttcagcaaagtggagactattgttgaaacatagcacattgtctcagtgaatggttggggaaaagatcttatttgaataggctcaggagacagtgagaggagaattggagactgtgtatggctccaaagaactcttcggagcaatttttatgtataaaggagaaatgtggtgagaagtgggggtgaggggggatgtagaaagctttatataaaatatacagtattaggagaatataaagataaattttatggaatgcgaaaagtaatggggtgaaggaaggaagataactttatgtgtattgggttgtatggttttgtggggggagtgaaaatttataatactttgtaaagagaattaacattaaaactattttctagtcttagaaatatatggtagaattacacataccattcatatctgtccatgaaaagaatcatggacaacatcctgctcaacaccaccttgcagaaagagaaagccaaaagagattaagtagttgcctaaattgtgccgttaataataatcacagaccaaaacagagttcctcctgccctttcgatcagtgctgtttttatagtattatctataatatggcttgcttttaaattgttttttagtcattatgttttatagtggagtttatttggatatctcaattagcctttgctgtataacagactaccctaaaacttagtggcttaaaatagtgatgtttatttctcatgatttcatgagttgggctcagtcgggaccattcatgtggctataatcattgacagctcaactggagctggaggggctaagatggcctcattcatgtgtctggggccttgctgctttttgttggcttgggctctctttatcactcagtagtctagcctggacttccttgcatggtagcaggagcattccaagagggtgaatatggaagtctagatccctaaacttggacaacatcacagcctttacattaaattaatcaaagcatatcatcaatccagtccaaattcaagggatgaggcaacaggccccacctcttaggaggtgcagaatatcgtcatcatattttttccatctgtcatagataattacaaattataattttaatccttgaatttccttttttttttaagagacaggatctcactctgtcgtcaaggctggagtgcagtggtgctgcaatgataacccactgcatcactgcatccttcaactcctggtctcaaattatcttcccacctcagcctcacgagtggctaggactactggtgtgcatcactatacctggctaattttaaaaatttttttatagagacgaggtcttactatgttgcccaggcttgagttaatgtctaatgttaacttttatttaatatggagctaagaagctgttgattcagagaatctaacaatgtagttttggtcaataatgagaaatataaaaatttgaaaataaaaaacgtattaaaaattaaaggaaaaaagctgttttccagattttatatcctctatgatgtaaaacaggtaaagaaatgcttatttttagaaaaaaaaattgggttaaaaaatgggggagaaaattcaatatagtctttgttgcacagaatgttgacataatcattattttctcagattattaccattaatttgttatcataatctttgttttttttgtgcatgttacagaatataatagaatgtaatgtgactaaaaacagtaggagcaattaagagtttcccatgaattaacttacagtaataataagagcatattgccaggcactgtcctaaatgcatttgtttacaatttcacttaatttatttgacagctatgtatattcagcacctactgtgatctttgcactgtgtcaagacttggggctattactctgaatcaaatcgacatggtttctgcatgttgccataccctagatagaaatcagggaaggttctctaaaggaactttctaagccaggacctgaaggatgagtagaagttagctgaggtgagagtgggaaagggagtaggaagtcctctggggacatgacaacgaccttgaaagtatgtgagtgaaaggaacattaaaataattgaaaaatatatgtagtatactaaagcctaatgtgaaaggaatgaggcaagaaagaatttggggaggttgccaggggccagatcacaaagggctttgtaaaatgtgttgttatagaatctggattttatgccaaggatcatgggaagccattgataggtttagagagagattttgtttgtttcctcagactgtgttttagaaaagtcactgactgcagtgactaggaggagtgtagctgggaagaagtaaaggttgacctaggggtaccaacaataaaggtcctagataatgatatgaattcagtgattatgggaatgaaaagaagtatttagaaatacttatgaggtagatttggtgactggatgtggagtagagggaagagcccaagacgactgactctcagatttcctacctggagtgctattactgaataggggcctaagtggaggaacaggtttgagaaggaaagtgttcttgtcctagacttgcaaccaattcccagtgaaaatcctgtatctctttgtattatctagtatttgaaatgacattgtgtaaaagtgactcttgtttagtaaaattcagtcaaatgtagcaatgctgccataacctgaatttacaccttgaagctgaaagattgtactttagcatttagtgatctgttactgtagttaattttatgaaacaatttacttactgcttaatttttaaaaattacttgaagagaataatggctaagaagccatatgtgaatacctatcttaagccttttattcacatataaagtaactttataaccagtgtttgtccaacttttaaaaataaagttcattaaaataacttataaaaaatattattttttgtctttcatgactctagtaagtagaatgtttacatttatgctagagatgaaaaaattaagtaggataactactttaaaataagtctctttcaccaggtgtgcacatgtatcaaaacatgttgtatgctataaatatatacaattttatctgtgaattttaccttaataaagttggggcaggggaatgaaacatctcttatgtgttctctacaaactgaatattcttttactttgaatattttgtaagtttaaaagtactttacaacctacttttttttttcttttttcttaggcactacaagggcccccagggatggagaagtaccaggagtggattataatttcatttccgttgaacagttcaaagcactggaagagagtggagcattgttagaaagtgggacatatgatggtatgtccccaaataacatcactaccacccaaaaaactatctgaacgactggaattatttcagagggaatttgaccagtaaagtaccactttttgaaaaactttttttcctctctgtttttgagaaaattttcttttgatggggagatttgtaatttattaattaaaatgggattaaataataagcaaaaaaaatccatcatattttaaagttgattgtgaacagtatactaaaaatcagccagactggccagtttatatatttcatagtaattcacattcatcatgtgaactcagtgagtatttgttgattgcattttatttgtggttggaattcaaaatctgtactttaaaaaacttacatgtaccttgactatcctggaaaaaagagaatataaaatttggggagaaaacaacaaaaacagaataattggttttcttttcatttctgtttcctctacccacttgattccattgatatttgatatttragatcaatttccatttttaaatgactctgttagatctatttttccccttatgtaacatacccttccctggcaagcttatccacttccatagcaccctacgctatggtccattattgctttttcatactattataattgcctgtttataagctctgtgatagtaatggtcatgtctttcttacttgatattatcttcagtgcctaaagatagtgttcaataaatatctaacctggaattcagcgtatctaaatatgcatttgtgttctatccaaaagagaaattcttcatcatttctctctttagcagcaccatgatctcagaacagtgaaatcattatttactttctcctttttctcacatttcacatccatttgccaaatctcatcatttcttcttttgtagctgcattcacaatacccttctttcactttcaccacctcattgtaggcccactagaagagctcatgtgtggactattgctgttgatctcatttgttcccatttcttccaccctgcccattgctaccatgctagtcttcttcaagagcagctttatcatgtctctctcctattcagaactttcaatgatttcctttcatctgctaagtttaacctaactaccttttctgggcttagcgcccatgactcattcatttgttcattcgttttatcctgttttattcattaaacaaccatttattaartacctactatgtgccaagtactaaaagagaatctcggaatactgtaatgaacaagattaaagtgcttttgaagtttttttttgtttgtttttgtttttttttaagaagccctctccccttaaatgatgaagatgctctacattttcttccactaaatataagagcttggtatggacgaagtggcatattacttattattaattgctgtgtgctcaattcaaagaaaatgcaaattaaaatagttgtacattatttcacatccatagattggcaacaattttacagtctgataattgcaagaaatggaaactcccatacactgctggcaagactataaaatggtataatccttctggagagcatcgtggcagtagctggtaaatttgaagatatacataactctgacctagcagtgcccctctctagacatctactcaggaaaaactgttgcccatatgcatatgtagacacatatgggaatatttgttatagtgtgaaacagtgacagaatggaaacaactctcctttagtagaatgaataacatacattttaatttgttcataaaaatggactgctatacagcagttcaatgtactggatttataggtatcaaattaataggtcttaagaggcataaaaagtataaaattatataaaggtataaaattgtataaaaagaaagttacaaaaggatatgtacattatactatttatgaaaaaatatgtgaaatattgtgaaaatactctgtgaagcttttatgaaaacaatagtatttacrtgttatagatgcatatatacatatcctagatgtatattcaggaggaaagacacatatcaacttcaggacagctcagggagggagtggctatagggacaggaagttagagctttaattgtagatgtggccatatatgtatatatccttaaagagaaaaaaagggagatttgaaagcaatctagcaataatatctagatgatgtatatataaataaatacatgtacatatacttatataagtaaattttatatagatatttctaatactattctgatactacagtctgtaattttatatgtttgaaatattgaatagttggcatttctgcaaaaatgaaaaagccttcagaaaataaaaaaaacttcaaaacagctctaaaacaatgaaaatctttgtcagtaactatagttagggttcacaaaccttggaattgtatactgtatctgaaaacttggtatttaccaacatctcaagaaaaaatagatctaatttattttatttatttatttatttttattattattatactttaagttctagggtacatgtgcacaacatgcaggtttgttacatatgtatacatgtgccatgttggtgtgctgcacccattaactcatcatttacattaggtatatctcctaatgctatccctccccccagatctaatttatttataaacaatgctaatttttttttaatctgagccccataattatctttttaaacaaggaaactgcccaaaattattatgaagtcctaaaatcttttcagtgattatggatggcagttatcatatcctgcatttttatattttccccttagaaaaaggttaaattttctcgagttakataataattaccaagaattctcagtaagatgtgtttytagtagtactactaccttacttagaaaaagtggactttttatttctgtcatggtatatccagtttccttgataststgattaatgggcataattcaggaaaaatagagaccctcgaacctcctaatccccagccaaatctctgtttggtgtatttctgtgccggctgccccagagaagcgtgactggctttttcattggttctttgctttacttctgagctagaaagtttgcagaaagtttgcagaaagtttagtctgttttcatacaaatctttgcatccatctgtatgactggagtaactccatttcaaatatggatttggaaacaagggagtaggtgagtagggagagacaggatgtcattgaaaagttttttagtttcattttattgttttgtcttcattattttaatgacaattactgctgaaagtcaaacttccaaagaattcatgttaaatgttttccccctcaaaacatgcacaatttaaggtaaactatgtaatgtctagatttgtctcagcattatggggaagaacctatgctattttctatctaggaaaaaacaatcaattatctacctcattaatttaccttaggtgaatgagcatcttaattacttccttaggagctaaggaatttgattagaaaatatgattttagaaaaatcatgagtattttactctctaatcatatatatatttctctaacgttagcataatgattaatagaatgtcaaaagtagtaggaaccacaaactgttaatgtggctagacctgttgagtgctttcccatattatttggcggcctagtgggaactgcatgacaaattgagaagatactcaattgttttcattcttttctggaacatttatttttactgcaaaaattacagattctcaagagaaagttaaagtatttcttgctttcctgagagtaagccaatactgaattatcctgctaatgtctctgtttgttcaataaattgtcagataaaataatagaatgctcagaaaaacttttaaaaattacccttacataaaaagcctacatttttatatgatctggttagttcttagcttaacctttacctacatacttcctcattttaccaaaatagttcattatgttacacattagaacaaaattatttcagttagttttatcctcatttacccccaccttttatgccaattagtcttacatgacagcatcaatgcatttaaattcacaaattatgtcctaattcagaacccatgtaaggcaatccctgtaggaatgaataatctacttacatacagtcaacttcctggccttaaacaaatagtattaagatattagataatatatgtgaagagcacttgagaaattagttctttcccctatttctgctctytcttctcgtaagatgagtgctttgagcgctttggcctccttttggccaatggtagatatttcaatttttttttttttttttttttttttgaggcagagtctctgtcacccaggctggagtgtagtggcgcaatctcagctcattggaacctctgcctcctagattcaagtgattttcctgcctcagtctcccgagtaactgggattcacaggcatgtgctaccatacctggctaatttttgtgtttttagtagagatgggttttgccgtgttggccaagctgatctgaaactcctgacctcaaatgattcacccatctcgacctcccaaagtgctgggattacaagtgtgagccaccatgcccacccctatggtagatatttcaaaacttctttgtgaaaaacagggcagagacatacactaggtcaaattgctctgactctcactgcaacattagtaatttcagctgctattttattcacttcaggaaacttctatggaactcccaagcctccagcagaacccagcccttttcagccagatccagttgatcaagtcctctttgataatgagtttgatgcagaatctcaaagaaaacgaacracatctgtcagcaagatggaaagaatggatagctctcttcctgaagaggaagaagatgaggacaaggaagctattaatggcagtggaaacgcaggtttgtaaatagatgaacaacttctaactgatcttctagattgattttactattacgttgaattaaaagcactaaaattttttacaaagcatatggagagcaagtgatgggattttaatttttttgtaaaggttgtatgtggagcaaagtgtatttctgtagaccatcctataagctaaagtgagttgtcccaatttggataaatcaatgataaactatcattagtaataaaatatatgccattaccctgctgtttaaaatatttgagatttgcctctgatgttgcaatgtgggagtcttgttggcctatgtcttactttacaggatgtaaacaatatatggatgttttagaatgtagacttcagcctaaacaaagtaaatagggcttgaaagtatgctgataaaaattatctaaaaggttggtttataatattttgaatttaaattttggattcactcaaagaaaaatttcaaatatgagacccttcattaaatgtaaaaccaacagaaattcagtggtgaagaatctgctccttttgagtagccctaattaatgtggtgattgcttagagggttattagacttataactgagagtataactaggaaaccatagaatcacagctgagcttattcaatggtattcattgcaaaaattccattcagaacactagaatgtaaacttcatagggctgaagttttcctttttttatgtactgttctatcccttccatcaaaaacatgcctggcatgtaataggaactaaaatcctcaaatttgcagaacacatttccttatcattttcccaaagcaccctaatctttttcatcaattattaaaatgtgatatgtatatttattgagttaatacattcwttgtttatgtcccactccagagtgtgagttctgttttatagtcctatctttcacataatacgtttaatgttaaatggattaccccaatgtatttaaatgtaaatactaaaaacaggttttaaaaggtttaggtgaattcacatctaatttttaggagttcctaagggaactcatcacaccgttgagccttttaatgttgatatcagctttgctatcccacaaaattaagtctgttaacatttaaaaatgctaaacagtaggattggagaccatgaatctttcccaatatgggaatttatatgttcttgatttaagggaaaagaaaatgttctttttttacttcctaatacagagcctttaattgatcactgcagttcttttagcggtaaacttgtttgtaatctctatagttgatgcttcatgtaagtcacttgttaaactgatgttatatactctttgatgttaatatttaaagggaatatatccaagggtgtgtgggaggcagttcgtatactacctcttatgtatagataccataggacacttacattgaattacatatttctttgtcatagaaaatatacaggacatttaagtgaaaaaatacaaagcaccygcctacaaacagaattcaccttctgaataagtatgaactgtagttgttagttaactaatcaaagttggggaaatatgctttgtgtgttgcttttgttgttttttgtttatttgtttgtttgtttgttttgagacagagtctccctttgttgctcaagcaggagtgcagtggtgcgatcttggctcactgcaatctgtctcctaggctcacacaattctcatgtctcagcctcctaagtagctaggattacaggcatgtgccaccctgcccagataatttttgtatttttagtagagacagggtttcaccatgttggccaagctggtctcgaactcctggcctctggtgatccgcctgccttgacctcccagagtgctgggattacaggcrtgagccaccgtgcccagcctgtgtatcgctttggaatccctgccttgaaaaatcagaaaattgttcgggagtagaaatgaggagaggataggtagaggtttatttgtgcacaccagtatgtttattattttatatcttgctgaagaaataacccaaaagaaagttaaaatggtcatgtacaataacatatgttacgtaataattattttttttctaagaaatggttttatataaagaacatcttcccaagtcattggctattaagcaaactcctttattcaattgcttggaactatattaagaaaagtgttatagatcatatacttgcttttacttttctccaacatggttatttcccaagaatgtaactcctttccagattgatttttccattaggtaccttttaatttctatcattttttctgcatacaaaataaatcatgtgtttgattcatttatttattcaacaaatatgtagtgagcacttactagaatactaaatgccattgtgctaaatgctagcaataaagcagtgaacaaaacggacaaaaacctgtcatgaactataccttctggtgggagagacagaactggccaacttaaatgaataacatacatcgtgtgttagatggtgctacagagaaaaatgaagcagagcaggaggtggtaagatgtggtggtcaaggtttgcaattttagacagtgtggaagaaaagacttgaaagaatcaagtgagtaaactcaggatatctgggagaagagcattctagacagacagaactggaggtacaaatgcccagagatgggaacatacctagaatattcaggcaatagcaaggaaaccagagtggttggatacaatgtggacaatgcattctatgtggttggagcagagtgatggaaggcaatagaatagaatagtaaccaataagatcatttagataatgatgggcatgaggagggaagaatgtatataataaagcatcttgtaggtcattggaagaattttgatttttattctgaaatgagaaacgattatggggttttgattcaaagagtaacatggtacaacagtttttaacaggcttattgtgactactgtattgagaataggcaaaaggaggacatgggcaaaataccctaactgggataccagttaggaggttattgaatgtgcaaggaagaaagtgatcagatgctgctgataactcaagtaggatggaactgagaaatgatcattggatttagcaatgtagaggttattgatgaccttgataagaatagtttaatgataggaattcaaaagccttgttggagtgaggtccagagagaactggaagagtggaagtggaggtagcaaatataaactctttcaaggtggtttggtgtaaagaggagagaaataggttggctgccaaggrgtaaagagaattattttctttttactgaactggraacatgtttttatgtggttggatatgatctaatagatagagaagattggtgatgcaggaaggagagtgaaagaattgctgtaggcaagagaagatgggatataatttataattggagggttagccctagctaggagtacaaacagttcttccatagtaacagatggtggagtcaatgggcacagttkctgtgtagatgtgatggtgggagtttgtggaagttttcttctgcttgcttctattttgttagtgaaataagacacaaggtcatcaaatgagatgagggataagggaaaagtagtggatggtttaaggagaaagaaggtatgaaataattatcttggagaatgtcagagtgaatcaactaaagaaatgtgctatgatcatcatgcatcattaaatgcccacataaggttagtgatcatgaatttaaagtaaacttgtcaatattgcctgtattcagctgtgtatggtgacatggagtaggtggagagtaggatttaagcagagttctgatttarccaggcagtattatgaagtaaggttagggcaaaggaatcaggaatatttacaagggaataattatagtggttcatcatggaatttaagttgggttagcagggcaatggggaaatgggtagaggataaagaatagtgaaaggtagtaaatagtagggcatggttagataaagaatggttggagttgaaatactatagagaaggatatctaaggatatataagatctctgtcagattctctgaatctgagccattgcctgcaatttgaagttgttatagtgatattrcatagcatcgtttaagttttagaaacaagttttaagtacacgaattgtgaactccctagacagtacccaaattttagtattcttacctacattatgggctttgggactctaaaaggattttaatattactaaacagaattatatttaacaacaggaactctattgagtgtaatttttaaaaattactattatttaaaggccagtgttaaatgtgtacaaggcagcttagtatagcaggtgagagcatggaccacttagattcagttcatggctttgctgtttattggcagtgtaattttgactaagttaacttaacctctctgtgccttagttttctcagtctataaaacaagragattaataatagatactcacagggttgctgtgatgattatgagttaacatacagaaagcacttaaaatagagcctgacacataaaaggactacattagtgctgctgtagctgctgtggcttattaggatttatactgaattaattctattgttgttttttgcttctttccaagactagcatcagaggtgctatacagagttaattgtcaattactaggggaaaagagttgaatatgttggttattttaaaatttatagcagaatgtggacataatagacaagaaatttgccatatttatgtatttggaattttttagaaaggaaaggtgctgtttgaagaagaatataactttacccacttttcacacctttctgttttgaacaatggcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgagtaagcaaatgtctctatctcttctaatgtgccctaacatgttgaggattgtctaagatttttttaaacctcattttagacacatacctttttcagaagactcattttttttctttctttaaaaatatttttcataaaactgacagttgatttttaatcagatttaatctgacacttcatttttatttgacttggataaaggaatagtgtatttgacttctggttttataagagcaggaggatcaaaaacagttcacgaatggtgaaaaatgtaaagaataaagggtattttgcttggctttttaaaaagcttttaggtagattgtccagcttaatgagatttcaagaattgtcatcatgagtaggagcatattattatccgaattaaatattttcagtcctggagtttgagtttgatgtgttcaggcaatatagttgaatgatgtaggaagaaaatatcactgatcatcagagtaattggtacaaatttaagttcacaaaaaacattatttttatggaaaagcactattaatataatatttatagagatactgattaccatatatattagatcaacctaaaattgtatgttgtttgtactagagaataatattatgcaaataattattggaagttttatcatgaagaatttttatattctcacgtagctgtaattctcatcgtaaagtaatttgcccaaaggtagaatattaatgtagtaaagttacagaatataacaattaartaacggttaaaatatttggatctaggcactacactcaaagaacatatactcagaaatgaatttggagtgggagtcttgaatctgtttcctcagatggtcccaattccgtacccttccaaaagagtgagcgtcttgctataccaaataggattctagtttttaaaagacacggatctttggatgtgtagcgttctttttactatagattgcacattattgatgaggttatacatttatataaacattcatcaccacaattatacaaagcaggtacaaccaggtggtatattcttctttattgacaactttaagggatttgttaagggaaatttagacttttgactttcatgctgactttagaactaagccccaaaataaggtgtagagtcattagaagtagctaaaatatctttaaaaacagattatgagacatttaatctgacagtacttcaccctgcaaacagggctaagttagtaaattaaagagggagaatttataaaaagaaatatttttatagtttaatatatgtaaatggatgaaagatctaaatgtaagacctgaaactataaaaaggaagaaaacatagggaaaaagctttacaacattggatttgccaagggctttttagatataacaccaaaagcacaggcaacaaaagccaaagtagacaaaaatggactacatcaaacttaaaaatttctgcatagcaaagcaaacaatcaacagagtgaaaaagcaatatatagaataggagaaaatatttataaaccatatatattataaagggttaatatgtagaatatagttaaatatttgctgctagataaagctgtttggtttggtataaccagtatggttgatctgtattactgctgctgttgaaaaatgcaactgtaagaaaataatgttcatataggtctatagactttagttcttatgttttgggaatakcccctatggatatttcttttcattggaaaattttgggtaaaattttagcaaattgcctacatctgctgatttagcaataaaattttggatcatgggaacctaagttaagcttttctcaagtggcagtttttagttgggtttagcaaggtattttcgtgttgttgttgttmttattgttgtttcctaacaatctatgtggctcctaggcccctgagttctcatcctttgcattttctaaaatttttttttaagcaaaaaacttttaagtttggggagattatttctctaatagcatgagtaatatagactttctagagataatctcacttttttctacagaaataagctattattcagcatattaaaaastgttttggccaggcacggtggctcacgcctgtaatcccagcactttgggaggccgaggcaggcggattatgaggtcaggagatcgagaccatcctggctaacatggtgaaactctgtctctactaaaaatgcaaaaacttagctgggcacggtggcgggcgcctgtagtcccagctactcgggaggctgaggcaggaaaatggtgtgaacctgagaggtggagcttgcagtgagccgagatcgggccactgcactccagcctctgtgacagagtgagactctgtctcaaaaacaaacaaacaaacaaaaaagtgtttctatcacattctaccagctagtattatacctggcagtggctgcakagctctgcaagtagctcagcggttacaaaagatatagaagatgtgagtaattccctgaaaccttattggcttcatttcctaagagtggtcaaggtacagattagtgagtttatttcatgttaaacacactcaggaaatataacttgtttacattcattgttactaattaataacagttaattacttcagttaagtatgacatggtattccaataataactttaggcaagagaatcacttgagccgaggagttcaagaccagtctaggcaacatagccaggcctctctctgcaaaaaaaattttttcagttgttaggcatggtggcacaygcctgtagtcacagccacttgggagcctgaagcaggaggatcacttgagcctaggaagtcaaggctgccgtgagctgtgatcatgccactgcactccaacctgtgcaacagagcaagactctgtctcaaaataataataataataataacaataactttaatttacattttattcccttcctatgtattttcttccatgactttttctttctttaatatccttgtatgtcagatatttaaactaacactgtttgtccactaagcaatgagatagtttcatttcggcgttagtatctgctgcatggtgacctggtctgaaactaactgactatgacatataatgaaattaaacagatactgctctctaaagtcatctttggcctatatcataaaatgaagcaggggcaggatatttttattcctcccttttttcctgtgtggatcatgctgatgaaaacttagttttgtagagcagagtttaactatacctgttgtttttacttgcatgtggcagaaacagccactttaaaactctttgttttattttattctattttattttaaagagtccctgagggcaggagctctatctgatgtttatttatctttatattccagcttcccacacagtacctacgtatcacaggcacacaagaaatatagtactttttgaagggaagaagaaaggagttcagccagtgagcaaacaaggttttcagtgcagtattgttggctagataatgcacagtatgtggctatgcgcccaccttttgaaacatttttaactgcttaaatagtgtctgttattccatacttggcattttaggccttctttaaagtctcttgattctcaagttagtgcctctagcattaccattcctttatsgaaattttgaagtagactgagaacaatagggttaatgaatgaatctgaggaatacaaatggagcctgttggagattaatgttcaaacatcatatgtcttttagtcacttttaatctttacttttgaaataattttctcctcctttattttactgtttctaattaaaatctttattctacagccacaataccaagacaaccacctggttggatcctcgtctttgtaagaaagccaaagcccctgaagactgtgaagatggaggtagagattcagaaacttactctatcatacttattctcttaatcctttcttgctcttcttgctcagataatgggtttttcaaaaccctaaacaaaccataatgtacacaagcaaaaaagcagtgggtggatatcataatcaactgattgtggtaattatgtcattacatctaactttatgagagatttcatttctttttcaggattacataactctctataaaaaataacaacaacactaaaatacatttgcccttttttgacatctgtcctgaagacagacttttaaaattctaaataaatatttaaaaattaggcacatcctcaaccataagctaggtctatcatgtcttatgaagtttttaaagtatatttaatttagtatacattacagtagatatgcaagtatctatagctattcttagccatttacagcagcagtagaaattcaaggaaagtctttaatataggcccccacacatatacacacttactttttactgcttaaaggaaaaattatttctctaagaatcatcagataatagcacttatctgtcctatatattataggttatatttaacagtgtagttttgagctgggtgtggtggcacaaacctgtagtcctaaagctatatggggagctgaaatgggaggattgcttgagctcaagagtttgagatcacagtgagctgtggtcatgctactgcactccagcctgggcaacagagagagaccctgtctctaaaaactaataaataaacaaattgttaaaaagagtagagttttgtaaataagtatagaatttattccatccaaaattgtttgctatgtctttaccttaggagatgaataaaatttgcatttttgtattactaatcagaaactatgtattaattggttttaaaaaataagtggcgtaaaatgaggttcacagtagtcctccttgtattgaagtccaatctataaaaagaaattaaacagaatttccacatatattgttcagcatgattataatataatattaagagttttctaggaagaagcaatcagaaaatggaattgtttaaaattccctctacaatggcatcaaaaaagttagatagcttgaaacaaatcttctgaacaatgtgcaagttctcaacactaaaaactacaaaacataattgaaagacataggaagacttaaaataattgacaagaggctgggcatgatggctcatgcctgtaatcacagccaaggtggatggatcacttgaacccaggagttcaagaacagcctgggcaacagggtgaaaccctgtctctactaaaagtacaaaaactcactgggtgtggtagcatgcgcctgtagtcccagctactcaggaggctgaggtgagaagatcrcttgagtccaggaggttgaggctgcggtgaaccatgatcacgccactgcactccagcctgggtgacagagtgagaccctgtctcaaaatactaatactaatactaataataattgacaagatatattctgttcattagccaaagaaccttaaaaaaaaaaagacaaagttggaagacatagggtaccagatctgaagacttattttagagctacagtgataaagacagtttggtattggcataaggatagataaatagatcagtggaacaaaatagagagtctagaaatcaatacacatgtatgtagtcactttattttcaaccaaagtgccaactgatatggaaaaatgaacctcaattatgcctcacttcatacaaacagttaatttcagatgaatcaaagacctaagcataaaagctagaaccacaaagcttttggaagaaaatataggagagtgtcttcatgagtcagaattggcaaagatttcttaaacaggccacaaaaaatatgaaccatagaagaaaaagttaatattttgcatgtaatagaaattttaaaattctcttcatcagaagacaccattgaaaaatgaatagacaaagtcacagactttgcaatatatatttgccaaaggaattaaattcagaatctataagaactgtttacaactcaataatattgccaaattttaaaatgggcaaaatatgttaataaacatttcaccaaagaaaatatacaaacagcccataaaaacatgaaaagatatttaaaattattaatcatkaggtgttttgcaaattaaaaccactgtgatctactactttacacccactagaatgagtataacaaaaaaaaaaacagatggtaactaatcttggggaggatagggagaaacagtaacccttgtacattgctgtgccattggaaaatggtatagccactttggagaacagtttggcagtttcttaaaaggttaaatataaatttaccatatgacctagtaaattttctcctaggtatctacccaagaggaatgaaaayaaaagtcctcataaagacttgcatgcaaatattcatagcagcactattcataatagccaaaaagtggaaaccacccaactgtccattaaccaatgagcagataaatcaaatgtgctataacctacaatggaatactattgagcaataaaaaggaacaaaatactatacatgctatatgtatgaatctcaaaaacatgctaagtgaaagaaattagacataataggccagatattgtatggttctatttgtatgaaatgtccagaataggcaaatctgtggaaacagaaaataggttactggttgcyttgggctaaggataagaatagagattaactgttaacagcatgaggaatcttcttggagttatgaagacrttttaaaactggattgtggtgatggttgtacaattcagtaaattattaaaaattattgaactgtatacttaaaacagatgaattgtatatatgtaaattatacctcaataaagttgtttttaaaatggccaaaggacttatgcacttcacaaaagaagataaaagaagagtcaagaagaacatgaagaggtgcttatcattagttatcactacaatgagataccatcaacacccactacaagggctagagataccatctacatcctttagaaggactaaagtacactgacgctcagcagaaaccttacatgccagaagggattggagttctatctttaaccaccttaaacagaataagtgtcagccaagaattttgtatccagcaatactaagtttcataaatgaagaagaaataaagtatttttcagacaagtaaatgttgaaggaatttgacattaccagatcagccctacaagatatggtaaaaggagttctaaatcttcaaacaaaaagttgatatgcaccagaatagaacctcttgaaagcatgcaacttacaggactgccaggcacggtgggtcacacctgtaatcccagcactttgggaggctgtggtgggcggataatgaggtcaggagttcaagaccagtctgaccaacatggtgaaaccccatctctactaaaaatacaaaaattagccagacatggtggtgggcacctgtaatcccagctactcaggaggctgaggcaggagaattgcttaaacccaggaggtggaggttgcagttagccaagattgcaccactgtactccagcctgggcaacagagcgagactctgcctgccatccccccaccccccctccaaaaaaaaactcacaggacctataaagcaatagcgcagtaaagaaaacaaagtactaggtaacaatcaacatgatgactggaatagtaccttatatctcaatattaatgttgaatgtaaatggtctaagtgctcacttgaaagaagaagattggcagaatggataaaaattcacaaaccaaatatctgctgtcttcaagagattcatctaacacataaggattcctatagactcaacgtaaaagagtggaaaaagatatttcacacaaatggaaactcaaagtgagcaggagtagctattgttatgtcagagaaaacagattttaaagcaacaacagttaaaaaaaaagacaaagaaggtcattatacaatgataaaatgatcaacaagaagatattgcaatactaaatatatatacccctaactctagagcccccagattcatgaaacaattactattagacctaagaaaggagatatcaacacaataatagtaggggacttcaacactccactgacagcactagatagatcattggagcagaaaatcagcaaacactggacttaaactacactctagaacaaataaacctgacagatatttacagaacaattctaaccaagaactgcagaatatayattcttctcatcagcacatggaaccttctgcaaagtagaccatatgataggccacaaaacaagtctcaataaatttttaaaactcaaaatcttttgtgggcatttagtgctataaatttccctctgcacactgctttgaatgygtcccagagattctggtatgttgtctttgttctcgttggtttcaaagaacatctttatttctgccttcatttcgttatgtacccatgcccacaagagaaagcaggaaagagccaaaattgacatcctaacatcacaattraaagaactagaaaagcaagagcaaacacattcaaaagctagcagaaggcaagaaataactaaattcagagcagaactgaaggaaatagagacacaaaaaacccttcaaaaaattaatgaatccaggagctggttttttgaaaggatcaacaaaattgatcgaccactagcaagactaataaagaagaaaagagagaagaatcaaatagatgcaataaaaaatgataaaaggggatatcaccaccgatcccacagaaataaaaactactatcagagaatactacgaacacctctacgcaaataaactagaaaatctagaagaaatggataaattcctcgacacatacaccctcccaagactaaaccaggaaagaagttgaatctctgagtagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaactgaatccagcagcacatcaaaaagcttatccaccgtgatcaagtgggcttcatccctgggatgcaaggctggttcaatatacgcaaatcaatgaatgtaatccagcatataaacagaaccaaagacaaaaaccacatggttatctcaatagatgcagaaaaggcctttgaaaaaattcaacagcccttcatgctaaaaactctcaataaatyaggtattgatgggacatatctcaaaataataagagctatctatgacaaacccacaaccaatatcatactgaatgggcaaaaactggaagcattccctttgaaaactggcacaagacaggggtgccctctctcaccactcctattcaacatagtgttggaagttctggccagggcaattaggcaggagaaggaaataaacggtattcaattaggaaaagaggaagtcaaattgtccctgtttgcagatgacatgatagtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacatgaaggacctcttcaaggagaactacaaaccactgctcaatgaaataaaagaggatacaagaaatggaagaacattccatgctcatggtaggaagaatcaatatcgtgaaaatggccgtattgcccaaggtaatttatagattcaatgccatccccatcaagctaccaatgactttcttcacagaattggaaaaaactactttaaagttcatatggaaccaaaaaagagtccgcattgccaagtcaatcctaagccaaaagaacaaagctggaggcatcacactacctgacttcaacctactacaaggctacagtaaccaaaacagcatggtactggtaccaaaacagagatatagatcaatgggacagaacagagccctcagaaatagcgccgcctatctacaactatctgatctttgacaaacctgagaaaaacaagcaatggggaaaggattccctatgtaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatgagcaayaaaagccaaaattgacaaatgggatctaattaaactaaagagcttctgcacagcaaaagaaactaccatcagagtgaacaggcagcctacaaaacaggagaaaatttttgcaatctactcatctgacaaatggctaatatccacaatctacaatgaactccaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaccacttttacaccgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacaagtatgtttattgcagcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgtatattctcactcataggttggaactgaacaatgagaacacatggacacaggaaggggaacatcacactctggggactgctgtggggtggggggagtgggaagggatagcattagatatacctaatgctaartgacgagttaatgggtgcagcacaccagcatgtcacatgtatacatatgtaactaacctgcacattgtgcacatgtaccctaaaacttaaagtataataataataaaattataaaaaaaactcaaaatcatatgaggtatcttctcagaccacagtggaataaaactagaaatcaactcctaaaggaaccctaaaaactrtacaaatgcatggaaattaaacagtctgctcctaagtgatttttgggttaagaacaaaatcaagatggaagtgttaaaattatttgaaatgaatgataatagtgacataagttatcaaaacctgagatacagcaaagcagtgctgagaagaaagtttatagcactaaattgctacatcaaaaagtctgaaagatcacaaattgacaacgtaatgtcacacctcaaggaactagagaaacaagaacaaacccaaagttagtggaataaaagaaataacagaagatcggagcagaattaaatgaaattaaaacaaacaaaaacagtaggccagatactgtggctcatgcctataagcccagcactttaggcggccaaggcaggcagattgcttggtaatttgagaccagcctaagcaacatggtgaaaccctatttctacaaaaaatacacaaattaaccaggtatggtggtgcccacctgtggtcccagctgctccagaggctgaggtgggaggattacttgagcctggaggaggcagaggttgcagttagacgagactgtcccactgcactccagtctgcgaaacagaacgagattgtctcaaaaaataaaaaaaatcaaagtgtgtgtatgtgtatgtatacacatatatatatatgtgtatacatacacagaagatcaaagagacaaaaagctggttatttgaaaaagatatacaaaatttatagaccattagctagattaaccaagaagagaaaaaattcaaataagcccaattcgaaatgaaaatgaaaatgaaatggaaatgaaaatgaaaatggagacattacaacaaacaccacggaaatacaaaagataatttgaggctactatgaataagtgaaattgaaactgtgcacacaaagtagaaaatctagaggactggataaattcatggaaacatacaaccctcctagcttaaatcaggaataaatagaaatcctgaaccaataactagcagtgagattgaatcagtaatttaaaaattgccaacaacaacaacaacaacaacaacaacaaaaagcctgaggccaaatggatttacagccaaattctaccagacattcaaagaataattggtatcaatcctactgaaactattccaaaagattgagaaagagggaatcttctctaactctttctatgaagccagyatcaccctgataccaaaaccgggaaaggacctaacaaaaaaataaaactatagaccagtatccctgatgaaaatagaaagaccccaaaagcaaatgcaacaaaaacaaaaataaatgcgacctaattaaacaaaaaagcttctacacagcaaaagaaataatcataagagtaaactgacaaccttcagaatgggagaamatatttgcaaattatgcatccgacaaaggaccaatatccagaatctacaaggaactcaaacaagtcagaaaaataaataaataaaacccaccaaataatgccaccaaaaggtaaaaagtggacaaattacatgaattggcatatctcaaaagaagatacacaaatggccaacaaacatatgaaaaaaaatgctcatcatcagggatgcgtaaattaaaaccacaatgagataccaccttattccagccagagtaataagtcaaaaagcaatagatgttggcatgggtgcagtgaaaagagaacacttatacactgctggttggaatgtaaattagtacagcctctatggaaaacagtatggagcattcttaaagaactaaaattagatctaccatttgatccaggaatcccactcctgggcacctatccaaagaaaaagaagtcattatatcaaaaagacacctgcttatgtatgtctatcatagcataattcataattgcaaacatgtggaaccaacttaggaaccaacctaagtacccatcaaatgatgagtggataaataaaatgtggtattgccaggtgcattggctcatgcctgtaatcccaacactttgggaggctgaggcgggcagatcacaaggtcaagagatcaagaccatcctggccaatatggtgaaaccccatctctactaaaaatacaaaaattagccaggcatggtggcatgcacctgtaatcccacctactcgggaggctgaggcaggagaatcgcttgaatccaggaggcggaggttgtggtgagctgagatcatgccactgcactccagcctggcgacagagtgagtctccatctcaaaaaaaaaaaaaaaaaaaaaaaaagagaagaaagaaaatgtggtatatatataccatggaatactacccagccatgaaaaagaatgaaataatgtcttttgcagcaacttggatggagctggaggtcattattctaagtgactcaggaatggagaaccaaatactctatgttctcacttataagtggcagctaagctatgggtacacaaagacaaacaaagtcgtataatagacattgaagattcagaagggaggagggtcggatgggggaagggataaaaactacatattgggtataatgtacactacttgggtgatgggtgcactaaaatctcagatttcaccactatacagttcatccatgtaaccaaaaaccacttataccctgatataaatatacatatataatatataatatatgtaatattatttttagatatagtaaaataaaatatactgacaataccaaagattaatgagattttagagcaactagcattttcatttattgtgagtggggacacaaaattacctgaacattttttagaacttttcacagtttcctatgaggtaatatctaaagagaaatgaaaacatatgttccccaaaagacttaactagaatgattatgacagcctttctcttaatagctcaaacctggaaacatcccaaatatctatcaagaagagaatggataaaccatttgtggtatattcatgcaataaaatactactcatgagtaaaaagaaaaaagtgttgataacactcaataatatggatgagtctcagaaacatgttgtaaaagaaaccagacaccaaagagtaggttctcaattactcattatttaaagcttgagaacaggcaaaactcatgtgtggtaatagaaatcagaaaatgactggggagagtagaagtggggtaaagtgagataattccctggaatgctatattctccatctcaattgaggtgacagttacacaggcatatccagttgccaaaacccactttttataattgaacaagcactcgattttttttttccccgagacggagtcatgctctgtcgaacaggctggagtgcagtggcgcaatcttggatcactgcaacctctgcctcctgggttcaagcgattcttctgcctcaacctcccaagtagctgggactactggcacatgccaccacgcccagctaatttttgtatttctagtagagacggggtttcaccgtattggcgaggctggtctcgaactcctgacctcgtgatccgcctgcctcggcctcccaaagtgctaagattacaggtgtgagccactgcacccagccagattttttttttaccattaaaagggcacttaagagttgtgcattttattgtttgtaaattatacctcaattattattctttttttgagacagagtctctctctgtcacccaggttggagtgcagtggcgcaatctctgctcactgcagcctcctcctcctgggtccaagtgattctcgtgcctcagcctccccagtagctaggactacaggctcatgccaccatggctggctaatttttgtattttttggtagagatggggtttcatcatgttggccaggctggtctgaaactcctgacctyaagtgatccacccacctcaggctcccaaagtgctgggattacaagtgtgagccaccatgcccagcccaagaaataatttttaaaataatttttataccrtagttgtttataaagctttccatagtaagttccttcttatggtgaaatcagccattctaaaggcaaactagaatatataatactatagaatttgactttttttattgtgaacatggtatttgtcttctagagcatgtcccttttactggcttccattctttttcctggtccctaattgtttcagttcagttttctgccttttcttgttttcttttgtagaaagcatttattctcatagctttatcagtttactatagcctgccccattatcaaaatctctagtattgtcctttgttctgaattatatttctgtttcctcttgcttttgagtctttgttttgatttccctactaatacttcaaataagcttatttaaaactaaattgacatctttctcctaatacaacccgtccctctttctgtcatatacgtaccattctcataatcatctatgccaaaatctttgcaattatgtttgcctgttcctctcttcttgctctacttcctgatttagttttcacgtcctgttgctttttcttttttctctttttgccaatatattattatgcaaaagtttcaacatataggaaaatgaaaagaatcatacagtgaacatacatatgcccaccactaggatattacaattaacattttgctacatttgcttcttcacatgattattcatttattctttctctatctgtgatttttcttttatattatatattcctttccattctcctaatcactacacacttggattattcttggtctttcttcctccagttatttctctctctttaatacatcttttatgccagtggttttcaaaatgatcatactcaaactatctactggtacccagtagaawatattagaactaatttttcataatgttgttactgaaagaaaaagaaacaaactaagcttcactactattttacatacagattggtaatggcattcttactgattccgtatgtcggattatcacatactctaaccagagtgccttgagggaggratggatgagacacctttgctcttttttcaaggacactgtgaaattttacagttgatttgtgcccagttaagtggatttatagactagttatatagtttttaaactaacctcacataaaatggaaatgtcactttaaaagatttctacaaaaacactactgattgaagatgatacaaataggcaaacccagactaatagcaagaaaatggaagaaccgatactgtttgtgtatcatatatgaccatatataagcttttttcaacttcaaggtaaaatcatgataattgcttgtttaatcacctcctttaaaaacatctatttttgtatatgttttattatatacatattagaagaggggcagatgtcagattttttactaaaaaggctacatgatcaaaaaaccttggagatattatgtaagaccaaattaatctttctaaaactaattttctatctatctctcccttgctgtccattgtcagcagagtaaagtccagactccttggttaagtattaaagattttttataattgaatcatattctatatttatttttcaaagtattctcatgtcataaatctgacatatttttcgtctttgccatatacccatttcttctgccaggaatcagtcttgtttcctgtgtctacctggctcatacctattatccttcgaagctccaatctaaagtataatttctttgtagccccttctgtcattttcttgcaagtcagaagtagacgtcctctcctctgtgctcagtagtaccatatgacatgtctctcttgtagcagttatattgcattgtaactagataccacactcagagcaatgatttttgacacattcatctgtatatcctttcagtagagacttcaatgtttgaaaagagggaaagagggaagagagggagggagggaagaagggaaaaggaagagaaagggaaaaaaagaaagaagctactctatcctccagattattttggtcgcccttttggaaatacttttcaatctctataaggctctgaggggccaataaataataagcccgtcttcattcaccagtttatagtcaatagagaaataagacaccagagacagacagatgaagtcagaatgtcagcaaatgaatgttagccctgcatgtacatggccttgctgttattttacccctgcaggagggagacatgagtacttagtctttggcctctgtgttcaactgcaagcctcctcccaacgggcagacatggcagagaacagaccagaatacgcctctgcaggcaggctgttaaccaaaacagtgagagaactcaagagtccctgagccaagcatattgagttcattgtgtaaaactccccagtcagataagacattctttcttccttggggaagaaagtgaaggggctccgagaaactggaaatgttcctcccattctttattctctaaggaatttgaagaattggatgaacatttccccctaatgctctttacattaaggctgaacatatgtcttggttggcccaggactgatccagctttttcctgttgccccaacataattattaatagtatccccttttattctcaaaagtggacagtacattttatgatcatcctaagtatatttttcttaaaatagaatgatcaaaattgcattcagtattctgggaatgtttgaaactctttaatatgggctactctcccacttacaaaactgggtacacctttttaacattgcctatacttatcttcgggggagcctacaatttagaacattgagtctatttgttttatgctcagccagccttttccactttcctctctacactttgtctccccacgtaatagccccacggaagactattttcaggatgaactatgtgtgattcatattagtattctctgcagtgctttgcacagagtagatgctgaaaagagaagaataatattttaagtgtaggttttataggttaagatattgtttacattctgctgaacatttaagatcttctagaaagaccttacagtttctaaaacatgcccttttcttcccagtcttctgatattctgaacacagctgtgtattcaaatacagtgtaaggacacagcttgaacagcttggtttaattgatgtacattttatcttctattcaaataaaatagtgttttggttaggtagttgtcttgaaaatacaacattaggaattcgttttaccctcaacccatcccatttctcttatgatgaaagaaagattaaatttttgctaaaggcagcttacaaatatattgaatgttgatatttcagagcttagagaatgattaaaaaaattatcaactgaatagagctccaccatgagaaaataattgtaattcttacatttaaacaagaaaaatcctatttggggaagaggaaagaaagataaattcatgggatttagaaccaaccagctgcttgatatgcccaaaatagttttgtcttttgaaatagctttttaggggaatactttggcttcatacacaggaaaagatggttaggttaggtctttcctgtatcaaaaataaacaaacaaattttctcttggccctaaccctccccatagtttttatactatcttttccacaagcaaatttttgttttaagtcatctattcttaaggactctacttcgtatttttctcttcagttactacagtattctgacttttgcctcctaccttttcagggttaccagtaacctcctgatcttatagactctttttagcccttatctttatgcctaacagctttacaaagcgtttttttgtttgtttgtttgtttgtttgttttgagacagagtcttgcactgttgcccaggctagagtgcagtggcgcgatctcggctcactgcaagctccgcctcctgggttcatgccattctcctgcctcagcctccccaacaaagcgttttttaatgctgaccatgcccttcctcttctgtcttcttttacaccattccccctgatgattcttactttctccatctgccgcttaaaatgttagtgctcctaaggttctgttcttcacctttctctgctcagtttatctaggtaatcatgtctgctgtcatagctttaactacaatgtctctcaaatctttatcttcttatatttctctttggagtaccgggttcatacggccaagagcttgttatttatctgtaccaggatgttctacagatcactcaaatgtaacaccttcccttcctgccttcaacagatatgacatccccccagctgcttgagccaaaaactggttgtcatcctcgcctttccctcactgtctcctctctgttgcagttaactaccaagttctatcaattctaacttttaaaaacctgccattcgggtggatcacgaggtcaggagaccaagaccatcctggccaacatggtaaaaccctgtctactaaaatacaaaaaattagctgggcatggtggcacgcacctttagttctagctacccgggagactgaggcaggggaatcacttgaactggggaggcggaggttgcagtgagctgagatcatgccattgcactctagcctggcgacagaggaagactccatctcaaaaaaaaataaaaaataaaaacctgccatttcttgagtgtccattggtggtagacacattactaggcacttttaatatatcatctgtctcctaaattcctctaaatccacattaatttctaatttctattcccacagccattttcataattattcttttttttttttttttgagacagactctcacactgttgcccaggctggagtgcagtgatgagatctcagctcactgcaacctccacttcctaggttcgagcaattctcctgcctcagcctcctgagtagctgagattacaggaacctaccaccacgcccagctaatttttgtatttttagtagagataggggtttcaccatgttgctcaggctggtcttgaactcctgacctcaaatgatctgcccacattggcctcccaaagtgctgggattacaggcgtgagtcaccgtgccggcccattttcataattattcaataaatatttgataatgtatcacttttatgccacaaaagctagaaacctgggaatcatctttgcctctttcctcccttcccttcctcaatcctcatggtagtcattaagttctgttactttaccttctttgttttattatccattctactacccctgccttagttccagtcttcacaagttcttatgcagtctattagtgtttatcttatttgtctgcctttattctcattgcacaccatctatttcgtcctttattactgcttcccataatctttttcaaatataaattaaatcatgtcacagttcaccttaatcaattctctatcatcgtcaaaataaagatcaaacttctcaacacagcactctaagaatgttggaattttgtgcttgttcataaaattcatttccctttgcatacaactttcattctagtttaccaaattatttgtaattatggaaaataccaagcattcttaatacctcaatgccctttaatctatctggaatcatctccctctccctaatcccaacttatttatttatttatttatttatttatttatttatttatttatttgactcggtctatcaccaggctggaatgcagtggcacgatcttggctcattgcaacctccgcctcctgggttcaagcgattctcctgcctcagcctcctgagtagctgggactacaggcgtgcaccaccacacccagataatttttgtatttttagtagagacggggtttcacaatgttggccaggatggtctcgatctcttgacctcatgatccgcccgccttggcctcccaaagtgctggaattacaggcgtgagccaacttatctttaaagactgcttaaacatcagcttttagcaggctttcctgatagcaatcttaccaggcaattggtattcctctgcactccccaaaaaagattatgtttatctttatcttatcatttatctcttctgtcttcctgtctagactataaactccttgaagtcaagaactgggttatatttctaatttttatttctgcataaggatgatggggagaggaggatgagaagggaggaaggaaaaaagaaataaaatgaataaatgaattgatccactaaatagtgtataaagttgctaggtattttagtcttgatttttattaccttcactttaaatgagcaaataataaccacttctttatctgtattaaattgccctgtgtgaaaacaaaacaaaaccaaacaaaaaaaaacttgctaatggtatcagtggtaaaggtgtaaaattaataaagtaacccagaagataaatggctgcatttgtttgccctcctaaagaaaggactgttaatctcttagttgctaattaccttgagtgctaactaaaatgctaaatsaactttcaagttaagattaaaatatatttatgttgatcttttatccttactattagtacatcccttttagtgaatttttcagatatcaaatggactatttcagctatttctatagtccttaatttctccaaacttctctaaagacaaaacataaatctaattgtggtacagttgtagaattcctccttactcagctctattcagttcccatgctatttcaagaaaatttctattaaagaaaaaaatatttttcatggaagatccataactgttatagtgcagttttacagatatattcaaaaaaattactcttatccatgaaacagttgtttggcgataaaatattatatctatttgatagatttgcttcatagctaaggaggattaaagtgaactaaagtacatctcagttctttttaatgttttgttctcttctcacatatttcaactattttagtatttcatttgttctcatctttcccacctgagacatttcaaccaggtccttcaaaggaaaaacacaaaaactcatcaaactttgaaaccaccaatcaatatatatgcagaaaagtatggtggagaaatggggtaggggtaattcagacattttcaccaggaggctagtcatctgttcttttcttatattctgaatgcagaataataatttttcttagagtaaaacagtatagcttgtcaagtttattataatggaatttttacttacaaagttggtatgtcataactgaggctaaatgatataaaactaataagtcttgtgatgctttctaaacctgtttgctgtccagcgtactttttgtgtgtgtgtctttcagcagagcagaagcattcttaagagaaattgaaaataaaagcgtgggacatcatagtgcacaacagtggacttttaaaaaaattcttttttgctcaactgctatataaaatggataggactagaaccacctgctaggaacattcttcccaacttatccatgttttactaataagatggttcttcagaaaccttaactttacaaggaatgcagacaaagtgggagggaaaagattcacattcacattgaaaagctcatgtcagttcatgttgaaaaggctagagatttgttttaactttcagaaattcaactaccttcagtatttctggttatattttattggtcacttactgagaattagtaatatataaaaatgctatgtaaggtatttatttgttatcattcacaaatacagattacacaaagcactgtggtagttagattagtgttccttcagatactcagatcttgttcaccaagagaaagcaggtacttttgtaggttttaagcaaatctagattgctcacttgaaatgacaaaagtccaaggctagggtttcctttgaggagaagtgggtctgaacataacatcaaaaatgactatgtataatagtaaaaaattgaacagatacctgcttcttctattggactacaagggtaaatatgtcttgtgtcagcatgatcaaggtttttaaatgaaagaagtacacagtaatttttattagcatttttatggcttgtggttcatatgaacacctttttgtttaatgccatcttctgttctrggcttctgattgcttgctgaaattctcactggctggtgaagaagccactcagacttaaattgtgtttgttccttgaaagtgagccctcagctttctgacacccaaatattagtataatgaaataataaattcactcactggtgaattcttttctgtcagttttgaatctggcatttcactcaattttctttatttacagagcttccttatggctgggagaaaatagaggaccctcagtatgggacatactatgttgagtaagtttgttacctcagttaatattctcccaaatattttcctttyagcatatagctttagagaatactggatacagcactttatgcttctgtgatccagctgttgagtttttcaactaggggaatgaaaaggtaggggcagtgagcatttgcttcattsaccttgggcttcctggaagttggctttgaatttctaaatatagagaataagggggaagttgcctagacaattaatagctagagatggtattgttactactacagcctctaaagagaaagtcagttgatagaaaactgaaatgagggcaacagactagatgaattatcaaggtcatttccaacactaccactgtatccttctgaaagcagtggaagatctttagggcattataacataattatctgaagttttgaagcatacacctaaaggtgtgctctcttttaaggagttattcaaggaaaacttagtattctttttaggggtgaaagttgcttcttaggcagctgytatggttaaatttaaacataaatatatattggagaggagtgccagacacctgcctatgttagccagagaaattaagctaatatcaatgtctaattttgccttctcttttctttatctaattgctacaatgttatgaccattgggattgctttctttccagatgctaaacactgaatttgacctcaagcgtctagcagcaggcaaatacttctatcagaaacattactatttacctggagactaggagttaaacctgctgcctaggtagcaaagacaaaatgttattattacctgaaaaagtaacaaacacaatcatctttaattttataattgtttcttaatgtttcaacacttataggcataaaccaatgccatttcctggtagttatccctaaagtaagtatctctgactcctgttgcaactgtagtctttattctattgtgcaggttgttacttgagtcactgtggttagagggatttttggaatgacttcttaaaattaaatgtgtctcctaaggaaatgactcaattagattgacacttaagtatataactttagaatttcaatatcttggttcctttgaaagctatgctaattttgtttccattgtgttacttaatgtcttactgatactgtgatgtaaaaagtatacagcagctcttttattattattttttcctaagacttattttgttaaaggaagaaacaaccatttttcacatcaaaggagtatttgggggccgactgaaaaggttttgcaggatttttttcttcccctcaaagtttagtctatttaaattgggctctaatcagctatttgccattgacactgctgaacatttctgagataatgattctcattctctttattatccattccaagtgaatttgaatacatggtcaaaaggtgaaagtcatttgcctgttataaaaccttgagctgaatgatctggtccccattatgcaaagatataatattaaagcaactttagggcaaatcctgaagcgacctgctcctagttgtcagggaggtacatgaaatagcctgaattagaagcaacagcagcagcgacatgattttgtatgattattcccagaatgagctcattttacaggagggttttgtattagactaagaaggagcagactgtactcaagatgcacattagtatggagtcagctgagctgtggagtgtggcttgattcccagattagttaggttttgaatctcgaccatagtaatctgcagtgagtttactgatggagataaaaagctgttacttgaatggctactctttggctctcttagtttgtcaaaccagatggcacgatgattgctcttggcaggagccttgtagtagtaacaccaactgcagtggtagtttttctttgtatttattttagaggatgggattctgaaatggatgaagttattttttaaaataaaatttttccaaaaatgtaatatgcttataatatgcataaatataaatatgcataagctataaatatgcttatatatttagaaatgcggtcttgattatattgcattacatgtctttttaaaattaacatataattatacacattttgggggtacgtagtgatgtttcagtacacgtaatatatagtgattagatcagggtgataagcattaaatgtcttgatgcacctagatgacaaagtcaaaatatatacttgctttcacaactaaaacttttttttttttttttttgagacggagttttactcttgcccaggctagagtgcagcagcacgatcttggctcactgcaacctccgccttctgcctcccaggttcaagtgattctcgtacctcagccccccagtagctgagattataggcatgcgccaccacacccacctaattttgtatttttagtagagatggggtttcaccatgttggccaggctggtcttaaactcctgacctcaagtgatccacccgcctcggcctcccaaagtgctgggatcccaggcgtgagctaccatgcccagccatctaaaactctttatgaaagaatattttgttgagataaatttttaaatccagatattagacataaaattttaatacagaaaatgtgtcaaattgtgtactaatatttaatcattcttgtttgctttgtttctttctgataatctgtaatattctcctctcttatttcccacagctagttatttggaaaacaaaatttgttgtgtcttaataatagtgtaggtataagtaattaaatgaaaaggacagtattttcacttttttattttttgattttttttgagtggcattttagtctagatagtctaagataatgaagacaataacttccttcagtaaatcttatattcttttgtcaaatttttaggaaaaggattactcatttgcatacgtctactctcctctcccacacattacaaagggtataaatacaaattactactttttatgttctaatgcctgggtggcaaagtgagtcattctagccaatgactttaaagtgaaagtgagccaaggttctttctgaacaggtttattcttttctgagtgtcaatttttagttgtttttcaaaagaatatgtaaaatatcagtacctaaataaattttttaaagtagttcctaggatttttattttcacagagttaaacagttaactcagtggacagtgtatcccccgcatattatgaagcagaagcatacttgagtgtcagtgaaatcagaacccaaacaatgtccagtggcacttaccatatttagagctcttaaactatttaataagtaactacgtctgttgtggaactgatatgtagtagtagcctgagtgacatggagaaagctaacattcctttttttgaaagtgtttttttaatttttaaatttttattttagtccctgctgcccatttctctaccaccactcttaatgtttacaaatggcaaagctccagcrtggacaacatagtaagaccccatctctacaaaaaaaaaaattttttttaattagctgggcatggtggcacacacctgtggtcacagctactcaggaggctgaggtgggaatatcgtttgagcctgagaggttgaggctgcagtgagctgtgattggaccactgcattccagcctgggtgacagaatgagtgcctgtctccaaaaaaaaaataaataaagaaataaaaaggcaaagtaaatgttcaacttgtgtgactatttatatgtacattttgtaatattcagtctacctaaaaacaatcatgttctgaaattctcatgatttggtatttaattgttggtgttcactcatatcamctctttatttttattttttattttttttgccgtggagtttcactcttgtcgcccaagctggagtgcaatggcatgatctcggctcactgcaacctccgcctcctgggttcaagtgagtctcctacctcagcttcctgagtagctgggattacaggcatgcaccaccacgcccagcttatttttgtatttttagtagagatggggtttcaccatgttggccaggatggtctctatctcttgacctcgtgatctgcctgccttggcctcctaaagtgctgagattccaggcgtgagccactgcacccggcctcacttctttaattaaagtggaaaactgtagcatatgctgaaatatatttgtactatggaagtgttagaatatgatttccattgcttctgaattagacctattcgaggtcctaaacatcttttttacagcatttcctttcttaaccaactccacttaactggcttgccagaagaatagtgctctttttcttctgtaaaacatactatcgcccatagcgtgttgaatagtttggctaatctcctagcggctagtctccccaggcttcctgctttctctcagagagttgtatgcattccaagagtcagtagtgaatgttcccaaatcataaatgccagttgaacctatgttataattattcatttaattatgatataattatgaagaaatttaagtgtgaaagagttattctatactatagttgataaaagcaagtcattttcttagttgctactgaacggatataggtgagtcagtggaaaagtaatagtaatataatttaaaaaggattctatacacaaatttctttcaaagtgcctttacagcttgcttcattttggagaaacttaaattaaaacccttctatcattaactgccttttttaaaaaaattaaattaccaagaacaagtacttctgattgcatcagataagaaggctatagttttgaaaactgttattggctatattgggtacgtttatgaagaagctatagtaaatataatatcaaaagcttcacagcttggcatcttctgcaggactttatttakcarcagaaagcccctctgctatcatctatcagtctctccatgttccatagcctaaagatacatatttgtcccctaatctatgatgatggaatggtatgatagactatttaagaatatgttactgttttattttaaactgaaatgtatatttttctgcattctacagtcaccttaaccagaaaacccagtttgaaaatccagtggaggaagccaaaaggaaaaagcagttaggacaggttgaaattgggtcttcaaaaccaggtaagcattcttttcaatcttttcttctaagaataacttgtgaaatttgtatgctgagttaataaaagtgagtttgaacttcttatttctatggctttgacactaaagagtgtctagttgttactgtaaagatatgaataatcttaataaaacatctgaacattatsagaatactgagatttttctcaggagtatacaaaaagcatgaagttgttgggagaagggatttcggcagcttttttatgaatttgagattttgttttgaagattggaatgtttccttatgtttaaggctagaccaatattaggtctccagttcatcgttagcttttcccaagttaattgcttaagtatggtatctgtaaccactgaggattcttcattaaccaatattaataaatactaaatatatcaaatgatttacctacatcattgagtctcaaatgggatggtagctattagtaacatcagattcatttagggagcatttttttaaaaatatagatccagaaatttcgatgagtctaatcatgtgtattttgaaaacactgctcaggaagttcttacattctacttatccctccccatcccttttccagccctcatttgtcattaataaccaggggtatatatggccatattgtagtaatccagtagattctccacttcggttgcctatgagagaaatagttctttcttatagttactcttcaaaaacatcgtcctcctcctaaagttctgcatttcgtttagcaaacattttgagtttaacaaatacttttgagcactgactatatccccagtgctttgctaggctctaggtattcaaaaatgactaagagtaagacagggcttgccctcaagagttcatagtctaatacaggaaactgatggttataatacatggagataggtgccatcatagagtagtagttataatggtaagctgaggagcaggtttgaatcccagctgtgtaatcttgggtacgtttcctaaatctctaaatgctcctatttcttcatatataaagtaggaataataatggtasccaccttttaaggtggttatgagtatgtaaattaacagatgtaaagtgcctacaatggtattaagcacatgttgactaataaatgatagtttcattgttattaatagacatgtacaagttacagtggtggcataaagacgggagtacccaactctgctttggtgggaaatgtcaagtgggcaggagaaatttcaaagcagaagagatagaaactaggtcttgaaaagtcaggaaaagttaaagcaggcagacaaaaattttaaaggagcaagaaagcataccaagtagaaggaacagaatgtttaaaatcacagaagcatgaaatggtgtgccgaaaggccagaaggcaagtaggtgtggttacagcatagggtatttgtagggtagtaacaagcgatgaggttgtagggataggcagccatgagaagaggttgagtatgtcatatgttgctggaatgtcaaggaagttgaagattgaaaaatatgtgttggatttgacagtagggaggtcattagtcactctaggaagagcaagtagagagtgaagtaaaattgcaatagaatgaagagggtatgggaggtcagacagtacaactgttggcaaaatgataaacataattaccatatatttatagtaactgctggaattccactcagtgtatacccaagatgaatgaaaatatgtccacacaaaaccttgtgagtgttcatatcaacattattcataatagccaaaaagtggaaataacccaaatgtccatcaactaatgaatggatcaacaaaatgtgttgtttatccatacagtgccatattatttggcaataatataataaatatattttatctttagtaagtacatatttaatttaatatttattatatattaataataaagagcaataaagtactgacatatgctacaatacagatgaccctcaaaaacactgtcaagtgaaagaaaccattcaaaaaaccacatattgtctgattttgtttatatgaaatrcctatattgggcacatctatacatggatagtagattcgtggtttcctaaggctaggatatggatgtgggttggggagaaattggataatgactgctaatgggcatggggatttcctctgaggagggaagaaaatgttctaaaattagattatgctgatagtcgcatgacattgaattgtacacttgaaagggctaaattctatggtatgtgaattatatctcaataaatttgttaaaaaatagataatggcagaacatttaaaatcttttttacagttaatttaatacttcataaattataaacctgcacaatttgattctctcagtttttgtcactttcctaatggcaggcatggttgaggagaagagagaagaggttctggaaggaagttgttatttgcagatgtgaatcactagggtcatctaacccctaataatgggcatttcaaaagaactatgtattttttttcctaaattatccactaaacatgagtgaaagggatagaaatatgaagctatttactgatagtaaaaagattcactccttccatcagttataaatcaaagactgcagaaagcctgagctgtgaattataaaaattctcaatatactctctttcataagtttgtgacacttgacttcatcttcctggtatagtactttgcacataaaactcagtagatgctgagttttatagtacagttgaatagtatccaaactttcagaaattgagtgctaaaggttgtatcattttgacttcatataatggactctgggttgaaagtaagcacagacaaggcaatgagaaagagattaagttgagaataacattaaaaagtcatataaaagattgactctgagtgctatattcattgtaattatttttgttctcaaacccacttctcattttggcacagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggtaagaaatttttcataattatttgaagagtagtgatactataacaaaaattatagtgaagagattttatatacataaagagagagaaataattaaattatataactaaagaaagagattccagtattaaaatagtttatcctttaatttaaaaaaaagttgtatgggtatacagtaggtatatatatttatgggatacatgagatattatactatgatacaggcatgcaataagtaataaccacatcatagaaaatgtggtatacatctcctcaagcatttatctgttgtgttataaacaacccgtttatactcttttagttataaaatatacaattaaattattgctgactgtagtcaccctattgtgttatcaaaaactaggtcttattcattccttctagctatatatatatatacacacacatatatataatacacatatatatacacacacatacacacacacacacacacacacacacacacacacacatatatatttttttttgagacggagtcttgctctgtcgcccaggctggagtgcagtggcgcgatctcggctcactgcaaactccgtctcccgggttcacgccattctcctgcctcagcctcccgagtagctgggactacaggcgcccgccaccacgcctggctaattttttgtatttttagtagagacgaggtttcaccatgttagccaggatggtctggatctcctgacctcgtgatccgcctgccttggcctcccaaagtgctgagattacagacgtgagccacaccgcacccggcctttctagctatatattttttatattccttaaccatctccacttccctctcaccgccccaccaaccctaactacccttcccagcctctggtaatcatccttctactctctagctccattagttcagttgttttaatttttagcatccacaargaaatgagagcattcaaagtttgtgtttctttgcctgacttatttcacttaacataatgatcttcagttccatctgtgtcattgcaaatgacaagatctcattctttttatggctgaatagtactccattgtgtatatgtaccatgttttctttatctaattatctgtcgatggacatttaggtggcttctaaatcttggctattgtgaaaagtgctgtaacaaacatgggagtgcagatatctcttcaatatactgatttcctttcttgtgggtatatactcagcagtgggattgctagatcgtatggtatctctatttttagtgttttgagaatcctccaaattgttttccatagtggttgtgcaaatttacattcccagcaacagtgtatgagggttcccttttcaccacaccctctccagcatttgttattgcctgtcttttggataaaagccatttttaaccagggcaagaagatacctcattgtgcttttgatttgtatttatctgatgatcaatgacctgagcacttattcatattgctgtttctatgtcttctatgtcttcttcatgagaaatgtctattccaatgttttgcccattttttaatcagattattagatttttcctatagagttgtttgagctccttatatattctggttattaatctcttgtgagatggatagtttgcaaagattttctcccattctgtgggctgtctcttcacttgactgattgtttcctttgctatgcagaagctttttaacttaatgtgatcccatttgtccatttttgctttagttgcctaggcttgtggagtatcactgaagaaatttttgcccagaccaatgtcctggagagtttccccaatgttttctttttttagttttacagtttgaagtcttagatttaagtctttaattcaccttgatttgatttttgtatacagcgagagatagaagtcaagtttcattcttctacatgtggatatccaattttcctagaaccattgaagagactatcttctccaatgtatgttcttggcacctttcttgaaaatgagttcattgtaggtgtatggatttttctattctgttccactggtctatgtgtctgtttttatgccaataccatcttcctttagttactatagctctgtagtataatttgaagtcaggtaatgtgattcctccagttgtgttctttttcctcagkctagctttggctattctgggtcttttgtggttccatataaatttcagaattgttttttctatttctgtgaagaatgtcattggtattttgatagagatttgatagagattgcattgaatctatagattggtttgggtagtattgaaaagaatattgattcttccaactatgaacatgaaatatcttttcattttttgtgtcctcttcagtttcttgcatcagcattttataatttttaatgcagagatctttcgcttctttggttaagttaattcctaggtatttaatcttatttgtggctattgtgaataggattacttttttatttctttttcagattgttcactggcatatagaaaggctactgatttttgtatgtcgcttttgtatcctgcaactttactgaatttatcagttctaatagtttttttatttgtggagttgttaagtttttccaaatataagatcccatcatctgcaaacaaggataatttgacttctccctttccaatttgtatgcctgttatttctttctcctgctgattgctttagctagaacttccagtcctgtgttgagtaacagtggtgaaagtgggcatcttcattttccagatctcagaggaaggactttcagtttttccctcattcagtgtgatactagctgtggctctgttgtatatatggcttttattatattgaggtatgtttcttatataaccagtttttttagggttttatcataaaggggtgttgaattttattaaattttttcagcatcagttgaaattattatagtttttttgtttttgttttgttttgttttgttttttagactgagtctctgtcacccaggctggagggcagtggcatgatctcagctcactgcaacccccacctcctgggttcaagtgattctcctgcttcagcctccagagtagctgggattacaggcactcaccagcacgcctggctaattttatatttttagtagagatggggtttcaccatgttagctaggctggtctcgaattcttgacctcaggtgatccatctgcttcaaatgattatagtttttatccttcattctgttgataccatgtatcacactgattatttgcatatattgtaccatccttgcattcctgggataaatcccacttggtcatgatgaatgttctttttaatgtattgtcaaattttacttgctaatattttgttgaggagttttacatcagtacttatcagaaatactggcctgtagttttcttttttttgatatgtctttgatttggatatcagggtaatactggcatcacagaatgagtttggaattattcttccctctatttttcagaatagtttgagtaggaattgtattactcctttaaatgcttggtagaattcagcagtaaagccatcagatcctgggctttactttactgggagactattatggcttcaatcttgttgcttgtcattggtctgttcaggttttagatttctttgtggtttgatcttggtaagttgtgtgtgtctaggaatttatccatttcttctaggttttccaatttgttggcatatagttgctcataatagtctctaacaatcctttgaatttctgcagtatcagttgtaatgtctcctgtttcatctctgattttatttacttggatcttacctctttttttctgttagtctaaggtttgttaattgtatcttttcaaaaaaccaactttttgtttctttgatcttttgtgttgttttcttcatttcaaattcatttatttctactctttctgcttttcttctattaatctagagcttagttttctcttttctagttcttcaagatgcatcatgaggttatttatttgaagtttttctttttttatatatataggcacttatagctataaatttccctcttagtactgcttttgctgtatcccataggttttggtgtgttttgtttccattattatttgtttcaagaaatttttccaatttccttcttaattcctttattgactcactggtcattcaggaacctattgtttaatttccatgggtttgtatagtttccaaaattccccttgttattaatttctgattttattccatagcagttgagaagatacttgatataattttaattttttggaatgttttaagacttgttctgtaacctaacatatggtctatccttgaatgatgccgtgctgaggagaatatatattctgcagccattggatgaaatgttctgtaaatatctattaggtccatgtagtctatagtgcagattaggtctgatgtttccttgttgattttctgtctggaagatctaatgctgaaagtgggatgttgaagtctcctgctattattgtattgaggtctatttctctctccttagctctaataatatatatcatatattatataataattatatatataaaagatataattgtaatatatgataaaatacctctctctttagctctagtaaagcaagtaacacttgctttatgtgtctgggtactccagtgttggatgcatatacatttacaattgttatatcctcttgctgaattgacccctttattattatataatgacctttttgtctcttcttgcagtttttgtcttataatctattttgtctgatataaatgtagctactgctactgttttttggttttcactggcatggaatgtctttttccagtcctttatttccattctatgtgtacctttacaggtgacatatgtttcttctaggcaatagatcatcaggtcttgctttttttattcactcatcttctctatgtcttttgattggagagtttagtccatatggattgagtgttattaatgatcagtaaggacttactcctgccattttgttatttgttttctggttgttttgtgattgtctcttccttatttccttccttccttttagtgaaggtgattttatctgtggtatgatttaatttcttgctttttattttcttgtgtatccattgtatttttttatttgagtttaccaggacgctagaaaatactatattataactcataattataaactgaggacaaattaacactgattgtataaacaaagaagcaaacaagcaaaaagaaaatgaataaaaactgtacaatttaacttcatcccttccttttaaattttttgttatttctctttatgtcttattgtactttgtcttgaagatttgttctagttattattttgattggttcattgtttagtctttctacctaagagtatgttacccaccacaattacagtttaatattctatgtttttctgtgtgctattaccagtgagttttgtaccttcagatgatttcttattgctcgttaatgtccttttctttcgcattgaagaaccccctttagcatttcttgtaggagagatctagtgttcacgaaatcccttagcttttgttgtctggaaggtctttatttctccttcatgcttacaggatatttttgccagatacactattatagagtaaaaggtttttttcctaagcactttaaatatgtcatgccactctctcctgccctgtaaggtttccactggaaagtctgctgttagacatattggagctcctttgtatgttacttgtttcttttctcttgctgctcttaggatcctttctttatctttgacctttgggagtttgatttttaaatgccatgaggtagtctcctttgggttaaatctgcttggtgctctataaccttcatgtgcttgaatattggtatctttctctaggtttgggaagttctctgatattatccctttgaataaactttttacctcattttttctgtacctcctcttttgggccaataactcttagaattgcccttttgaggctgttttctagatactgtaggtgtgctttattgttctttattcttgtttttttttgtctcctctgactgtgtattttcaaataggctgtcttcaagctcactaattmtttcttctacttgatcgattctgctgttaagagactctgatkcattgtttagcatgtcagttgtatttttcaactctagatttctgtttgattctttttaattatttcagtctctgttaaatttatgtgacaggattctgcatttcttctctctgttatcttgattttttgttgttgttttctcaaaacaactatttttaattttctatctgaaaggtcacatatctctgtttctccaggattggtccctagtgccttatttagttcatttggtgaggtcatgttttcctggatggtcttgatccttatagatgtttgttggtgtctgggcattgaagagttaggcatttattgtagtttttgcaggctgggtttctttgtgcccatccttgggaaggctttccaggtattcgaagggacctaggtcctaaacccaataacaataagtaccaccttggtattcttggatacgattcagaagaattatctggattaataggcagagactcttgttcttttcccttacattcttccaaacaaacaaagtcagtctccctctctctctctctctctctctctctctctctccctccctccctccctccctccctcactctctgtctctctctttctctctctctgtgctgagcctcttggaactgggggttgggggacataaacatccctgtggccaccaccactgggactgcgctgggtgagacatgaaaccagcacagcactggatcttgcccacagccagctgtaaccactacctggctgccacttaaattaactcaaggccctggagccctatgatcagcaggtggcaaagtgagctaggttcgtgtccctctcttcaggatggtgagtttccccaagccgcgagtggattcagagatatcgtctgggagctagggattgaagtcaaaaaccttagaaatttacctggtattctattctattctggctaagctggcattcaaaccacaagacagacagaattcttcccattcttcaccttccacagacagagaaacctctccctgtggccaccaacactggcccatgtgggtgtgtgggggtgttgccaggccactgctaatgctcacctaaagcacaaaggctcttcagtcagcttgtgatgaatgctgtcaggcctgggactcacccttcaggacagtgggctctcctctgatccagactaggtccagaaatgctgaccaagagcctaggcctggactcagggaccccgagagcctgcgtggtgctctaccctactgtggctgagctggtacctaagctgcacgacacagtcacctttacctttccccctacttttctcaagcagcagtctttcaccatagttaccacagcagggaatgtgctgggtcacgcctaaagccagcatgtctcagagcccagtatccgtggtgtatttattacctgggtattgctattggttattcagggcccaggggctcttgagcaggcaggtgatgaaacctgccaggtctctgctgtgacagggcagcactgagttcaatgaaaagtccatcagccactgtgctccccctctcacaatcacacagatttctccataccaggtggctgctrccgggagctaagggagaggtggcgtaagcactcccttagctgccctggctggtgtctcgtaggttgcagtcaggtgtctctgatcccagctcagcactaggacttgtctaggaattgcagtccttgtggcctagactgccactcatttcactcggggcccagagcactccagcccccagtggtgaggcttgctggaactcagtctccaatcactggaatgggcaattcccctatggctagggtcgacccaaatgctccctttgttggcatatgtcagctgagtacagcctggttctgctttcccttgtgacaggggagcactgagttcaatgcaaatcctgacaatckctgtgctcaccctctcccaagcatgcaaattctcaccaccastgcagggaggatgggggagtggtagcactggcaattccagactgcctttcctatcttcttcagtgtctctttcagtgatatgaagtccaaaccaggcactatgattgctcacctgctttttgtctcttgtaacggtacttttagtgtgtagttagttgttaaaatttggtgtttctgtgggggtagggggatgagtagtgtaggcttctatcccgccactttgctctgccctccgtcaccatctatcctctaaactaaatgcatattatctttgatggtgggccattttacaaacaggtgaaaactgttggagaaaacattaaatttattaatattttgaaatattttatataactttgagataatccttttgctgtataaaactaaagatttattaatcatctcagaaaaatatttgtttgattttcttgaattataaaggatacttttggagcaaacatttacctataaccttatttgaaaaaaaggtcctgtgtggtgtttatcatggtatcaaattattaaatcttgccgtttttcccaagtttgtttgcttccttaatcttactggttattaaattgaactcctatgttaagaattgtagacataacattaccatttttacaaagtagtgtaaacttgtcttttctatagtttcctaaagcctttacttggtaattgctggatattttaatatggctgggagtgtttgtggttcaggaacttggagaaggttgaagactagtttctgattgcggggggaagtttaagtattgttttccagaaagattttagtattaatactgaggttgctttttgcagtgtttgctagacttttctaatcctctgttatttcacataccgtgaaaatatggaccaacattcagatggttgaattgtcatagtattttttgatctctcatattatgctttcccattgaggtaacaaaaacttaaaacaggaaaacttaaaataatcaagttatacttgtaaagaaaattatttttttctactttattactttataaagttaacaaactttagagattaaaattaatagtaaggttcttttgttttcagttttgaccttttcaacattttatccatgaaacacatgtcttagctattgtgtatgctgtcaggatttcaaaatgtagtttcatatttgcctaatatgcttatctaatttgcatggcaatacaatatttccgtgaaaattctgggagctttaataccagattgagttttttaaaagccatcagaacaaattaaagcacctttgtttggcaataaccttttaaataatcatattcaaataaaagctaattgatgagacaacaggggccaaattttaagtcaagactgtattaaaaaatacccaactgatgaccgtcaactggtaatgattctacaaccaaaatagtcttactaatgtcaaatcaggaaagcaaaaccaacttttagagggatttattaagctgccttgtcagtgtcttcaataatgcattgtttgcttctgttgaattttttgttgcttgtttcaccttttgaaatctgatttatacatcaaattcaaaattgctggaaaaagaaggatactacaagaaaatacactcataaattaacatcattctaatcttcagttcaaaatttgtcaaactagaatgaatttttaaagtacattgttagcaatggcttttgttttgtttagttttttagttttttttttattattattatactttaagttttagagtacatgtacacaatgtgcaggttagttacatatgtatacatgtgacatgctggtgtgctgcacccattaactcgtcatttagcattaggtatatctcctaatgctatccctcccccctccccccaccccacagcagtccccagagtgtgatgttccccttcctgtgtccatgtgttctcattcttcacttcccacctatgagtgagaatatgcagtgtttggttttttgttcttgtgatattttactgagcatgatgatttccaatttcatccatgtccctacaaaggacatgaactcatcatttttttttttttttttttttttttttttttttttttttttgagacggagtctcgctctgtcgcccaggctggagtgcagtggcgggatctagggttactgcaagctccgcctcccgggttcacgccattctcctgcctcagcctcccaagtagctgggactacaggcgcctgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccagccgaactcatcattttttatggctgcatagtattccacggtgtatatgtgccacattttcttaatccagtctatcattgttggacatttgggttggttccaagtctttgctattgtgaatagtgccacaataaacatacttgtgcatgtgtctttatagcagcatgatctatagtcctttgggtatatacccagtaatgggatggctgggtcaaatggtatttctagttctagatccctgaggaatcaccacactgacttccacaagggttgaactagtttacagtcccaccaatggtgtaaaagtggtcctatttctccacatcctctccagcacctgttgtttcctgactttttaatgatcaccattctaactggtgtgagatggtatctcattgtggttttgatttgcatttctctgatggccagtgatggtgagcattttttcatgtgttttttggctgcataaatgtcttcttttgagaagtgtctgttcatgtccttygcccactttttgatggggttgtttgtttttgtcttgtaaatttgtttgagttcattgtagattctggatattagcccttcgtcagatgagtagattgcaaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctaatccatcttgaattaatttttgtataaggtgtaaggaagggatccagtttcagctttctacatatggctagccagttttcccagcaccatttattacatagggaatcctttccccattgcttgtttttctcaggtttgtcgaagatcagatagttgtagatgtgyggcgttatttctgagggctctgttctgttccattgatctatatctctgttttggtaccagtaccatgctgttttggttactgtagccttgtagtaggttgaagtcaggtagtgtaatgcctccagctttgttcttttggcttaggattgacttggcaatgtgggcttttttttggttccatatgaactttaaagtagttttttccaattctgtgaagaaagtcattggtagcttgatggggatggcattgaatctataaattaccttggtcaatatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttatacattgattttgtatcctgagacttttggcttatcagcttaaggagattttgggctgagacaatggggttttctagatatacaatcatgtcatctgcaaacagggacaatttgagttcctcttttcctaattgaataccctttatttccttctcctgcctaactgccctggccagaacttccaacactatgttgaataggagtggtgagagagggcatccctgtcttggcgagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataaccatgtggtttttgtctttggttctgtttatatgctggattacatttactgatttgcgtatattgaaccagtcttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtgtcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattcgtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatccccttttatcattttttattgcatctatttgattcttctctcttttcttctttattagtcttgctagtggtcgatcaattttgttgatcctttcaaaaaaccagctcctggattcattaattttttgaagggttttttgtgtctctatttccttcagttctgttctgattttagttatttcttgccttctgctagcttttgaatgtgtttgctcttgcttttctagttcttttaattgtgatgttagggtgtcaattttggatctttcctgctttcttttgtgggcatttcatgctatamatttccctctacacactgctttgaatgtgtcccagagattctggtatgttgtgtctttcttcttgttggtttcaaagaacatctttatttctgtcttcatttcgttatgtacccagtagtcattcaggagcacgttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctggaaaaaatgtatattctgttgatttggggtggagagttctgtagatgtctattaggtctgcttggtgcagagctgagttcaattcctggatatccttgttaactctctgtctcgttgatctgtctaatgttgacagtggggtgttaaagtctcccattattattgtgtgggagtctaaatctctttgtaggtcactcaggacttgctttatgaatctgggtgctcctgtattgggtgcatatatatttaggatagtttgctcttcttgttgaattgatccctttaccattatgtaatggccttctttgtctcttttgatctttgttggtttaaagtctgttttatcagagactaggattgcaacccttgtcttttttttgttttccatttacttggtagatcttcctccatccttttattttgagtctatgtgtgtctctgcacgtgagatgggtttcctgaatacagcacactgatgggtcttgactctttatccaatttgccagtctgtgtcttttaattggagcatttagtccatttacatttaaagttgatattattatgtgtgaatttgatcctgtcattatgatgttcgctggttattttgctcgttagttgatgcagtttcttcctagcctcgatggtctttacaatttggcatgattttgcagtggctggtaccagttgttcctttccatgtttagtgcttccttcaggagctcttttagggcaggcctggttgtgacaaaatctctcagcatttgcttgtctgtaaaggattttatttctccttcacttatgaagtttagtttggctggatatgaagttctgggttgataattcttttctttaagaatgttgaatatcggcccccactctcttctggcttgtagagtttctgccaagagatccactgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatttgaatgttggcctgccttgctaggttggggaagttctgctggataatatcctgcggagtgttttccaacttggttccattctccccatcactttcaggtacaccaatcagatgtagatttggtcttttcacatagtcccatatttcttggaggctttgttcatttctttttattcttttttctctaaacttcccttctcgcttcatttcattcatttcatcttccatcactgataccctttctttcagttgatcgcatcggctcctgaggcttctgcattcctcacgtagttctcgagccttggctttcagctccatcagctcctttaagcacttctctgtattggttattctagttatacattcgtctaaatttttttcaaagtttttaacttctttgcctttgatttgaatttcttcctgtagctcggagtagtttgatcgtctgaagccttcttctctcaactcgtcaaagtcattctccatccagctttgttccgttgctggtgaggaactgcgttcctttggaagaggagaggcgctctgctttttagagtttccagtttttctgctctgttctttccccctctttgtggttttatcttcttttgttctttgatgatggtgatgtacagatgggtttttggtgtggatgtcctttctgtttgttagttttccttctaacagacaggaccctcagctgcaagtctgttggagtttgctagaggtccactccctaccctgtttgcccgggtaccagcagcggtagctgcacagcagcggattttcgtgaaccgtgaatgctgctgtctgatcgttcctctggaagttttttctcagaggagtacccggtcatgtgaggtgtcagtctgcccctactggggggtgcctcccagttaggctgctcaggggtcaggggtcagggacccacttgaggaggcagtctgcctgttctcagatctccagctgcgtgctgggagaacccactgctctcctcaaagctgtcagacagggacatttaagtctgcagaggttactgctgtctttttgtttgtctgtgccccgcccccagaggtggagcctacagaggcaggcaggcctccttgagctgtggtgggctccacccagttcgagcttcccggctgctttgtttacctaagcaagcctgggcaatggcgggcgcccctcccccagcctcactgccgccttgcagtttgatctcagactgctgtgctagcaatcagtgagactccgtgggcgtaggaccctccgagccaggtgcrgcatataatctcctggtgcgccgttttttaagcccatcagaaaagcgcagtattcgggtgggagtgacccaattttccaggtgccgtctgtcacccctttctttgactaggaaagggaactccctgaccccttgcacttcccgagtgaggcaatgcctcgccctgcttcagctcgcacacggtgcgctgcacccactatcctgcacccactgtctggcactccctagtgagatgaacccggtacctcagatggaaatgcagaaatcacccatcttctgcgtcgctcacgctgggaactgtagaccggagctgttcctattcggccatctcggctcccacctgtttagtttttttgtttgtttgttcgtttgtttgagaccaaatctcactcttgtcatccaggctggagtgcgatggcagaatctcggctcattgcaacctccgcctcctgcgttcaagtgattctcctgcctcagcttcctaagtacctgggattacaggcgcacgccaccatgcctggctaattttttttctttttttgagatggagttttactcttgttgcccaggctggagtgcagtgctgcgacctcggcttactgcaacctctgcctcctgggttcaagcaattctcctgcctcagcytcctgagtagctgggattatagcacataccaccacacccagctaattttttgtatttttagtggagacagggtttcatcatgttggccaggctggtcttgaactcctgacctcaggtgatccacctgcctcagcctcccaaagtgcggggattacaggcgtgagccaccgcgtctggcctaatttttttgtattttagtagagatggggtttcgccatgttagccaggctggtgtcgaattcctgacctcaggtgtactgggattacaggcatgagccgctgcrcctggcctgagccaccacgcccagccartggsttcttaaactcaagaaataaggtggtatttaaagatagactgaccctgtcaaaaagtggacaaaggatatgaacagatacttctcaaaaaaagacaattatgtggctaacaagcatatgaaaaaaagctcaacatcgctgattattaaagaaatgcaaatcaaaatgacagtgagatatcatcttacgccagtcagaatggtgattattaaaaartcaagaaacaatagatgctggcaaggctgtggagaaacaggaacgcttttacactattggtgggagtataaattagttcaattaatgtggaagacagtgtagcaattccttaaggatcttgaaccagaaataccatttgatccagcaatcccattactggatatatacccaaaggaatataaatcattctactataaagacacatgcacacgtatgtttattgcagcactatttacaatagcaaagacaggaaccaacccaaatgcccatcaatgatagattgcataaggaaaatgtggtatatatacaytatggaatactatgcagccataaaaaggaatgagatcatgtcctttgcagggacatagatgaagctggaagccatcatcctcagtaaactaacacagaaacggaaaaccaaacgctgcatgttcttataagtgggagttgaacaatgagaacacatggacacagggccgtgaacaacaaacaccagggccagtcgggggttgggggacgaggagagggagagcattaggacaaataactaatgcatgtggggcttaaaacctagatgacgggttgataggtgtagcaaaccaccatggcacacttatacctatgtaacaaatctacatattctgcacttgcatcctggaacttaaagtaaaatttaaatatatatatatttatatatatgatatatwwwatatatcatatataaatatatatmatattaaatatatatatgatatataatatatatacactatatatgatatatataatatatatgatatatgaatataatatrtatgatatataatatatatgatatattatatatgatatatataatatatatgagatatatataatatatatgatatataaatatatatgatatatatataaatctatatatatatcaggggtggaggaggatttctggctataggggctataggaacttgacaggattcttgctgaatgcaggctgaggtgatcaggtaatcacctggagaatggtggggaatgaggacttagatcatatatcaagagtgggtgattctggctaaaccaacttagcaggattcctgctaaagctgggctctggaggacatgccaaggatgaggcctactgaaaaaagagctcagaggaacctgtctagagtttggttaaggacagcgtctttttcagtgtatgtatatatacatacatacagatatataaataaaattaatttattcaaaaaatataatacagtttgtacaagtagtcagtggagttatttgcttctgtactaaatacctactgcaatgtgcctagctttgcatggatacttagatatgactcagagggtatactaacaatgataatataaattatcagggttttttttttaatgattcacttgagcttgaagtcaaaattctttgctactgaaataagtaggattttagacatttatacatacattttagagaggagttagaaaagggagaaggtctgtgttagaaatctatcttttcagcagttaatagaggtttccaaaattcaaatttagttgctaaattgtagttatttttgcccctctagcaaaaaaattaacttatttgttgattttaatatttttaacatgattatgtttttccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaarggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtaagtaaaagcacaacatagaaaaagtttcagtgttcaagcgtttatatctactgattgtctttccttacagtttagaatgtgttttcccagcagacttaactagtaattagtgtgcattttccttaaggttctgtctgattgtttccataagcagtgtctttttcagcagtttttaaaaaattattagtgatttcattcatgtccattatggatttatttccctctgtattcttttgaaaatctgattcatggctttaatgattagagagagtcacagcattgtgatacttcaaatgaaatacatcctcttaatttcatttctctgttgatgacagtaatagaaattgactctttcaaccaatggtgtgtcatctggacctctgtaatgcaccaaagatgttttgaaagagctagcatctctgtggataagtaaaatgttggatggtgtrttaatctgttctgcagaggcaatcatgatagcatgtgctcataaagttttcatcttaagctctagtatctgactgtaaatgttaattaaaccacacagtgcttatgtgagagaaatataatttttattttccaaggtcatcagctgacatgaactcctcccagacatttacaaattcagttccaaggaataatcacaaagttgaattttaatatgctttcttaaatccatacttataagtgactagtatcttaaagaataaaagmcacttactcttttatctctctggattttacttttcactattgaggcaaacgagcacttcagcttctttgggagttgtttcttattctcgtttctttgattcacatgggtttcttctctgagtgatggtggaatgtgctccaagtaaggtagaaatctctttgtgagtgcttgagagtaatccagggcttcaacaagtataacaaagacaccaaagttcaatgtcacacaggtttgatgtcagtttcctgccttgccacttactggttctttggtataggaaasaatcttagtttaccttctctgtaagatggtcataacatttgtgccttcagattgttataaaaatgaaatgagataatatatgtataatgcctggtacataggaggttagacacagaatttactagcgtactaaaagttgaagctagttttatcgtaaacattagcagtatttgtgatctgggaatgcatcctctggttttaaactttggttcattttttttttaaggtcctccttcaccaaccaaaactgccaaaatggtgagtatacactggtcctcaaatcttttccccaacacactgagagagatgccacattcccctctgtaagaggagctcactgtggtgatgattatcgactgggagaagttaggaggcatgctgcccttggcttgtatttattagaaactagggaagcgtttgaaaaagccccctagtgaggagatgtgctccactggttaagtattgcaactggaggattactaaaggcctattgtaccaataatcctgttctctaagttataaaatgtgaacacattaaagaaccaacctagaggtctttttacttttgtgtttcagagaaacaaggtaggaaggacctaaatgttaagacagatgataaactattacatcgtcttgcccctgcctgaagagaagacgtactagttcacataattttgtggggactataaatatgcatgcacctttagataatcttcttacttttaagactaaattaggcttatttttttattatttattttttatttatttatttattttttgagacggagtcttgctctgtcgcccaggctggagtgcagtggcactatctcggctcactgcaacctccgcctccggggttcaagcgattctcctgcctcagcctcccaagtagctgggactacaggtgcacgccaccacacccagctaatttttttgtatttttagtagagacagggtttcaccatgttggctaggatggtctcaatctcttgacctcatgatctgcccgcctcggcctcccaaagtgctgggattacaggcatgatacaccacgtccggctgactaaacaagactttctagagtaattgtggccttctatgctaaatttgcttgttgtcaaagtgaaagacctgaaacagtgtcttctttggcattcttctaaataatcacgtagcctgtttaaggacctgtgcagagaataagaactttaaaaaggagtgcatcaaatrctgctgttgtggaagaaactctacaaggtgcacatttgtagctatttaaatatccacaatgttttggatataaagacaattttatttaaaattctaatttagttctagtttgctcctttggagtcttttatctcaaaatcaaaagatggccttccataaccataaactatagacaattatattaaatgaattagttctttctagcccaccaagtaggaatcctctgcaaatttgctgttttatagatkaaaaagaatccctcagcttctggcctttttttttttttttttttgagacagagtctcactccatcacccaggctggaatgcagtggtgtgattttggctcactgcagcctctgccgcctaggttcaagcaattcttgtgccttagcctcccagtagctggaattacaggtgcacgccaccacacgcagctaatttttatatttttggtagagatggagtttcactacattggctaggctggtctcaaattcctgacctcaggtgatctgcccacctcggcctcccaaagtgctgggattacaggcatgagccactgcgcccggccagcttctgcccttttcattgactgcttatactacttgggtccagtgtgaacagaaattgtttttgtccattcagttcaaattgcactgtattctacatttctctggttcctctagtaatcatttttaactcctgtgccaccatatttatttcataatggatgccactgcagtcgcagtggccctaatgctttataattgatggaagggtctgatgaactttaaccgcctctgacagaatgctaagatgtatggggaagggtaggagactactgttagcttctctgccttctcattgggtctgggtgattgaagggtcccctctagcacgacactttgtagtggctgacccctgattactccctgacagactggtgcccctgcattctagtcattgttaatgatcacaaacatccataatctccctctcctaacaataatccaggaaaacgagctggtctcaaaaccatatttcttaggccatttattggatttcattgttaacattttattaaataagtcattttgcttggctgttatcttgggaaagttctagctgaataggaaaaatatcaaaatatgctactatgctttcccttatctaattgtcttgcatggtacattttctcttaatatatgtgaattggccagacagggttttcacagtgccatctttataacctaaattagagttaacctctcctgttttcttagaaagagtattatcttaaacatcttccttagaaattaaactcagtgaatgggaggtgggccgtgctaagaattttatgaagatattctctgaatctccctcttactttacttagaagtgctgccttgtattgtatttctatttatcttcatctcaaagtcaatttgtgtcttggtggtggagaaaagggcaaaattgtttaaacataggactaactaaggctcttcagttgatattactataaacttttttctaatttaagttaaatatgtttcaaccaaatacacattgctatgaaaatgaattcctgtaactgtaaatctgctgtgtctttgatcctgccacctatacaactataatcagttgacatatccatttcagatatcagttttatgaattaatcaaccatctkctttttaaaaaatactaagtaaggctyttttccatttcagaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaacgtaagtagttgtggaatatttcaggagagcatwtaacaagataaatttggatttattttagactaggaccttcccatctttcagaagcatattgaaaagttattccttcattaccattttaatagaactctggacttcttccatgtatattcgacattcacacattcatttttttcaaaatcatgctttaagtgctagttatctaccagatgccatactaggtaaccagaatacagagataaataggttacataggacctgcacccaaaaatattattagaactaaatggaaaaagacaaatatgtaatcaaatagtatacaaataagtacacataataagcctaacaggtacagtgatagaaagatgaaatggataaattgggatccaaagaaggaatattcagttttatcagtgtgggcagtaggaagtgtcaggaaaagcttcatactggaagcaaagctttaactaagtcatcagggatgaaaaagtgtctttgaggaagataaaagggaaagatagaaggaatagcacatgcacactggccttgcatgacttgggctctgcaagtagttcactttcgctgggtgcaattggcaaggaaagtcacagaggagagcaggaacagattgaggaaggccaatgatgcccttccaagggagctggagttggtcatataaataacagagaaccacagaatgcctttaactataaggaaggcatagttttgtgttttagaaaggtttttctggcaggagtatgaaggatgaatcagaggtgtatgcaatttgagggagggtgtgcaatttgaagaagaaactaaagagttgactccttacaggagtccagctgagagataaaaagagagactgcataaggcagaaattcatgcatgttcctactmattcacttactaatgataaatcttttccaaagtaaaattgcagatttgagtaggtataattttttaaaatttatttgttcttagaaagagatgtaaatctacsttggaaaagatatgtacaagtggaatatatgtatagttgacttaatgcttatttaactagttgcagaagtacatcttgataatcccaagccatattcagaaagatgaaaaccagttgtacgcccagcaaagcaataatttaaattagcataacaatgtagaatccctttcttcatactttccattcatagcctgatacattattaatactggtataaactctgcagtcccatcaggcttcacccataaaataagtgagttgaactgatgactctttttttttttttccctgagacagagtcttgctctgtcacccggagctggagtgcagtggcacaatctcagctcactgaaacctctgcctcctaggttcaagcaattctcctgcctcagcctcctgagtagctggcactacaggcgtatgccaccatgactggctaagttttgcatttttagtagagacggggtttcaccatgttagtcaagctggtctcaaactcctgacctcgtgatccgcccacctcggcctcccaaagtggactcttttaatctctaaagttctacaattttaataggaagtatatatcaaaagatactgcttctatagaatattatcaggaatttactaatctcactttttacatagttccctgacatgtttatttcttctctctttacagtaaatacttcttacctataaataacattaatattttcccaaaggaaaaattttagtcatgaaatagatttttrtgacttaatattctttttttttttttttgagatggagtcttgctctgttgcccaggctggaatgcagtggcacgatctcagttcactgcaacctctgcctcccaggttcaagcaatcctcctgcttaatattctaaggaatacaacctaycctttgagggtaggacagtatgagttaggagattagaccctggaaatcaacctggatttaaatcttagcttcaccacttgctatgtgacaatggccaacttacttacaccctcagttttcccacctagaaaatggggctaataataaatgttagctcttaattattttcctttaaaatgctatcattttgcaaaactaggctaggtaagtagttcatatggaatacttttctgagagaaaggtattagcttgagagcaggaataaggtattttacaggcactctatacagcagtgcctgtacagatttaatgtaccttacccaagtgttaacttaggtcatttgcacctgtcaaatatcaaactcaagtttgatcattctgaattcaacattgttatattgattggacagcattagaagttaatggcagtgtaatactgagtatatggaagtgagagtaaatgtttctaaacartcttcatacagttttgtttagagctcaaaacgaggatttatagttgaattgtgtgtgtgtgttacactcttgtgcaaattttccatattaaaaagttctgagattatagtttattgagttactctataatatcctactaaatactgaactttgttttgttttaatccttttaaaataaatcatagtatttatattttctgattttcctcagcaccaaacaccaaagatttggatgtttttcttcgaaaacaagagtcagggtttggcttcagggtgctaggaggagatggacctgaccagtctgtaagtgtcacttctttggaacatggctgtttcctgttcaaacrttttgagtggtgatttggtggattatggtgtgttttaagtttttttttctctgacagtttcattaatatgaagaataactgcatttccattattatcatagtccctcagttattgtggtgtagctgaggctaaaaactgtgggtaaaaactgaatatgtcagctgcaaattagacagtgattaatttatttacttctctgtgtgaataactacataaagcttattttaagtttatattttcctttgccctcattaaacagagtctaagacattttccttctctaagaagcctataatcccatgtcctctttcccactattactctatcttctggatgctccataaatggttggcatgagcctgtgcatattgtttcacctcgtcttattaataggttggcattttcatgctcagtactttgcatgtcatttcatctgttacctttgaaactagaggaatataaaataattaatatttttgtccagaggcataagggttatatttgcaaagcatttgaagtctaggattttgtttacacatgattctcacataaacttgttttagagaacaaatgtagtgggttttgtttctaagttttgctcttggtttgaataacaaagaagtaatgtgttctgtagcatttttaagaacatatttgcattttattttatataatatcaatatattatatatcaaaaaatatggttggaagttaggtgaagaacaataatctttaaaaattacaggcttcttatttctgaatagaacatttgatttatgtagtataaatttgttctaattggtcatattggttacagttacaacagtcattggagacacataaagcttaaggcaggttgccctatgtagaacaaatactagatactttaattgttcttkgtatttgtatttttgttttattgcttcctattttgttgatactcataatgttcacttagacattttaagaatttgtctcaaacaacttagaagaaacctttcttttctcttaaatgtcagattttagcagctctgaaactagcctaaacattcaggattgcctaattacaggattctaatgctggtgagcaaaatgaaccagatttgttcacctagatgcaagtgaagcttcaggccactctgttcccgctgagatttagaaacaagaaatgtctctgtgctgtgtatattgaacttgtaccgttagtcatatgtgatgggagtactgttgagaatgatcccagttgctgtgaacagtatgtagaaaatcttgcctgatgacattgaacagacttttaatagctactctgcagatttatattttctgagtttagtgttttgtttcattgtaatgatagggataatggttgtgctttttgagttatcgaacaactttgtattttctattttctttgtacacagccctgaggatctataagggattacataatacaatgtggttatttgaagtgccattttggagaatgggcactttctcagataatacctttctaaaatataactgttttcatagttgaactgcaaaaatctgttggtttgcacaatgctaagttaggaattccttaactcttcagctaaactttacactgtggaccaaactgtactttgttatcttatcagatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggaggtgtgtgaacttgttcctgctctgaaaagttaaaaaagaaacaaagatactagtctacttcctgtgtagttttgcaggttattttattacattcagtagtatctaagataacccatttggtgtgatccagggcctcactgtggaaggctatgcaaacacaaaaggattcagaaataatactactataaaaaaataaattttgggcttctatattaagattattttcatatattgatgcattttgcaaatgtattataggtgggagtattgatttaaatccggttttgttttgttttgttgagttgaggtagagtctcactctgtcacccaggctagagtgcagtggtatgagctcagctcactgcaacctccacctcytgggttcaagcgattctcctgcctcagcctcctgagtagctgggattacaggcacacaccaccacacggctaatttttgtatttttagtagagacggggtttcaccacattggccaggctggtctcgaactcttgacctcaagtgatccacctgtctcagactcccaaagtgctggaattacaggcgtgagccactgtgcccagcctaaatttgttttgtttttttttaaataacaaatacaaaattatttagtcataccaagatatcccactagctgaatatacaaagatttttggatcccagtgraatctgagctactaaaggaaagtaggatgtttctacttgagaagttttagtataatttaacatttattgagtgcttactatgtcctagatgcatggattattttatttaatcttcacaacactatgaggtcattatctagttctatgattactcagagaaaggttgagaaacaaataactggtaagaggtagggcctggattaaaagttgcagtttaattcagagatcagggtttaaaccatagcattaggatatgaatatctcttatagtttctcgccagtagctttatgaataattaaatagaaattcttataagtgaattctttccactttaaaattaaaaaaatacaactctgtagcacaagaatataagcctcatgaaggtatgaatttttatttgtgtagttatctgctgtaagctcrgcacctaaaagagtgcctgtctggtacaaagtggacattaataaatgttgttaattggatgaatatttacatcactcttaaaaatgaggcactgtattttttattgcaacattcaaagtaaaggcctgcctcctttggtaaataccaggcatttagaatgcatatagattgtaatgcagtactgcctcaatttggttgtgttggaggccaaatgtaactacttacagtaaaattgtgatgttatacaacctacgctcttccctggaaagaatcatgaagaagtttcatagtagtttggtattattggagacattttagctaatacattctaactatgcattttgaaaaaaaaaaagaaaaaaacatattcttaaaaccatgtgaattttcagmcagaaagagaccttataaatatggacatgactgcagtgtgttgtggttattattaacgatggtttgtaccaaattatggcaaaaaatatgccctttttaaaaaatcagttaggactttgtgtcattctcaagttctgatgtcatccttgaagagcagaaaaaggtgtaggttaattggccatttgtcaggaatttcatatgaccctgtctatgcccagaagtgtttgctattcatgtggacagcttgttatgtgtcccagcaagttgaggggtggaggttggggaggttgaaggctgagaactgctaatgatgaactcatcttatatcatcactcaggaaactgcagttgcaaaacacatcatataagacaaatcctgtacaggtagcaaactgttataatggggcagcatttctgccctgatgctttaacctctaagacagacatcaatgaatatcagtcactgagctaaattatatttataattgattttaaaaggaagttcatgtgtcattcctcattatgtgtttcattaaaattattggtccatgttataaaacttgatggaactaaaacagttttaggaagaatttttttactatcaaatctcacagaaactttgaaaagcttcctttaaaatgagatcatgaggtcaggagttcgagaccagcctggccaatatggtgaaaccccatctcttctaaaaatacaaaaattagccgggcatggtggtgggcacctgtaatcccagctactcaggaggctgaggcaggagaatggcgtgaacccaggaagcagaggttgcaatgagccgagatcgcgccactgcactccagcctaggtgacagagcaagacgccatctcggggaaaaaaaaaaatgagataacatgagattgtatgtatttttcagtaatccactctgagtatttgggaagtcggatggactgctgttgcctacatctgcactcagattatacccgaagctcacatgtggggctgcttttctattctttatgttattagaaactgaattkttctgtgagaggcttagcataaaaacactttagtcaccagaaattatgatgttccagacatatcaaaactgatcatgtttattacagaaaaacaacccgaggacgacagctctcaggccttcatttcaacrcagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggaggtaagggctattgtatcttattgtctctccctgcaagtccagttttctgaggctcccactggagtttatgaaataattaggarctatgtataaaatgccttaggtacttatctttttaagaatggtgaatactttccttattttcaaaattaggtaatttgaaccgaaccttccaggcttcaagtttatctattatctcacattctataaaatatttaataagtctcagtagctccatttgcmtcaaggttatactgaagacagtatgtcatagatatggatttaatgaaaggtataatgctgacttttaagaaaatggggacataggttttgaaaattaggataaatcgtgtatgtagaaaatagagactagaagcaattgagaagaagcaaagcagattaacagaaaaatcttgacccaaatatgtcgtagatattttatgttattatttaataataattgccatagtccagctataaattacccttgttgaatgataagaggcataccttttataaatgtttcattgaaaggtaaaaattttgtcaacaattggaaaatggatctaaatatcttgaaccaagtttaacagaatattctaatccagaagatgaatgtatttatatcagttccatgatcaaaggaggaattacatctgatatattcagggctgttacgattcagcaaatgaaatatttgtcttgatatttctataaaataataatttttaatataattataaaatccagttgaatatgagaaccagctccaagtcaaataataaaaatctttgaccacatgaaaatgtgcccttgcctttacaagtcagtttgattatgttttgaatagtgagatccttttagaccaagtggttgctaaaaccttagtttaaaaaaaagaaaacacttttaggaaagtgttgtgagccaaatcagtttgcaaaaatcttgctaaaattaatggaaatgtataagggaaaaagagtccatgacatggatgagttattgctatagtattaggtcactgctcactgatgctagtttccattttcccaaagcagttgccatggaaacacttggaactggaactgtcactgatgctgtgaggatgataatatggcgtgtgtcagaaaaatgaaaggaaagcagcttttaggtggttttcatgttgtatcattggaatcagtatttccaaaaacagataaccatttaggataatgatattgtcattctcgtaacatacaataacaccaggcattcagattaactaaaacagtgaaagtattactctagtagatagatgctaaccactttctatattgaagatattccctttctagcactacagaaatttggggaaagtctagtgttcactataaaactaagctatatagaggaattcagtaaaataagtttcattgcttaaatatatttaagcatatttttacatttatttatatttaacatttatgttatattaaattttaatatattaagtatttttatttgtatatattggtaaatttttaaaaatttaaaaatctttaagtagttttatatttccttgtttcaatcattttttactattgtgatggttttacctatggagatacttcatctctttaagatagtgtcattaagtgttgtgttttgtaatccaacaaacttggattcaagtcctgcttatgtcttttaatagctgtctgatcttgggcaaattactttccctccaagagctccagtttcttccacaaaatgaggatgatagagacactccctgtctcatgaatgtgaggattaaaggagacagggtatgtgaagcccttagccaaggccttcagtaaatgttagctgctgttgcttgttgtaacttctgctgccattgttatcatcatcattatttagaaaattgtcaccgtctcttaacttttcttttaaaaaaaaacttttaaaagttcatcaatacttaataatgagataggaaagaaagcccaattaaaatgtaagattgaggcagcagctaacatgtggcaggagatgagtatttgcagctcattaattatcaggctgaatggtaaattaggctcaggttgttgatgaattttatgtaaagtacttgagattttcagtcatggtgtaaaaccagaattgataatttcactgaaatgctagttaataatctcataaaatgttgaggcctgagagtattcttgttagaattttatttttcacatatagacagaaaaagggtcctggggaaagctccaatgaggagttttcacttacagagactgaacacttgctgcaaactgtatgacagagaaggtttggttcagaaaggagttagcacaggtggaaaggcaggaaacctgtctcagaatagatcagtattttctttttcttttttttttttttgagacagtcttactctgttgcccaggctggagtggagtggtgtgatctcggttcactgcaacctctgcctcccaggttcaagtgattctcgtgcctcagcctcccgattagctgggattacaggcatgtgccaacacacctggctaattttttttgtatttttagcagagacggggttttgccatgttggccaggctggtctcaaactcccracctcaggcaatccacccaccttggcctcccaaagtgctgggattacagacatgagccaccgtgcccrgccagatcattctttatggacctcatctcaggtattttctgatgacgtatgtctcaagaagagttcctagtagcatctgtggtaccagttatggaattctgagtttctctactgttgactttttcaaagatcagggatccaggtctagcatcctcacaatttgtctaagtgctgaatgaatggagtacttagaaaaggcctctatttaagattaagaagactcggctagtttttgctttactagtacttcagagcttttagtgttattccttcttatcatgtagttttcagttctggttgcaaaggatttctttgaaaagggaacatttccagttactgttctttgttttcctgaaaagaaatgttttaagagcactaaagtgatctcaggatctagacaagccaggctatgagacagatttaggccaaagatgaatgaagatggataagttggctttatggcaaatgcctgtagactttgtgtatcaacaaaaacaaggcaggactgaaggcttttccctagctatgtgaactctaaggggttaccttgaacagtttcccagtccgtttagaaaatgttcagaagctacctttctactggtctgtttgctatttttaactgttccggtgacactgctataaatactaagacagtaacaatctgactgcttttaccttccctcacccagacaaccagccctttaggaagttgtataccaccatgcaccaattctttttaccacattgctcgcagactgagaaaggggaccactaagatttcagagattaattctatttaatgctttcccaagtctgaacaaactccttttagtgagccaaggaactgaatgattttcttctcagagtatctagaaagaacactatgtttgagtaaatcttttgtaaggagaataactgagatattgatttagaaggtcaccacagggccaccgtatgacctgccgtatgtttctggtgtgccacctgttgtagaattagtgaatcaactcataatgcctgatatgacatggccctttctgcactggcatttctctaattacgttgtttgtaaggaaaatagaataataagtgcttgacataattcagagctaaaaggcacttccttccaacattgacttactctattttaagataaaatctgccactgtgtattcctagaagagccagggcactgtctgtagggaaataaatcatcatcaagaataacttttctactccaaatgaaggtctatttaaatgtcccttacatactcctagatatgattcagaaatactagtaaggagcaggttttactatggaaattaaacatcattcacagtgccattcaaaaatatgaattatccctattcaaatcagtcagtagtcagcaggagcccacatacctgataagtttaaagtttactgacctaggctaggaaattctcagagaacatagaaggaacatttgtttcctaatacaaatgctgcctgttgcacggtggaaaatattttgtttgacaagatttcctgaatatctgagaactcatttcaagctataataatagcagagtatcttaatagttagtccaggaaggctcttagcattataagctagagatacagtagagctacacagagcatctttgcaattgtattagactcagctttgtgtatttggtttagaatttgatccatgagtcaagtagtcttaacagttaacatttaatgttccaattccactcagcttttcaaattttaaaaagagccaaaggcataaataagaggaattaatttacatgtggaattaagtatgattcattttaattgtcagtcatttcactgtacctgaatttctgaccaataactaccgagtgctaaacctgagtttgacctgcatttatttacaaggttccttatgggagcaagtgtccctttaacagaagcaaagataatcttatcgtagcagtttttaaaatagctaaaaacttgttgcagcttaaatggccaacaataaacaatgagacatctgatcagtcaggtggtatcagtgagattagtagctcttaaacagaacaattacgatgagaatgtaaaaattagaaaaaggtttctggtaggtagaaaatagcaaagaggtttatatgctatgattacaactgtgtaaagagtatttatgcatgtgggcaaaagtgagaagtatgaaaatagttccgtttggatgcgatgatgacgtgtggtacttttctgttatgtttttaaataattttctttgatgttatgttgaattttaaatgacgttgattataaatctaacactagcagaaatcttaaataattgaaaaacctggggttttttttcccatagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaaggtaaggagccagtagacgcgcctgccccaagctgatctgagaggcacaaagcctgtgtgaggcagtggcctcctccagcactgccagaatcactgcggggatataactgtgtatgcacgctggagtcttattcttccccttttcaatttaatgaacttaaaaaacaacttattataaagttgtcagcagctcaagaaaaataatccagctagtgagtgtggaccgtttatttatgtgctagagaagcaagcacccagaagtgaaagagactggtagtacttttcagatcttattttcttaaaataatgtcttaagtcttcgcttaagtgagagaaaatcctttaaacagttcaaagaaagtcactgttgatatcaagtcttttatgtcaggcccatgccacagtgtgcctttccttggggacagggctttgttctgggcagccgctttgtaaacagggtaaaggagtgcgtgggaatggctagtaagtggggcataaaacacatactggcagccgtggagtctcccaaacatgtttaatgtcttgccttgctgtaaagctgccttttgatcattaagaatttctaattaggaaccatctttagccagtccatattctttgtgaattacaacataaccactatgtaatgctctcatttttcctgattttgcaaaactaacaaggagaagccaaaaacagaattatgaagggtcagtctttgatgttaaaattcctcatactataatgtgtattcatgttccattttctcccatgaccctctaatctagttggtttccaagtcttttatacttcctggttctaccttttgtttctgttcctaccacaccactctcatcatttatttctaaggtattacataaatctgttcaagatgctataggggttatttctgcatggacatgaattgacttcactgctcccttaggccctgtcgaattctgggcaggattccaagatgctgtgacatccctgcctttgttctttcccttctccattctgttcctatactcttctcagactctgctgattcttttctaaaataatcccttgtagaagctccactgcttccccactctctgcccagaaagtgttctgtgattttgctctcagccttttaaatgtacttctcagtattctctccacaccctctctaagctgggcctcactggcctctatgtacatggccttcccccscaaccgcaactcccatagcacctcctatctctgcacttcactggacatcattcttacataaccatatccctatttaaatggtctgctctttgtaaacaaaaaacatattggttgactatgatactagatgctcagcatttttttttttttttgagacagggtctcactctgttgcccaggctggagtgcagtggcacagtcctggctcgctgcagtctcaacctcccgggctcaagtgatcctctgacctcagcgtcctgagtagctaggactacataatttttaatttttttttttttttttttttgagataggggtctcactgtgttgcgtagtctggtctcgaactcctgggctcaagcgatcttcctgcctcagcctcccacagtgctagtattacaggcgtgagccaccatgcctggccagcaaatattttttgaatgaaggaatgagtaaacgaatgagtgaacaaagtaaaagttaggagatgttagttctgagggcttctgtcccattacctaagcagaggctatttaaacccaataaaagaagtaaggcttttgacaaaggccacagatacctattagctagttacatgacaaaaaaactacataatatttctaatcttcacttttttaactgtagaactggagtagtaatatctatttcagtatcatcatcaggggttaaaggtgaaaatatacataaactgcataaataccctagggtgctcatctaatatcattattttacctacatgactggctccctcattcaggtctctgtttaaatctcacttcccaaggaaataataatagtatttaataagtgtgtactatgtgacaggcactgtcctaaatgcttgacatatattaactaatacaataatcctaggcaggcactatggttttccaattcttgtagatgaggaaactgagtcacagagcagttagatgaattgcctgtggttaaaaaatgttctaaatgcttactctcaatatctatgtatctcgtctatgaaccacactttgggtagccttgggatagattgttaggaaaaaaaactacttctttctccagtaacttttcccccaaaattactgtttaatgttgatggtattttctccaagagattatccaagattgttcataatttttcttagaataaaagttccctttcacattctggcccaaacacttgtggacagacacttaagatttcctgtgtaacgtcagtttgtgtgcagagaaaagagaagggtggagggaagctccctagaagatatatacttaaagtatatttcatatgcagccacagcctcttaaaatacagtcacattttatatgttaaatcacatttcactgatcacacactattttattatgctctaggttttttttaaactatgaaaacatccagaatctcttatttttcttaggaaaaaacagaaaatcttccttctgtccataaagatctcattcatggagtttgtaagccttccaggttctcataaaattcagtataaaatctatcaactgcattaatgagtcaaatgaatatttataactctaaagctattttcagaaaccacacattcagatcaataccttagggcagcagagcttcccatctgatacttctccccttctctccatcagccattccccattgacaggtaaaagacagttacctagaaaatgaacaactcttggtccctccatccttttttccccctttgctagatgctgtttaatatttgtgcctatgttgccaaggatatggtaaggcaagtgtcatatttcataaaagacttccaaactgtagccaggacttgagactgttctctatcatatggcattccccacaacactaccgcctcttcctctgccatggtatcttgtttttaaatatggaacataaatttactatatctggtagttcctgcttactgtaaaaaaaaacttaaattatataatttttcaaaattaatttcaaattttttgtcaggccttgttaattttaagagtgaacatgacttaccaaaggctaccaagcactcctgttggaattgattctggtagtgttgcaatacttttgttttgttttgttttcagttgatttatctgtttattcccatttgtctccattttccattctcatttctctcactgctcccattggcaagcattctagtatgttttatgtactgcattttatttgtacatcttttaaaatacattttttgttgtgtgttggcatttatttttgagttacgtaaatgttatggattttacactgggtttttctcagaaccatgttgttgttgttttcttttaatgccattttactgttctaagatccaatccagtattcctcttgacatttagctgttgtcttttttttctttttaattgggatagacttcatatactataaaattaatcattctaaaatatacaatttggcctggcgccgtggctcatgcctgtaatcccagcactttgggaggccaaggcaggcggatcaactgaggtcgggagttcaagaccaacctgaccaacatggagaaaccccacctctactaaaaatacaaaattagccaggcgtgatggcatgtgcctgtaatcccagctactcgggaggctgaggcaggagaatcacttgaacccgggaggcagaggttgctgtgagctgagattgcgccattgcactccagcctgggcaacaagagtgaaactccatctcaaaaacagaaatatatatatatatatatatatatatgcatttcagtggtttttagtatattcacagggttttgcaatcattaccactagttccacattttattgctccaaaaagaaacttcatacccattagaaatcacttcccattctctcgaaacccccatccctaggcaaccacttatccactttctgtctctgtggatttgctgggtatttcatataaatagaatcatacaatatgtggccttttgtgtctggcttctttcatctggcaaaatgttttcaaggtacgtcctagttgtagcatgcatcagtactgcattcctttttatgactaatgaacaatatttcattatgcatacatatatttttcttacctattaatcatttgatagacatttcagttgtttctactactgtgaataatgccactacaaatgctgttttataggtttttgtgttgttttatgatttcatttttcttggtcgtatacctaggagtggaattgttgggtygcatggtaactatgtttagctttttgaagaacttcaaaactgttttccacagcagctgcacccttttatattcccaccagcaatgtatgaggcttccatttccccatatccttgccaacacttattttctgtttcaggggtttgttttctagccattctagtgggtatgaaatggtatttcattgtggttttgattggcattttgctgatgagtaatgatgttgaacatctttttcatgtgcttattgactatttgtaaatcttctttacatagagaaatgtctatttaaatcctttgccatttataactcagttatttgtcttttttattgttgaattgttttctgaatactagacctttatcagatacatggtttgcaagtatttttctcccattctccatttgtctttttactttcttgatactatcctttgatgcacaaagttttaatgctgaagaaatctaattcctctatttacaggggcggtgcttgtgctttggtatcatagcatcatatgcttttaagatttatctgcattgctgggtgaccataattgattgcttttaactgcttgaccgttttccatgagtatttaccacaaataacctgtccacttccctatagacagtcacattgcctacaacactacagtattacaaacaattctataatacacatcttcacatatctatgttacaaaacagtgtgagaagccaggcattggtggcacatgcttgtagtcccagctacacaggaggatcacttcagcccagaagtttaggccagcctagataacatagcaagaccttatctcttaaaaaaataaaaaaacagtgtgagaatttctgggagtgaaattacttgatcagagggtatacatgtatttgatttaatattgtcagattgttgcatccatctactcccaccagcaaaacattgaggattctgatactktacttccccaccagtactttgtattatcagcttttgaatttgctagcctaaagcatgaaggtgttgtcttattatttaatttgcatttctctgattgcccatgaatttcagcatctcttcatatgcttgagtttttttcttgtgggatttctgtgttgttgatatttattggatactcatgaattatatggacttcagtagtacagttttgttttagagactataaatatctatctttttctgccatctgtatgttctttgaccatggtaccctttattatacagaaattcttaatttagatgtaatcaaatttgtcactttttacctacagcttaaactcttgaggttttatttaagataagtcattttttccccacatcacagagatttttcttttatatgatctaataccagatttgtaattttgatttttgtacttaggtctttaatccatctggagcctacctttgtatgtagttttaggagggatgtagttttattttttattcttaagatgagccagatttcccaacaccagctattagacagcacttctttgccttatttatttgtgatgccatctctcctatatatcaacttcccctttaaacatgagtctccaagtcctctattctgttctattagtttatttgttcttgggctgatgatatgtgtgtgtgtgtattttttatttttttatctgtaagtttgtgatacatcctaatatatctgcttattagggaaaacctatctgtctccctgtttctcaaaattgactacatattcatggaacttttctatataaaattttagaacaaattattaagctcctccaaaaaaaatcaaagtgcagttttttggggatatattgtgtatacgcgtatataaatatatatgtgtgtatgtatatatattttgggggtggagaatatctttacatattaagtcatctcaccaaagatcatggactgtatttccaattattcagctcatcttttatgtcctttaatagagttttagagttctagtatgttctctcatagggttcttatttactcttggtaaggtgagtctcaatagattataatgtttattgctgtagtttaactgtggattttgtttttatcttttgaaaatacactttcttttaagtgtattattataggcataccttggagatactgcaggttcagttataggccactgccattaggtagtgaatattgcaataaagtgaatcacatgaactttttggttttctagtgcatatagaagttatatttacactatactgtagtctcttaagtgtgcaatagcagtatgtcttaaaaaacaatatacataccttaatgaaagtatactttattgctaagaaatgctaatgatcatctgggcctttagtaagtcttaatctttatgctgatggagggtcttgcctcgatgttgatggttgctgactgatttgggtggtagttactgaaggttgaggtggctgtagcaatttcttaaaataagacaataaagtctgccacattgactctttctttcaccaaagatctctctgtagcatgtgatgctgtttgatagcattttacccacagtaaaacttctttcaaaattggactttgtcctctcaaactttgccwctactttatcaactaaggttatgtactattctaaatcctttgtggtcatttcaacagtgttcacagcatcttcaccaggagtagattccatctcaagaagccacttctttgctcatccgtaggaagcaaatcctcacctgttcaagttttgtcatgagattacagcaattcagtcccaacttcaggctctacttctaattctgttccttgctgtttctaccacatctgcagttacttcctccactgaagtcttgaacctctcaaagtcatccatgggaactagaatcaaattattccaaattcccgttaatgttgatatttttgacctcttccccatgaatcacgaatgttcttaatgtcgtctagaaacctttccaggttttcagtttgctttgcctagacccgtagaaaaatcactatctgtggcagctatagacttaccaaatatatttcttaaaatactaagacttgaaagtcaaaattactccttgatccatgggctacagaatggatgttgtattggaactcatgaaaacaacatttatctccttgtatttctccatcagagctcttgagtgactaggtgctttgtcagtaagcagtaatattttgaaaggaatctttttttctgagcagtaggtctcaacagtgggattaaattattcagtaaatcatgctgtaaacagatgtgctgtcatccaggctttattgttccatttttagagcataggcagagtagatttagcataattcttaagggccctaagatttttggagtgtaaatgagcacatgaatttaccagctgcattagcccctagcaagagagtcagctgcctttgaagctttgaagccaggcattgacttctcctttctagctatgaaagtcctagatggcatcttcttctaataagaggctgttttgtctaccttgaaaatctgttgtttagtgtagccaccttcaccaatgatattagttgaatcttctggaaaagttgctgcagcttctgtatcagcacttgctgcttcaccttgcagttttatattatagagatgacttctttccttaaacctcatgaaccagcttcttctagcttcacacttttcttctgcagcttcctcagctctcagaatggaagaaagttagggccttgctctggattaggctttggcttatggaaatactgtggctggtttgatcttctatccagaccactaaaactttctccatatccagcaataaggctgtttcattttcttgtcactcatttgttcactggagtaatatttacaattttcttcaagaacttttcttttgcattcacaacttggctaactggtacaagaggtctagctttcagcctgtctcaggtctcaacaagccttcctcactaagcttaatcaagtctagcttttgacgtaaagtgagagatrtgcaactctttctttcacttgaatacatagaggtcattgtagggttattaattggcatgatcaatattgtgcatctcagggaatagaggggcctgaggagagggagaaagatggggaaaggctagttgatggagccagcacacacatatttatcgattatgtttgccattttatatgggtgtgatttgtggcacccaaaaacaattagagacaagtaacttgaaattgacatacccagtaagcaaaggtggaagacctgggaatttccagtgggtacaagaatataaatatcaaagatcactgaccacagatcaccataacagatataataataatgaaaaagttagaaatwttggaagaattaccaaaatgtgacacagagacatgaaagtgagcacatgctgttggaaaaatggcactaatagactcgcccaatgcagggttgccataaaccttcaatttataaaaaatgcaataaaatgaagtgtactaaaataaggcatacctatacttacagacagaaagcccagcaaaaatgtaattctcatcgaaggagagatatacttaacccattgctttactattttaagaattttcaaataaaattcagagagaagataggcctgtttgacattatggaataaatatttgactttgtgaagtaaaatagcttataacagaaaaaaaatggagaagccatgtagcacgggttgaaggactaaaaatgaaaagaatcccagtgataggaagttttacttaaatttgatgaagacaacaaaacaacaaaaaacatgtaactttttttttttttttttttttttttgagacggagtctcgctctgtcgcccaggctggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcagcctcccaaagtgctgggattacaggcgtgagccaccgcgcccggccaaaaacatgtaactttaaaagtaagcaccaatttgtggtacattttgcctggaactgaaatgtctcatctggaatggaaggtagaggaaaacttgaaattgatcagattacttctattgtcctgctctgatgttatacactcattacaatagccaagctagtaacgccgataaattatctctcttgaccacatgcaaaggtacaagtatctcccagtcatctcattggcaaatggaattttccccatcattttccatctccttaatagtaaccatgaatttacagcgaccgaagacaatcgaactctatactgggcagtaaagtttagagacaggtaacttgaaattgacatacccaggaagcaaatgtggaagaacttatggaaatttctagtgagtacaggaatatcgagataactgagatgtgattcttgcaatcaaggagttcagagtctagtaggagagacaggtgttctgccagctctgacacaatgtgggaaatgctgtgagaacattgtgatcacagtgtgcttaaggtgccaggtaggatttcacagaggaggtgacaatttgaacatgaggtgaaatggaaagccaggagtgcccaggtaacaagtatcttatgagcaagaaaacgtcaccataggttgtttttgtttgttagtttgagatagagtcttgctctgtcgcccaggctggagtgcagtggcatgatcttggctcattgcaacctccacctcctgggttcaaacgattctcctgcctcagcctcccaagtagctgggactacaggcacatgccaccacacccaactaatttttgtatttttagtagagacggggtttcaccatgttggccaggctggtcttgaactcctgacctcaggtgatccgcctgccttggcttcctgaagtgctgggattacaggcatgagccaccgcgcccagcccaccataggttttttacacaaggcagtggcatgtttcaacttatgtgttaaaactggagtctaaggtggcaaagagagcagttaggaggtcagtataagcagcttgttaaagttactcargaaaaataaaattcatgatagcaatataaaagagcaacaaatttccaggtctccaaaaaaaaaaaaaaaaaaaaaagttcatagcccactctactcccaccctcccttcctggaatacttgaccttaaagaggaaacacaaccctctgggtaagttctggtccagaggttggttctgcatctccaggtctagtacacattgttaaatccatgttcacacccaagcccagcagccagagggcgtagaaatcctcaggggccacctggcttggccatataccatttcttcctcctgccactttgtactctctggcctgtgtttttagagtactctctagcttctagatacaagaaacttttcaataaaaataagcaatttatctgtgtttttagtctcacagcactttggaaagtaacaacttaacccaagcaataaaatagtgatgcatgtattgtagtaaagcctgaagtttcagctttctcaatggaaactgcttcttaattatctcttatctttaacatgagattttcactattgtattctaagattcaggttatatcagcttccacatgtttttctaacttaaagtaccctctacatttaacatttttataaagcaaggtaaagatttcagcatatatgtttaaagagaaatgcaaccccaagtgagagatatcattttgatgatgatgatgatgatgatgaaaatgatgatagttataatagaaactgttatattgtgactattatatgccaggcactattctaagcatgtatatttataagctcctttgatactataacccagtgagataactgtatttccccttttataggcaagacaattcaaagcacagagaacataacagattttctcaagaacacacagctagtaaatgatgcaatcaggcttaaaccctgtccatcttgctcagagttcatggtcttaatcattaagctgtgctccctctgatactttaaatatcctatgcttttatatttaaacataataaaatgttcaaaagtttcaacttcaaaaatatgagtctgccagccttaggcatcttgtttaattgtcgcctccttgccatctagttctaggtgcaggcagtcactatgcttagctatgaaagctaccttcgaggaacagcagggagtccagagctgttgggaatgatacaaaacaaatgtaatgtttttcacctatatttgtgttctgagaaaatggaagcagtagaatatttataaatatttgttagcactcaggattctataagtttgtctttggttctcagtggcaggcaaaataactgctcctatattgaagatgcaggttcaaaggtgtgagtgtggtttgcagactggcctccgtgttccagcattcctgagacccggctttgttatctagaatgggttaccaattattaggtgtgtgctctggaagcccatagaataggcaacagtatagttcctggagctctgtcttctagataaatattatgttcatttctgaattttatgttatatggatgactaaaacacaggtgaaaatggggacataatatgattcctgttctcctgagacataaacgttaatcaaaagccacagggaaaaagatgttaatgcgccagttccagacagctgacaatagtgctgttcatgctaaagccactaaagtcagtacagcaatagccatctgttattgtctcaccttcacagatccgcttggccttcacatttttatgtacaaattcttatttctattgttttctcatttgaacagagcatcatggtccaccatcaggaacaaactcagccaggcaaagcccagccctgcagcacaggcccatgggacagtcacaggccaaccacatacctggggacaggtggggctattttcaggtttttgtttttgtttttttcttattctctccttattgctctgctgttcataaccccactccccatcatccacccccatgcagtaatgcagatgccagctgttgaggtcaaaatgacaactcttgcctgttcctcaaataccgtccccatcacctccacccattcagtaccttcgtccctcttccagcctccatcccaggcacagcataattatccaatcttgcctgacatgcgaggattagaaagaaatgacatagcatctggctctgctactcttggtcctcayagttttcatagggaagctgcagacccatatggattgctgtcttatcagaccacctgagcagagcaggttttgtgtgtatttctgtcttctttcattgaaaatattagcctagatttccagaaatccagcatcttcacgggcattggtgctgcaggagagccatttttcactgtgacagggtcagcttaactgccctctggtgtagttatttgattgcagttttctttgatataaactgctctgagatgtccttaaaaaaattgtggatgttgacagacttcaaagtatgttggaattaatgaccaggtttctcctagcacccctctgattttagatatagtctgtcttcatagtggtttgtcagagggaaaatggcaaggtcgagcttttaaaagaaaagaaattaatctgcctttagactgtttttcattttctcagttcagagagtgacttgatttctctctcttgtagaagtgccctagaaggtgaaattggaaaagatgtctccacttcttacagacattcttggtcagaccacaagcaccttgcacagcctgacaccgcagtaatttcagttgtaggcagtcggcacaatcaggtaaacaaacatttccccagatggggagtgatattttgagttgccataccactggcattggtgaatttttattgcaaatcagttcagataaatttgtttccaaaactaataattctcgaagacctgccatgtgtttggcattctgctggcattcataggagaatgttaggagtgaaagaaaagtttcccctacagcaggagagctttgaacccttggttaagtacttagaagtaaatagtattttagataatcaaattcaggtttttttgtttgttacttgtttgtttccaggaaaattagtcaaacgctacttaaaggaagcactttccaaaattctgttctctgattgttgcattgcacattgaccaactagaaaagacatgtaaccttcagwttaatttaggctgcatttataaaaattaagtagccctttaaccaaaacctacattccttctttacaatatagaaatgcacattgagagtataaatcatttcttccagctatagaagtaatctttcttcaaaatgtaagtaaacagtccatgagaacttgcttttcttatacttctttctctctagaaccttggttgttatccagtagagctggagagaggcccccggggctttggattcagcctccgaggggggaaggagtacaacatggggctgttcatccttcgtcttgctgaagatggtcctgccatcaaagatggcagaattcatgtgagttggtttctgtctgtaaccttaggttcaggctctagactagaaacttcgaaagatattaataattgatttaaagggaatgcaggaacctcctaaatctaaaaagcaggatttgtcatcactggtagctaaaaaaggcaaatgcttgtcattttgcttttctaacgccctgatgatttcatttcttctcttcagtgtgctaaaccatattgcagttatgccacttttgccttcttgaccttggtcaataagaaaattcatttcttattcacatagtcaacatctgagggtaaacgaattaataaatacacttttcatcttaataagagtcttgagaaagcgaggatcaaatagaatckttaactttttccaggaggcaataggcccaggattttttttccccactcttagctaccgggagaggtaactagaggctgaaaagcgtggctctcaacatttcttattgtttgaaggcctagaattcacatcagtagtattccatcatagatgttctcaactctgaaacactgtgacttcgtatagggaactgcagaccaaattgtttatagatctgcataagatagtttttccttcttctctggatgttaattaaagaggaatcttatatagaagacatttgctgctgggcgcggtggctcacgcctgtaatcccagcactttgggaggccgaggtgggcagatcgcctgaggtcgggagttcgagaccagcctgaccaacatggagaaaccccgtctgtactaaaaatacaaaaattagccgggcctggtggtgcatgcctgtaatcccagctacttgggaggctgaggcaggagaatcacttgaacctgggaggcagaggtcggagtgtgccgagatcacaccattgcactctagtctgggcaacaagagcaaaactccatttaaaaaaaaaaaaaaaaagacatttgctgtcttcaatttaaaaaaaaaaaaaacttaactcactggcattcagttaggtgatacattaaaaacttttaatttctagacaccgttccccctactactcaaaagaattttggatttcctttccctgccaccagtaggcatcagagaaaaggaactttttttttttaattttaaactaagtaattcaattagaaaggcaaatgatcctggtaattattagatggtatattctagtaattattagaaaaggtgcttctgggtgattgcagttttgaatttttcatttcactcccattagtcatttcataaacacatwttgagtgtttgcattacccaaagctttatgcatgctactgaatgagttgggagagtgactcaaaacaaataagatattatcctccctcaaaatgaccagacacatgcacaagttcaaagggatgaatagagaagatttcacagaataggtggcattgacaggtgcataggayttcaatagggagaaattaaggagagaaaacattccaggctgaataaatgagcaatggcgtaaaactaaggaagtataagtcatgtacagggaacttcaaatggttgagtttacttagattttatttagaaaatgcgtagatgaatagaggaaatgagaatataaaagccgatgggtcrcaggcatamaggtcctaggcagtgggaagccatgggaggctttttagccaggagtttcccctcagagcaatctgctgataaaaatctgttagtggtgtgcaggaaggatgaagggactccaggtagctgtaatttatgcatacagtggtagtggtgggagtataacttgaatggtaacgctttggatggaagataagagatgcatataagttcaaatttcagtgaataaaggaccagactagatgaacaacaagtatcctttaaatgagggatgaaggaaaaggaagagtaaaggatgactcagaagccttgccccatctgtactacgaaaaccatcagggaagccaaggggagaaaggatatggcaaagactgatggtgtagtaagttggagtcatgttgaggtgaagggaacagctagtagagcaggtgtaaatgtttagcaggcaattactactagtagtggtagaagcccagattgcgacattactgagaagtgatgattgaaacctttgtggtagataagatcactaaggaagaatatttagagagtactyagccaagggcagagctctgagcaaggcatgtaattagtggactagataaaataaagaaaatgggaaggcgcagcatgcagagccacagagccaaagctgcagagtgtttatgacaaagagggaccgatggccttaatacagctcgtcaagaactgctgaatctactttcttatagagacaatttcatatsgtgacaagaacatgggtttggaaatcagacaggacattctcctgagtttcctcatctgcaaaatgcagaaccatatgtaatatacatggtccaagtaaacttcttaaagtcttaataagagcatcttgagacactgtttacagaggatggcatatttattcctggttttcttggtcctttcccctcccctcccctcctatcttctcttctctctctctctctcatctctctctctctctgtctctctctcacacacacaacctattcagttactttacatctgtgtttcaatgcttctattgtaaatagtgtcacaaaaatccaattaaatgataaattaggatataattgttttaaatgttggttccaaatataaccctcagatccactaatctcagtaaaccaaaggcaaacaggccttaaagcaaagtctagttctaaacatgtcattctcagccaggagtggtggcacatgcttgtaatcccagctacttgggaggctgaggtgggagggttacttgagcccaggagttcaagaccagtctgggcaacacagcaaaacatcctcagttaaaaaacgacaacatgacatgctttatgaatgagcagaaactttagaatctaatgatgaaakcagcttttatttcaagaataaactctgaaaacaaaagcaaatgagcaattaactgttagaccccagtgtgctctaacctgtaagaaaatgtcagcttttcagagaagtcactttttgggctattaaattatcaaaatcttgacttgatacagctcatgagggctttgcatataactagtgctcaataaaatgttattgatgacaactttctctggtggccgctgtccaaatgataagagtttatctctagctgacactcgcaccacggagccacctgagtgcccctctctgcctcccccgcttgcctctcctcttctccctttattaggttgacagctgtactttgtgtcctatacctattattccgtatctccagcacctgatatggtgccttgaatattcatatcaggtgctccatagatatttgttgaaagagtaaaatgtatggataataattctagatactgagagaattattgtgtgtgtgtgtttttatttttaagatcagttcccagcacttattactgggtgaacaggactggggatatatgaagtaattagcaacaatcttagtgtcattaagaaaacaagaaatgttaatttgtaacatagatggaaggatattgagaatcattgagaggttcttcctttcggtctggttaagatttagagaggagagagaaaaaaagtgttctgggataaggaactgagaaatagctgaatggaaaaggttcatattagggaatagtgtcaaacttaaatatttaacgtagaacataatcagatttagaaaatattaagtgtttgctgtctttgaggcaacatgtattttcctacacaacatgcgtttttacttatattagtctcaaaaactctgagataggtgacattatccccacttacagatttaaaactgaggctcaaggagacttagtcacttgcagagatcactcatcctgtgcaggccacagtgtgacccaggtatgaccctagtccgtcgtcctcgaagatcggttcatgtgctttccgctatgtcaggtcttggcttgagtccagtttggattggatttcattgataggcagacagtttcttaacaggttgtgagataatataagccatgtggtagaaatattttgtcattttaatacatttgtagtggatgttgtttttaaaacgacaagactgcctataaaaaaatagtgatttgtttaaaaaagggaacattctttttccctattcttcctacttcttttcttttggttctcctattttttttcctttctcttttctttcctctctcttctctgtccccataattatttttcaataatacaaaactgaacttgaatctttgttctatttatcaaaagatgttttctccaaattattttttatcacatttttaaagtgacttaaaatgttaaaaggatgtttactgggtgaatttactcctctgaatttccctctyagaagagtctttttcatctgtagttttgtgtatgtaggtctctgcagaatttctcccactctgagggcctgtctaccataaatcttaaagcaatggctccccctccttcccctcattcagttttaaagttaaacagaaatgacacctggtggcaagtctgttcaattacaagtttttgttgttktttttttttgcagtttattgcaggaaaagaataaaaagtgttctgggttggagagcttaagctaaagaatgtgattgaaataaattataacctcaaacctgttttacaagatatgcccaaagcagtgtccaaatactatctactttaattttctttatcagcaagattatatatctagtgctaatttcttacctacattgcctcatgaaaatgattcttcttccatcatttatcaagggaaatctaagtattggcttttgtttcacttatatattctggatagtaaggggtttctaaattattctccatcctgctgtcttactttggttttattaaggtgttttcatcttacatattaaatccatcaatcttgtttctgatattctccatttgttcaagagtaagcctcccttgtttaaaataagtatgcaataagacctttagtctatttcatagttgacttgaatttttttgcattgtatagaatggagtgcagtctacagttaaatcttcgtaatgatacactttaaaatagcttgaaaactaatatttgcacttggtatataatcatgttttatcttaagtcctcccagaatcccacgaaataggtactaatattatcctcatttaacagatgaaaaaaatgagaccacaacactagaaagaggtggagcacaagatgtgaaccacagcctcctgaccgcctgtgccatgctgtatctgtagaaagagttggcccactgacctttgttaaatattgagtccttctgttttgttacttctggattggcttattattatttctattctttagtcaccttgcagctagcttcaactcaaaggaacttctggattgttttagtaagctcttacaaatatttgagtatttgctttttggaatttcagtaatatgccattgtctaatttttctgttttgaagccagtatccttcattttacatgtcaccttgaaatatattttttcaacttttttttaataagttcagtgcggcacatgtacaggtttgttacacaggtatattgcatgattctgaggcttagaatatgaatgagttcccatctcccaggtagtgggcatagtacccaataggcagttttttagcccttgaccctctccttccctccccccatcttgtattcccgtgtctgttgttctcatctttgtgtccatgtgtactcagtgtttagctcccaattacaattgagaacatgaggtatttggttttctgtttctgcgttagtttgcttaggataatgatggcctccagctccatccatgttgctgtaaggggacatgatttcgctctttttatggctgcatagtattctatggtgtgtatataccacattttctttatccaatgcagcattcatcaacatgtgtttgcttgaaatagatttaaaatcagtaccatcattatgtttaattaggtctgttccaaagttatacttgacttttacatattttccctttttcttttaaaataactcagacatttctagtaaatcacaatggtactaaggtatatcttattctgatccctagttttatgtttattttcctgaaaaatgatttttttttttttttgagacggagtttcgctcgctgcccagactggagtgcagtggtgcaatctcggctcattgcaacctccacctcccaggttcaagtaattctcttgcctcagcctcccaagtagctgggattacaggcatgcgccaccacacctggccaattttgtatttttagtagagacmgggtttctccatgttggtcaggctggtctcgaactcccgacctcaggtgatccaccagcctcagcctcccagagwgctgggattacaggtgtgagccaccatccctggccctgagaaatgattttacactaacatcactaagtttatgccagttactggttttaaataagtgttcatattaatctattctccaagtttaagtttttaagaattttaatctataaagatgtcatttattcaaatacctcatgtatgtacaggacatagcagcagttcaaaggaatgagcagttctccctggaggccaggaaaggcttcaaagataagagccctctgcccaggttttaggagatatatttaaaattcagctcaagtttgaaagtacccttcacattcggacatagctctgtagtatcatttggattgttgtttgtaaaatgtctaacatgtacccagtgctctcctgcgagagttgataagaggacagatggcagcaacaggaagagacaatgtccaggtttactcacgcataaaaaccctacacagcaagtgcccaggtttacttatgaaaatcctacacagggccggscgcggtggctcacgcctgtaatcccagcactttaggaggctgaggcgggcggatcacgaggtcaggagatcgagaccatcctggctaacacggtgaaaccccatctctactaaaaatacaaaaaattagccgggcgtggtggcgggygcctgtagtcccaactactcgggaggctgaggtagtagaatggcrtgaacccaggaggcggagcttgcagtgagccgaggtctcgccactgcactccagcctgggcgacagagcaagactccgtctcaaaaagcaaaacaaaacaaacaaacaaaaaatcctacacaggaaagttttatatggctattaaagatctgggcatcttcaaatcaagaaccaaattctagaatttgattaacattctaaatttgatttctataaatttagaaaattccaaatctgattctagaatttgattcttgatttcaagatgtccagatcttagttagtagccatataaaactttcctgtgtaggatttttgtgagtaaacctgaacattgcyacttcctgttgtttgttgtcatctgtcctctcatcaactctcacatggcagtactgggtacacgttaggtattttacaaacgaaagaatcacttagcaaggttgaatggctcaagagctgacaaaagcagaatttacaaaggatgcatagtttcatgttgttcctgtgaatgttctctgtctaggttggtgaccagattgttgaaatcaatggggaacctacacaaggaatcacacatactcgagcaattgagctcattcaggctggtggaaataaagttcttcttcttttgaggccaggaactggcttgatacctgaccatggtaagtaaagtagcccactagtagctgaaaagttgtatattagggaggggacagaagaaaaaggaatatatatttggagaggatagatattttactagttaattcagaggtgaatgctagaaccatgaaaagctagttacatagcagagttatcataaatagtattagaaaacaagtgacttaggcaggactttcgttggaatggaatgtattttaaatttaatcagaaaaaacatatagttgtttttgtagagaaatgtacctattaaaaaagtgtattagaggcaaacaatttaaataccataaaaaatgttttaaatctcttcaaaatatcccagctttttctcttacttagctaattacacattaccaaccaatatttttatttctgtaaagcaagataagtttatattataatgaatgcgcagcatgaaaacttaggcttttctggtgactcggcaaaaacaagttgctatcaccctacctggagacagggagttggacctgagaccatttctgtcctgtattaatgttaaacttcctgggtttccatggcatgttttgaaatatcatggtatttgaaagtcactgttttttgagtgcactattctagaaataaaggcagtaccacacccacgcagtacttgcctyatctagctccccacctcctgccctaccccaccccaccccaccgcttttgagggataagtgtagacataacctcctacagtacccttccagcttatgattctctgactgtattatcttccaccatctgcttgtaaatcatatgttcccagtgacatctttgctaactgcactgatttttttttttttttttcacatagtcctaggctttttctcttccctcttcaggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctatcttctgcacttttcagtcttcttttgacattaaatttgacagcttaatgcaagagaattattacaaatgcccatgagcctcattctggttaccacagtttggtttcctttattaattagtgattttgccatatcctaaactgtatcaattcataataattagtgagcttcttgggccacgtaatttggttcagctttataacttgtaagttctaattgggctttactaatagagaatttacagatcatatattatctcactaattatatgtaattggaaaaaatgaatattattttrtgtatataaacaacccatccttcatgtatgaacagatgtctgtacacatccgcctttatagagagatatgttgtaaacatatacaaactgtataaaatactcaggctttttaagcagttacgacaattcaaatggctgtcaaagttcaaaacgtattgttcctatttgtaattctaaaatttaataatrttccattcaaatcacttttttaggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgyctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcagrctatacgggyagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaratagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaaaaaaacagtttatggcctgcatttcttttactgtcacattggtttaatgttgctttctaatggtggagctaggtcccatcatagtctgagtcctcaaatagattttgtccctccaagtaacaaactttcaaagtcctaaaatcaggaagagtcttataataatgattttacctctataggtatacttttatttatttataaatagagtttgaaattctttagagttgaatatcattataaccatttttcatctttcattgtaaagaaaatagctttggataaataatttgctactgaaaatcctttcttaacactgttggggagagaagaggagtttctcattggaaattcagctactagacatttataatggatatagtaatatcagtccagttactacaaggtcacaaaatcccatttcatcagactaatgattcacattatctttaaagatcatttatttagttttatacttacttttagaatgttttgacttaactcggtatgaaaagtgcctaaaacctacttcaagaccacggttaattttatactcttttaaggtgaaatataaattcccacttaccattgcaagaacgcatactaaaaataaacccacggtcgggcacagtggctcatgcctgtaatcccaacactttgggaggccaatgcaggcagatcatttgaggtcagaagttcgagaccagcctggccaacatggtgaaaccctgtctgtctctactaaaaatacaaaaattagccaggcatggcggcaggtgcctgtaatcccagctactcaggaggctgagacaggagaatcgcttgaacccgggaggcggaggttgcagtgagctgacatcacaccactgcactccagtctggctgacagatgatgagactccatctcaaaaaaaaaaaaaaagtatacccaaacttctagttagttcccagaccccacagtgaagatgtgccatagcagaggctgcagaaacaaacaggcagtaaaatcgttttgttgttttagtgaacatattttcttactggtcacaacagggagaaaagctttgagatattattacattgtctccctagtgagattagaaggctaagatcctatgatattgtctttagttacatcagtcttggaccaggcagcttttgaacaggaacaactcttatttcagaagtcttggatccagaaaggcacttggctttttattctacatgagaataccttgttacttccctttttaatagcaagatttaaaagagaaataaatgtaatcatgtagaagtaaaaccaaatgcttttaaacatgtagacaaagaattattttatgtttaatatgtccaccattcaaagagtaaggatttataaggcaaggagtattcagattaaactgtataaaacaaacagtctcactaatgacttccagaaagctgtatttaagttgaagcttagtccacagtggagctaaggaacattgatataaataaacttgttacaaaatgtgacatttcagtctggtatgaggaatacatcagagcaagtttttacatcatcatggcatgctccaaggcctaaaaactatttgtgctttgaaacaataacatttatttattcgggtggctcttttctggttctattagagtttatcgggaatatgacttgtttaaagcatgtcattattacatggaatctataatctttgcttttagctagctgaattaacttaatatatcaactaagttggatattttttcaacattgctaggcaagtagccttaagaattataaagccaggcatggtagtagacacctgtagtccaaactactcaggaggctgagctgggaggatcacttgtgcccaggagtttgagtccagcctggatgacacagtgagaccccatctcaaaaataaatctttttcttttttttccccttgagatggggtctcactctgccacccaggctggagtgcagtggcacgatcttggctcactgcaacctctgcctcctgggttcaagcagttctcccacctcagcctccccagtagctaggactacaggcgcacactaccacacccagctaatttttgtacttcttggtagagatggggtttcaccatgttggccaggctggtctcaaacccctgatctcaggtgatctgcccacctcagcttcccaaagtgcaggggttacaggtgtgagccctgtgcccagccaaaaaaaaaaaaatttttttttaagtagtataataagggagtatgaaggcttataaggagttagaattctggctgggcgcggtgactcacgcctgtaattccagcactttgggaggccaaggcaggtggatcaggaggtcaggagatcaagaccatcttagccaacatggtgaaacccatttctactaaaatacaaaaaaatagctgggtgtggtggcgcatgcctataatctcagctacttgggaggctgaggcaggggaatcgcttgaacctaggaggcggaggttgcagggagctgagatcatgccactgcactccagcctggcgacagagcaagaactgtctcaaaaaaaaaaaaaaaaaattctatttaatagaaaactctgaatctttcttatgtatacattaaaataggaaaacatagccaagagctttaatttagcctaaacctatatcttgacaaataatcctgtgggtattttgcaatactgcattcaagtcaagcctaactattagcaaatacacaaatcaagagacatattttgtccttaataaaagataatcggctgggcacagtggctcacgcgtgtattcccaacactttgggaggccgaggcaggtggatcacaaggtcaggagatcgagaccatcctggctaacacagtgaaatcccgtatctactgaaaatacaaaaaattagccaggcgtggttgcacgcgcctgtagtcccagctactcaagaggctgaggcaggggaattacttgaacctgggaggcagaagttgcaatgagccaagatcgcaccactgcactccagcttgggtgacagagcgagactccatctcaaaaaaattaaaaaaaaaaaaaatagaaaaataaaagacaaccatttattaactagagtaataccctattataccttataggctcaggatatgctgcaggaaaggtatagaattattgcacatttgtgaaactcacacttcactattcaacatgggccccaataacagcagggagcaaaggattactaaactagccagtacatgaatagattaggtttaatgaattaactcccaagtgacacactgtatttggaagagagactcatctagcctattatgagtgtgtagatctaaaagttttcacacataaatttcattaatttgaaagattatttttaaactgcataggtccacttgcctctaaataaaatgaacctaaaataaaaacaaactatactttgtgagacatcctggtatttagaatttttctacctgtctctgaaagtcagaaccatactccaatgaggcaagtatttggttattcaacttctcaaagtgtttatattatacatgggccatattgtacatatttagaaagtctgtagatcagcagtccccaacctttttggcaccagagactgatttcatggaaggcaatttttccacggacctgggggcagggagaagggatgcagggagggggtggtttcaggatgattcaagtgcattacatttactgtgcactttattatttcattgtaatatataatgaaataattatacaactcaccataatgtagaatcagtgggagccccaagcttgttttcttgcaactagacgtcccatctggaagtgacgggagacagtgacagatcatcaggcattagattctcataaggagcacacgacctagatcctcgcatgcacagtccacaacagggttcacgctcctctaagaatccaatgctgctgctgacctgacagaggtgacctgacagaggtggagctcaggcagtaatgcaagcagtgtgagcagctgtaaatacagatgaagcttcactctcacctgcagctcacctcctgctgttcagcgtgggtgtgggtggctggggacccctgtggtatattatacacccacagcaactttaggagagataatttttcccaatataactgcagattataaaattaagtcaacaggtatttttcttacccttctatggttattactattccaactaaatgtatgaatggcctaatctaattgtttttacatcttggtttaatttctcagtaacaagtaattatcaccaaaatctcattccttttttgaaatcaaaacaaaagcccaagttcctagaaattattatacagggataaatgaggcactgaaggtgggagaaccatgaaattacagttgatccttgaacaacatgggtttgaatggtgtgggtccacttatatacaggcctttttctgtaagtatattggaaaatttttttgagatttgtggcaatttgaaaaaacaaaccatgtagcctagaaatatagaaaaattaaaaagttatatagatactagcctattttatcatttactataaaatacacacaaatctattataaaaagttaaaatttataaaaacatacaaacaaactgtacatggcaccattcacggttgagagaaatgtaaacaaagatacagtattaaatcataactgcataaaattaactgtagtacatactgagctactataattattttgtagttacctcctgttgctattgtggtgaactcaagtgtcaaaagatctgtttaaaacaccatgtgatgctaatcatctctgtgtgagcagttcatctctccataaaccgtggatcacagtaaaaagtgatcccttgcggttcttgcatatttttcatggttagtgcaatactgtaaaccttgaggacataaaaactgcaggacccatatgaagcaccaccagtcatagaagtgctcccaagaagcacagaagagtcatgacattacaagaaaaagttgagttgcttgataccatagattggggtctgtggttgcccaccatttcaagataaatgagtccagcataaggaccattgtaaaagaaagaaggaaagagaagaaagaaggacggaaggaaggaagggagggagggagggagggagggagggagggagggagggaggaaagaaaagaaaaactcatgaagcttttgctgcagttatgccaccaggcatgaaaaccttgcactttttgtgaaatagcttttaacttgcatttaaaatgcagcttcatgtgagtatgggagtgctctaaggcatatctatagattccaatgtgattcaagaaaaagcaaagttatatgacaaagcaaaaggaaagtagatttgctgatgaagaagcagcagacgagttcacagatgccattcagaagataactgagaagaaaagatatctgccttaacaggtttttaatgcagaagaaagtgcctattctgggaaataatgccacaaaggaaatttattagaaagagaagcaagcaccatgatttaggcaggaaaggataagctaatactgtgcaaatgcagttgtgtttacgatcaggactacacatatctgtaaacctgctaacccccaagccttgaagaagaagaagaaaaaaaaacaccagctgacagtcttttggttgtataccaagaagtcctagacaatgagaaccctttttctggattggttctgtcaatgctttgtccctaaagtcaggaagtaccttgctagtaagacactacctttgaaagttcttttgatactggacaatgcccctggccacctaaaaccccataaattcaacaccaaagcgatgaagtggtctctgtgctcccaaacacaacatctttaattcaggaataagggggtcataaggactttttagatccattacacacagtactctggaaaggactgtcaa
